United States Patent 11,312,770 (BISPECIFIC AND MONOSPECIFIC ANTIBODIES USING NOVEL ANTI-PD-1 SEQUENCES) - sequence listing, part 2

SEQ ID NO: 9928 - protein, 11 aa, Artificial Sequence
  Description of Artificial Sequence: Synthetic peptide
  XENP018930 vhCDR3
YYGNYGGYFDV

SEQ ID NO: 9929 - protein, 11 aa, Artificial Sequence
  Description of Artificial Sequence: Synthetic peptide
  XENP018930 vlCDR1
RASQSVSNDVA

SEQ ID NO: 9930 - protein, 7 aa, Artificial Sequence
  Description of Artificial Sequence: Synthetic peptide
  XENP018930 vlCDR2
YASHRYT

SEQ ID NO: 9931 - protein, 9 aa, Artificial Sequence
  Description of Artificial Sequence: Synthetic peptide
  XENP018930 vlCDR3
QQDYSSPRT

SEQ ID NO: 9932 - protein, 249 aa, Artificial Sequence
  Description of Artificial Sequence: Synthetic polypeptide
  XENP018931 1G6_H3L3_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9933 - protein, 122 aa, Artificial Sequence; identical to SEQ ID NO: 9915
  Description of Artificial Sequence: Synthetic polypeptide
  VH of XENP018931

SEQ ID NO: 9934 - protein, 107 aa, Artificial Sequence; identical to SEQ ID NO: 9844
  Description of Artificial Sequence: Synthetic polypeptide
  VL of XENP018931

SEQ ID NO: 9935 - protein, 5 aa, Artificial Sequence
  Description of Artificial Sequence: Synthetic peptide
  XENP018931 vhCDR1
NYWMN

SEQ ID NO: 9936 - protein, 19 aa, Artificial Sequence
  Description of Artificial Sequence: Synthetic peptide
  XENP018931 vhCDR2
EIRLKSNNYATHYAESVKG

SEQ ID NO: 9937 - protein, 11 aa, Artificial Sequence
  Description of Artificial Sequence: Synthetic peptide
  XENP018931 vhCDR3
YYGNYGGYFDV

SEQ ID NO: 9938 - protein, 11 aa, Artificial Sequence
  Description of Artificial Sequence: Synthetic peptide
  XENP018931 vlCDR1
RASQSVSNDVA

SEQ ID NO: 9939 - protein, 7 aa, Artificial Sequence
  Description of Artificial Sequence: Synthetic peptide
  XENP018931 vlCDR2
YASHRYT

SEQ ID NO: 9940 - protein, 9 aa, Artificial Sequence
  Description of Artificial Sequence: Synthetic peptide
  XENP018931 vlCDR3
QQDYSSPRT

SEQ ID NO: 9941 - protein, 249 aa, Artificial Sequence
  Description of Artificial Sequence: Synthetic polypeptide
  XENP018932 1G6_H3L4_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9942 - protein, 122 aa, Artificial Sequence; identical to SEQ ID NO: 9915
  Description of Artificial Sequence: Synthetic polypeptide
  VH of XENP018932

SEQ ID NO: 9943 - protein, 107 aa, Artificial Sequence; identical to SEQ ID NO: 9853
  Description of Artificial Sequence: Synthetic polypeptide
  VL of XENP018932

SEQ ID NO: 9944 - protein, 5 aa, Artificial Sequence
  Description of Artificial Sequence: Synthetic peptide
  XENP018932 vhCDR1
NYWMN

SEQ ID NO: 9945 - protein, 19 aa, Artificial Sequence
  Description of Artificial Sequence: Synthetic peptide
  XENP018932 vhCDR2
EIRLKSNNYATHYAESVKG

SEQ ID NO: 9946 - protein, 11 aa, Artificial Sequence
  Description of Artificial Sequence: Synthetic peptide
  XENP018932 vhCDR3
YYGNYGGYFDV

SEQ ID NO: 9947 - protein, 11 aa, Artificial Sequence
  Description of Artificial Sequence: Synthetic peptide
  XENP018932 vlCDR1
RASQSVSNDVA

SEQ ID NO: 9948 - protein, 7 aa, Artificial Sequence
  Description of Artificial Sequence: Synthetic peptide
  XENP018932 vlCDR2
YASHRYT

SEQ ID NO: 9949 - protein, 9 aa, Artificial Sequence
  Description of Artificial Sequence: Synthetic peptide
  XENP018932 vlCDR3
QQDYSSPRT

SEQ ID NO: 9950 - protein, 249 aa, Artificial Sequence
  Description of Artificial Sequence: Synthetic polypeptide
  XENP018933 1G6_H3L5_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9951 - protein, 122 aa, Artificial Sequence; identical to SEQ ID NO: 9915
  Description of Artificial Sequence: Synthetic polypeptide
  VH of XENP018933

SEQ ID NO: 9952 - protein, 107 aa, Artificial Sequence; identical to SEQ ID NO: 9862
  Description of Artificial Sequence: Synthetic polypeptide
  VL of XENP018933

SEQ ID NO: 9953 - protein, 5 aa, Artificial Sequence
  Description of Artificial Sequence: Synthetic peptide
  XENP018933 vhCDR1
NYWMN

SEQ ID NO: 9954 - protein, 19 aa, Artificial Sequence
  Description of Artificial Sequence: Synthetic peptide
  XENP018933 vhCDR2
EIRLKSNNYATHYAESVKG

SEQ ID NO: 9955 - protein, 11 aa, Artificial Sequence
  Description of Artificial Sequence: Synthetic peptide
  XENP018933 vhCDR3
YYGNYGGYFDV

SEQ ID NO: 9956 - protein, 11 aa, Artificial Sequence
  Description of Artificial Sequence: Synthetic peptide
  XENP018933 vlCDR1
KASQSVSNDVA

SEQ ID NO: 9957 - protein, 7 aa, Artificial Sequence
  Description of Artificial Sequence: Synthetic peptide
  XENP018933 vlCDR2
YASHRYT

SEQ ID NO: 9958 - protein, 9 aa, Artificial Sequence
  Description of Artificial Sequence: Synthetic peptide
  XENP018933 vlCDR3
QQDYSSPRT

SEQ ID NO: 9959 - protein, 249 aa, Artificial Sequence
  Description of Artificial Sequence: Synthetic polypeptide
  XENP018934 1G6_H4L1_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 9960 - protein, 122 aa, Artificial Sequence
  Description of Artificial Sequence: Synthetic polypeptide
  VH of XENP018934
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSS

SEQ ID NO: 9961 - protein, 107 aa, Artificial Sequence; identical to SEQ ID NO: 6247
  Description of Artificial Sequence: Synthetic polypeptide
  VL of XENP018934

SEQ ID NO: 9962 - protein, 5 aa, Artificial Sequence
  Description of Artificial Sequence: Synthetic peptide
  XENP018934 vhCDR1
NYWMN

SEQ ID NO: 9963 - protein, 19 aa, Artificial Sequence
  Description of Artificial Sequence: Synthetic peptide
  XENP018934 vhCDR2
EIRLKSNNYATHYAESVKG

SEQ ID NO: 9964 - protein, 11 aa, Artificial Sequence
  Description of Artificial Sequence: Synthetic peptide
  XENP018934 vhCDR3
YYGNYGGYFDV

SEQ ID NO: 9965 - protein, 11 aa, Artificial Sequence
  Description of Artificial Sequence: Synthetic peptide
  XENP018934 vlCDR1
RASQSVSNDVA

SEQ ID NO: 9966 - protein, 7 aa, Artificial Sequence
  Description of Artificial Sequence: Synthetic peptide
  XENP018934 vlCDR2
YASHRYT

SEQ ID NO: 9967 - protein, 9 aa, Artificial Sequence
  Description of Artificial Sequence: Synthetic peptide
  XENP018934 vlCDR3
QQDYSSPRT

SEQ ID NO: 9968 - protein, 249 aa, Artificial Sequence
  Description of Artificial Sequence: Synthetic polypeptide
  XENP018935 1G6_H4L2_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 9969 - protein, 122 aa, Artificial Sequence; identical to SEQ ID NO: 9960
  Description of Artificial Sequence: Synthetic polypeptide
  VH of XENP018935

SEQ ID NO: 9970 - protein, 107 aa, Artificial Sequence; identical to SEQ ID NO: 6256
  Description of Artificial Sequence: Synthetic polypeptide
  VL of XENP018935

SEQ ID NO: 9971 - protein, 5 aa, Artificial Sequence
  Description of Artificial Sequence: Synthetic peptide
  XENP018935 vhCDR1
NYWMN

SEQ ID NO: 9972 - protein, 19 aa, Artificial Sequence
  Description of Artificial Sequence: Synthetic peptide
  XENP018935 vhCDR2
EIRLKSNNYATHYAESVKG

SEQ ID NO: 9973 - protein, 11 aa, Artificial Sequence
  Description of Artificial Sequence: Synthetic peptide
  XENP018935 vhCDR3
YYGNYGGYFDV

SEQ ID NO: 9974 - protein, 11 aa, Artificial Sequence
  Description of Artificial Sequence: Synthetic peptide
  XENP018935 vlCDR1
RASQSVSNDVA

SEQ ID NO: 9975 - protein, 7 aa, Artificial Sequence
  Description of Artificial Sequence: Synthetic peptide
  XENP018935 vlCDR2
YASHRYT

SEQ ID NO: 9976 - protein, 9 aa, Artificial Sequence
  Description of Artificial Sequence: Synthetic peptide
  XENP018935 vlCDR3
QQDYSSPRT

SEQ ID NO: 9977 - protein, 249 aa, Artificial Sequence
  Description of Artificial Sequence: Synthetic polypeptide
  XENP018936 1G6_H4L3_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9978 - protein, 122 aa, Artificial Sequence; identical to SEQ ID NO: 9960
  Description of Artificial Sequence: Synthetic polypeptide
  VH of XENP018936

SEQ ID NO: 9979 - protein, 107 aa, Artificial Sequence; identical to SEQ ID NO: 9844
  Description of Artificial Sequence: Synthetic polypeptide
  VL of XENP018936

SEQ ID NO: 9980 - protein, 5 aa, Artificial Sequence
  Description of Artificial Sequence: Synthetic peptide
  XENP018936 vhCDR1
NYWMN

SEQ ID NO: 9981 - protein, 19 aa, Artificial Sequence
  Description of Artificial Sequence: Synthetic peptide
  XENP018936 vhCDR2
EIRLKSNNYATHYAESVKG

SEQ ID NO: 9982 - protein, 11 aa, Artificial Sequence
  Description of Artificial Sequence: Synthetic peptide
  XENP018936 vhCDR3
YYGNYGGYFDV

SEQ ID NO: 9983 - protein, 11 aa, Artificial Sequence
  Description of Artificial Sequence: Synthetic peptide
  XENP018936 vlCDR1
RASQSVSNDVA

SEQ ID NO: 9984 - protein, 7 aa, Artificial Sequence
  Description of Artificial Sequence: Synthetic peptide
  XENP018936 vlCDR2
YASHRYT

SEQ ID NO: 9985 - protein, 9 aa, Artificial Sequence
  Description of Artificial Sequence: Synthetic peptide
  XENP018936 vlCDR3
QQDYSSPRT

SEQ ID NO: 9986 - protein, 249 aa, Artificial Sequence
  Description of Artificial Sequence: Synthetic polypeptide
  XENP018937 1G6_H4L4_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9987 - protein, 122 aa, Artificial Sequence; identical to SEQ ID NO: 9960
  Description of Artificial Sequence: Synthetic polypeptide
  VH of XENP018937

SEQ ID NO: 9988 - protein, 107 aa, Artificial Sequence; identical to SEQ ID NO: 9853
  Description of Artificial Sequence: Synthetic polypeptide
  VL of XENP018937

SEQ ID NO: 9989 - protein, 5 aa, Artificial Sequence
  Description of Artificial Sequence: Synthetic peptide
  XENP018937 vhCDR1
NYWMN

SEQ ID NO: 9990 - protein, 19 aa, Artificial Sequence
  Description of Artificial Sequence: Synthetic peptide
  XENP018937 vhCDR2
EIRLKSNNYATHYAESVKG

SEQ ID NO: 9991 - protein, 11 aa, Artificial Sequence
  Description of Artificial Sequence: Synthetic peptide
  XENP018937 vhCDR3
YYGNYGGYFDV

SEQ ID NO: 9992 - protein, 11 aa, Artificial Sequence
  Description of Artificial Sequence: Synthetic peptide
  XENP018937 vlCDR1
RASQSVSNDVA

SEQ ID NO: 9993 - protein, 7 aa, Artificial Sequence
  Description of Artificial Sequence: Synthetic peptide
  XENP018937 vlCDR2
YASHRYT

SEQ ID NO: 9994 - protein, 9 aa, Artificial Sequence
  Description of Artificial Sequence: Synthetic peptide
  XENP018937 vlCDR3
QQDYSSPRT

SEQ ID NO: 9995 - protein, 249 aa, Artificial Sequence
  Description of Artificial Sequence: Synthetic polypeptide
  XENP018938 1G6_H4L5_scFv(GKPGS)4
EVQLVESGGGLVQPGGSLKLSCAASGFTFSNYWMNWVRQASGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9996 - protein, 122 aa, Artificial Sequence; identical to SEQ ID NO: 9960
  Description of Artificial Sequence: Synthetic polypeptide
  VH of XENP018938

SEQ ID NO: 9997 - protein, 107 aa, Artificial Sequence; identical to SEQ ID NO: 9862
  Description of Artificial Sequence: Synthetic polypeptide
  VL of XENP018938

SEQ ID NO: 9998 - protein, 5 aa, Artificial Sequence
  Description of Artificial Sequence: Synthetic peptide
  XENP018938 vhCDR1
NYWMN

SEQ ID NO: 9999 - protein, 19 aa, Artificial Sequence
  Description of Artificial Sequence: Synthetic peptide
  XENP018938 vhCDR2
EIRLKSNNYATHYAESVKG

SEQ ID NO: 10000 - protein, 11 aa, Artificial Sequence
  Description of Artificial Sequence: Synthetic peptide
  XENP018938 vhCDR3
YYGNYGGYFDV

SEQ ID NO: 10001 - protein, 11 aa, Artificial Sequence
  Description of Artificial Sequence: Synthetic peptide
  XENP018938 vlCDR1
KASQSVSNDVA

SEQ ID NO: 10002 - protein, 7 aa, Artificial Sequence
  Description of Artificial Sequence: Synthetic peptide
  XENP018938 vlCDR2
YASHRYT

SEQ ID NO: 10003 - protein, 9 aa, Artificial Sequence
  Description of Artificial Sequence: Synthetic peptide
  XENP018938 vlCDR3
QQDYSSPRT

SEQ ID NO: 10004 - protein, 249 aa, Artificial Sequence
  Description of Artificial Sequence: Synthetic polypeptide
  XENP019064 1G6_H1.239_L1_scFv(GKPGS)4
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10005 - protein, 122 aa, Artificial Sequence
  Description of Artificial Sequence: Synthetic polypeptide
  VH of XENP019064
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10006 - protein, 107 aa, Artificial Sequence; identical to SEQ ID NO: 6247
  Description of Artificial Sequence: Synthetic polypeptide
  VL of XENP019064

SEQ ID NO: 10007 - protein, 5 aa, Artificial Sequence
  Description of Artificial Sequence: Synthetic peptide
  XENP019064 vhCDR1
NYWMN

SEQ ID NO: 10008 - protein, 19 aa, Artificial Sequence
  Description of Artificial Sequence: Synthetic peptide
  XENP019064 vhCDR2
EIRLKSNNYATHYAEPVKG

SEQ ID NO: 10009 - protein, 11 aa, Artificial Sequence
  Description of Artificial Sequence: Synthetic peptide
  XENP019064 vhCDR3
YYGNYGGYFDV

SEQ ID NO: 10010 - protein, 11 aa, Artificial Sequence
  Description of Artificial Sequence: Synthetic peptide
  XENP019064 vlCDR1
RASQSVSNDVA

SEQ ID NO: 10011 - protein, 7 aa, Artificial Sequence
  Description of Artificial Sequence: Synthetic peptide
  XENP019064 vlCDR2
YASHRYT

SEQ ID NO: 10012 - protein, 9 aa, Artificial Sequence
  Description of Artificial Sequence: Synthetic peptide
  XENP019064 vlCDR3
QQDYSSPRT

SEQ ID NO: 10013 - protein, 249 aa, Artificial Sequence
  Description of Artificial Sequence: Synthetic polypeptide
  XENP019065 1G6_H1.240_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10014 - protein, 122 aa, Artificial Sequence
  Description of Artificial Sequence: Synthetic polypeptide
  VH of XENP019065
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10015 - protein, 107 aa, Artificial Sequence; identical to SEQ ID NO: 6247
  Description of Artificial Sequence: Synthetic polypeptide
  VL of XENP019065

SEQ ID NO: 10016 - protein, 5 aa, Artificial Sequence
  Description of Artificial Sequence: Synthetic peptide
  XENP019065 vhCDR1
NYWMN

SEQ ID NO: 10017 - protein, 19 aa, Artificial Sequence
  Description of Artificial Sequence: Synthetic peptide
  XENP019065 vhCDR2
EIRLKSNNYATHYAEPVKG

SEQ ID NO: 10018 - protein, 11 aa, Artificial Sequence
  Description of Artificial Sequence: Synthetic peptide
  XENP019065 vhCDR3
YYGNYGGYFDV

SEQ ID NO: 10019 - protein, 11 aa, Artificial Sequence
  Description of Artificial Sequence: Synthetic peptide
  XENP019065 vlCDR1
RASQSVSNDVA

SEQ ID NO: 10020 - protein, 7 aa, Artificial Sequence
  Description of Artificial Sequence: Synthetic peptide
  XENP019065 vlCDR2
YASHRYT

SEQ ID NO: 10021 - protein, 9 aa, Artificial Sequence
  Description of Artificial Sequence: Synthetic peptide
  XENP019065 vlCDR3
QQDYSSPRT

SEQ ID NO: 10022 - protein, 249 aa, Artificial Sequence
  Description of Artificial Sequence: Synthetic polypeptide
  XENP019066 1G6_H1.241_L1_scFv(GKPGS)4
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10023 - protein, 122 aa, Artificial Sequence
  Description of Artificial Sequence: Synthetic polypeptide
  VH of XENP019066
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10024 - protein, 107 aa, Artificial Sequence; identical to SEQ ID NO: 6247
  Description of Artificial Sequence: Synthetic polypeptide
  VL of XENP019066

SEQ ID NO: 10025 - protein, 5 aa, Artificial Sequence
  Description of Artificial Sequence: Synthetic peptide
  XENP019066 vhCDR1
NYWMN

SEQ ID NO: 10026 - protein, 19 aa, Artificial Sequence
  Description of Artificial Sequence: Synthetic peptide
  XENP019066 vhCDR2
EIRLKSNNYATHYAEPVKG

SEQ ID NO: 10027 - protein, 11 aa, Artificial Sequence
  Description of Artificial Sequence: Synthetic peptide
  XENP019066 vhCDR3
YYGNYGGYFDV

SEQ ID NO: 10028 - protein, 11 aa, Artificial Sequence
  Description of Artificial Sequence: Synthetic peptide
  XENP019066 vlCDR1
RASQSVSNDVA

SEQ ID NO: 10029 - protein, 7 aa, Artificial Sequence
  Description of Artificial Sequence: Synthetic peptide
  XENP019066 vlCDR2
YASHRYT

SEQ ID NO: 10030 - protein, 9 aa, Artificial Sequence
  Description of Artificial Sequence: Synthetic peptide
  XENP019066 vlCDR3
QQDYSSPRT

SEQ ID NO: 10031 - protein, 249 aa, Artificial Sequence
  Description of Artificial Sequence: Synthetic polypeptide
  XENP019067 1G6_H1.242_L1_scFv(GKPGS)4
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10032 - protein, 122 aa, Artificial Sequence
  Description of Artificial Sequence: Synthetic polypeptide
  VH of XENP019067
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10033 - protein, 107 aa, Artificial Sequence; identical to SEQ ID NO: 6247
  Description of Artificial Sequence: Synthetic polypeptide
  VL of XENP019067

SEQ ID NO: 10034 - protein, 5 aa, Artificial Sequence
  Description of Artificial Sequence: Synthetic peptide
  XENP019067 vhCDR1
NYWMN

SEQ ID NO: 10035 - protein, 19 aa, Artificial Sequence
  Description of Artificial Sequence: Synthetic peptide
  XENP019067 vhCDR2
EIRLKSNNYATHYAEPVKG

SEQ ID NO: 10036 - protein, 11 aa, Artificial Sequence
  Description of Artificial Sequence: Synthetic peptide
  XENP019067 vhCDR3
YYGNYGGYFDV

SEQ ID NO: 10037 - protein, 11 aa, Artificial Sequence
  Description of Artificial Sequence: Synthetic peptide
  XENP019067 vlCDR1
RASQSVSNDVA

SEQ ID NO: 10038 - protein, 7 aa, Artificial Sequence
  Description of Artificial Sequence: Synthetic peptide
  XENP019067 vlCDR2
YASHRYT

SEQ ID NO: 10039 - protein, 9 aa, Artificial Sequence
  Description of Artificial Sequence: Synthetic peptide
  XENP019067 vlCDR3
QQDYSSPRT

SEQ ID NO: 10040 - protein, 249 aa, Artificial Sequence
  Description of Artificial Sequence: Synthetic polypeptide
  XENP019068 1G6_H1.243_L1_scFv(GKPGS)4
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10041 - protein, 122 aa, Artificial Sequence
  Description of Artificial Sequence: Synthetic polypeptide
  VH of XENP019068
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10042 - protein, 107 aa, Artificial Sequence; identical to SEQ ID NO: 6247
  Description of Artificial Sequence: Synthetic polypeptide
  VL of XENP019068

SEQ ID NO: 10043 - protein, 5 aa, Artificial Sequence
  Description of Artificial Sequence: Synthetic peptide
  XENP019068 vhCDR1
NYWMN

SEQ ID NO: 10044 - protein, 19 aa, Artificial Sequence
  Description of Artificial Sequence: Synthetic peptide
  XENP019068 vhCDR2
EIRLKSNNYATHYAEPVKG

SEQ ID NO: 10045 - protein, 11 aa, Artificial Sequence
  Description of Artificial Sequence: Synthetic peptide
  XENP019068 vhCDR3
YYGNYGGYFDV

SEQ ID NO: 10046 - protein, 11 aa, Artificial Sequence
  Description of Artificial Sequence: Synthetic peptide
  XENP019068 vlCDR1
RASQSVSNDVA

SEQ ID NO: 10047 - protein, 7 aa, Artificial Sequence
  Description of Artificial Sequence: Synthetic peptide
  XENP019068 vlCDR2
YASHRYT

SEQ ID NO: 10048 - protein, 9 aa, Artificial Sequence
  Description of Artificial Sequence: Synthetic peptide
  XENP019068 vlCDR3
QQDYSSPRT

SEQ ID NO: 10049 - protein, 249 aa, Artificial Sequence
  Description of Artificial Sequence: Synthetic polypeptide
  XENP019069 1G6_H1.244_L1_scFv(GKPGS)4
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10050 - protein, 122 aa, Artificial Sequence
  Description of Artificial Sequence: Synthetic polypeptide
  VH of XENP019069
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSS

SEQ ID NO: 10051 - protein, 107 aa, Artificial Sequence; identical to SEQ ID NO: 6247
  Description of Artificial Sequence: Synthetic polypeptide
  VL of XENP019069

SEQ ID NO: 10052 - protein, 5 aa, Artificial Sequence
  Description of Artificial Sequence: Synthetic peptide
  XENP019069 vhCDR1
NYWMN

SEQ ID NO: 10053 - protein, 19 aa, Artificial Sequence
  Description of Artificial Sequence: Synthetic peptide
  XENP019069 vhCDR2
EIRLKSNNYATHYAEPVKG

SEQ ID NO: 10054 - protein, 11 aa, Artificial Sequence
  Description of Artificial Sequence: Synthetic peptide
  XENP019069 vhCDR3
YYGNYGGYFDV

SEQ ID NO: 10055 - protein, 11 aa, Artificial Sequence
  Description of Artificial Sequence: Synthetic peptide
  XENP019069 vlCDR1
RASQSVSNDVA

SEQ ID NO: 10056 - protein, 7 aa, Artificial Sequence
  Description of Artificial Sequence: Synthetic peptide
  XENP019069 vlCDR2
YASHRYT

SEQ ID NO: 10057 - protein, 9 aa, Artificial Sequence
  Description of Artificial Sequence: Synthetic peptide
  XENP019069 vlCDR3
QQDYSSPRT

SEQ ID NO: 10058 - protein, 249 aa, Artificial Sequence
  Description of Artificial Sequence: Synthetic polypeptide
  XENP019070 1G6_H1.245_L1_scFv(GKPGS)4
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10059 - protein, 122 aa, Artificial Sequence
  Description of Artificial Sequence: Synthetic polypeptide
  VH of XENP019070
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSS

SEQ ID NO: 10060 - protein, 107 aa, Artificial Sequence; identical to SEQ ID NO: 6247
  Description of Artificial Sequence: Synthetic polypeptide
  VL of XENP019070

SEQ ID NO: 10061 - protein, 5 aa, Artificial Sequence
  Description of Artificial Sequence: Synthetic peptide
  XENP019070 vhCDR1
NYWMN

SEQ ID NO: 10062 - protein, 19 aa, Artificial Sequence
  Description of Artificial Sequence: Synthetic peptide
  XENP019070 vhCDR2
EIRLKSNNYATHYAEPVKG

SEQ ID NO: 10063 - protein, 11 aa, Artificial Sequence
  Description of Artificial Sequence: Synthetic peptide
  XENP019070 vhCDR3
YYGNYGGYFDV

SEQ ID NO: 10064 - protein, 11 aa, Artificial Sequence
  Description of Artificial Sequence: Synthetic peptide
  XENP019070 vlCDR1
RASQSVSNDVA

SEQ ID NO: 10065 - protein, 7 aa, Artificial Sequence
  Description of Artificial Sequence: Synthetic peptide
  XENP019070 vlCDR2
YASHRYT

SEQ ID NO: 10066 - protein, 9 aa, Artificial Sequence
  Description of Artificial Sequence: Synthetic peptide
  XENP019070 vlCDR3
QQDYSSPRT

SEQ ID NO: 10067 - protein, 249 aa, Artificial Sequence
  Description of Artificial Sequence: Synthetic polypeptide
  XENP019071 1G6_H1.246_L1_scFv(GKPGS)4
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10068 - protein, 122 aa, Artificial Sequence
  Description of Artificial Sequence: Synthetic polypeptide
  VH of XENP019071
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSS

SEQ ID NO: 10069 - protein, 107 aa, Artificial Sequence; identical to SEQ ID NO: 6247
  Description of Artificial Sequence: Synthetic polypeptide
  VL of XENP019071

SEQ ID NO: 10070 - protein, 5 aa, Artificial Sequence
  Description of Artificial Sequence: Synthetic peptide
  XENP019071 vhCDR1
NYWMN

SEQ ID NO: 10071 - protein, 19 aa, Artificial Sequence
  Description of Artificial Sequence: Synthetic peptide
  XENP019071 vhCDR2
EIRLKSNNYATHYAEPVKG

SEQ ID NO: 10072 - protein, 11 aa, Artificial Sequence
  Description of Artificial Sequence: Synthetic peptide
  XENP019071 vhCDR3
YYGNYGGYFDV

SEQ ID NO: 10073 - protein, 11 aa, Artificial Sequence
  Description of Artificial Sequence: Synthetic peptide
  XENP019071 vlCDR1
RASQSVSNDVA

SEQ ID NO: 10074 - protein, 7 aa, Artificial Sequence
  Description of Artificial Sequence: Synthetic peptide
  XENP019071 vlCDR2
YASHRYT

SEQ ID NO: 10075 - protein, 9 aa, Artificial Sequence
  Description of Artificial Sequence: Synthetic peptide
  XENP019071 vlCDR3
QQDYSSPRT

SEQ ID NO: 10076 - protein, 249 aa, Artificial Sequence
  Description of Artificial Sequence: Synthetic polypeptide
  XENP019072 1G6_H1.247_L1_scFv(GKPGS)4
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10077 - protein, 122 aa, Artificial Sequence
  Description of Artificial Sequence: Synthetic polypeptide
  VH of XENP019072
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSS

SEQ ID NO: 10078 - protein, 107 aa, Artificial Sequence; identical to SEQ ID NO: 6247
  Description of Artificial Sequence: Synthetic polypeptide
  VL of XENP019072

SEQ ID NO: 10079 - protein, 5 aa, Artificial Sequence
  Description of Artificial Sequence: Synthetic peptide
  XENP019072 vhCDR1
NYWMN

SEQ ID NO: 10080 - protein, 19 aa, Artificial Sequence
  Description of Artificial Sequence: Synthetic peptide
  XENP019072 vhCDR2
EIRLKSNNYATHYAEPFKG

SEQ ID NO: 10081 - protein, 11 aa, Artificial Sequence
  Description of Artificial Sequence: Synthetic peptide
  XENP019072 vhCDR3
YYGNYGGYFDV

SEQ ID NO: 10082 - protein, 11 aa, Artificial Sequence
  Description of Artificial Sequence: Synthetic peptide
  XENP019072 vlCDR1
RASQSVSNDVA

SEQ ID NO: 10083 - protein, 7 aa, Artificial Sequence
  Description of Artificial Sequence: Synthetic peptide
  XENP019072 vlCDR2
YASHRYT

SEQ ID NO: 10084 - protein, 9 aa, Artificial Sequence
  Description of Artificial Sequence: Synthetic peptide
  XENP019072 vlCDR3
QQDYSSPRT

SEQ ID NO: 10085 - protein, 249 aa, Artificial Sequence
  Description of Artificial Sequence: Synthetic polypeptide
  XENP019073 1G6_H1.248_L1_scFv(GKPGS)4
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10086 - protein, 122 aa, Artificial Sequence
  Description of Artificial Sequence: Synthetic polypeptide
  VH of XENP019073
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSS

SEQ ID NO: 10087 - protein, 107 aa, Artificial Sequence; identical to SEQ ID NO: 6247
  Description of Artificial Sequence: Synthetic polypeptide
  VL of XENP019073

SEQ ID NO: 10088 - protein, 5 aa, Artificial Sequence
  Description of Artificial Sequence: Synthetic peptide
  XENP019073 vhCDR1
NYWMN

SEQ ID NO: 10089 - protein, 19 aa, Artificial Sequence
  Description of Artificial Sequence: Synthetic peptide
  XENP019073 vhCDR2
EIRLKSNNYATHYAEPVKG

SEQ ID NO: 10090 - protein, 11 aa, Artificial Sequence
  Description of Artificial Sequence: Synthetic peptide
  XENP019073 vhCDR3
YYGNYGGYFDV

SEQ ID NO: 10091 - protein, 11 aa, Artificial Sequence
  Description of Artificial Sequence: Synthetic peptide
  XENP019073 vlCDR1
RASQSVSNDVA

SEQ ID NO: 10092 - protein, 7 aa, Artificial Sequence
  Description of Artificial Sequence: Synthetic peptide
  XENP019073 vlCDR2
YASHRYT

SEQ ID NO: 10093 - protein, 9 aa, Artificial Sequence
  Description of Artificial Sequence: Synthetic peptide
  XENP019073 vlCDR3
QQDYSSPRT

SEQ ID NO: 10094 - protein, 249 aa, Artificial Sequence
  Description of Artificial Sequence: Synthetic polypeptide
  XENP019074 1G6_H1.249_L1_scFv(GKPGS)4
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10095 - protein, 122 aa, Artificial Sequence
  Description of Artificial Sequence: Synthetic polypeptide
  VH of XENP019074
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSS

SEQ ID NO: 10096 - protein, 107 aa, Artificial Sequence; identical to SEQ ID NO: 6247
  Description of Artificial Sequence: Synthetic polypeptide
  VL of XENP019074

SEQ ID NO: 10097 - protein, 5 aa, Artificial Sequence
  Description of Artificial Sequence: Synthetic peptide
  XENP019074 vhCDR1
NYWMN

SEQ ID NO: 10098 - protein, 19 aa, Artificial Sequence
  Description of Artificial Sequence: Synthetic peptide
  XENP019074 vhCDR2
EIRLKSNNYATHYAEPVKG

SEQ ID NO: 10099 - protein, 11 aa, Artificial Sequence
  Description of Artificial Sequence: Synthetic peptide
  XENP019074 vhCDR3
YYGNYGGYFDV

SEQ ID NO: 10100 - protein, 11 aa, Artificial Sequence
  Description of Artificial Sequence: Synthetic peptide
  XENP019074 vlCDR1
RASQSVSNDVA

SEQ ID NO: 10101 - protein, 7 aa, Artificial Sequence
  Description of Artificial Sequence: Synthetic peptide
  XENP019074 vlCDR2
YASHRYT

SEQ ID NO: 10102 - protein, 9 aa, Artificial Sequence
  Description of Artificial Sequence: Synthetic peptide
  XENP019074 vlCDR3
QQDYSSPRT

SEQ ID NO: 10103 - protein, 249 aa, Artificial Sequence
  Description of Artificial Sequence: Synthetic polypeptide
  XENP019075 1G6_H1.250_L1_scFv(GKPGS)4
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10104 - protein, 122 aa, Artificial Sequence
  Description of Artificial Sequence: Synthetic polypeptide
  VH of XENP019075
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSS

SEQ ID NO: 10105 - protein, 107 aa, Artificial Sequence; identical to SEQ ID NO: 6247
  Description of Artificial Sequence: Synthetic polypeptide
  VL of XENP019075

SEQ ID NO: 10106 - protein, 5 aa, Artificial Sequence
  Description of Artificial Sequence: Synthetic peptide
  XENP019075 vhCDR1
NYWMN

SEQ ID NO: 10107 - protein, 19 aa, Artificial Sequence
  Description of Artificial Sequence: Synthetic peptide
  XENP019075 vhCDR2
EIRLKSNNYATHYAEPVKG

SEQ ID NO: 10108 - protein, 11 aa, Artificial Sequence
  Description of Artificial Sequence: Synthetic peptide
  XENP019075 vhCDR3
YYGNYGGYFDV

SEQ ID NO: 10109 - protein, 11 aa, Artificial Sequence
  Description of Artificial Sequence: Synthetic peptide
  XENP019075 vlCDR1
RASQSVSNDVA

SEQ ID NO: 10110 - protein, 7 aa, Artificial Sequence
  Description of Artificial Sequence: Synthetic peptide
  XENP019075 vlCDR2
YASHRYT

SEQ ID NO: 10111 - protein, 9 aa, Artificial Sequence
  Description of Artificial Sequence: Synthetic peptide
  XENP019075 vlCDR3
QQDYSSPRT

SEQ ID NO: 10112 - protein, 249 aa, Artificial Sequence
  Description of Artificial Sequence: Synthetic polypeptide
  XENP019076 1G6_H1.251_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10113 - protein, 122 aa, Artificial Sequence
  Description of Artificial Sequence: Synthetic polypeptide
  VH of XENP019076
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSS

SEQ ID NO: 10114 - protein, 107 aa, Artificial Sequence; identical to SEQ ID NO: 6247
  Description of Artificial Sequence: Synthetic polypeptide
  VL of XENP019076

SEQ ID NO: 10115 - protein, 5 aa, Artificial Sequence
  Description of Artificial Sequence: Synthetic peptide
  XENP019076 vhCDR1
NYWMN

SEQ ID NO: 10116 - protein, 19 aa, Artificial Sequence
  Description of Artificial Sequence: Synthetic peptide
  XENP019076 vhCDR2
EIRLKSNNYATHYAEPVKG

SEQ ID NO: 10117 - protein, 11 aa, Artificial Sequence
  Description of Artificial Sequence: Synthetic peptide
  XENP019076 vhCDR3
YYGNYGGYFDV

SEQ ID NO: 10118 - protein, 11 aa, Artificial Sequence
  Description of Artificial Sequence: Synthetic peptide
  XENP019076 vlCDR1
RASQSVSNDVA

SEQ ID NO: 10119 - protein, 7 aa, Artificial Sequence
  Description of Artificial Sequence: Synthetic peptide
  XENP019076 vlCDR2
YASHRYT

SEQ ID NO: 10120 - protein, 9 aa, Artificial Sequence
  Description of Artificial Sequence: Synthetic peptide
  XENP019076 vlCDR3
QQDYSSPRT

SEQ ID NO: 10121 - protein, 249 aa, Artificial Sequence
  Description of Artificial Sequence: Synthetic polypeptide
  XENP019077 1G6_H1.252_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10122 - protein, 122 aa, Artificial Sequence
  Description of Artificial Sequence: Synthetic polypeptide
  VH of XENP019077
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSS

SEQ ID NO: 10123 - protein, 107 aa, Artificial Sequence; identical to SEQ ID NO: 6247
  Description of Artificial Sequence: Synthetic polypeptide
  VL of XENP019077

SEQ ID NO: 10124 - protein, 5 aa, Artificial Sequence
  Description of Artificial Sequence: Synthetic peptide
  XENP019077 vhCDR1
NYWMN

SEQ ID NO: 10125 - protein, 19 aa, Artificial Sequence
  Description of Artificial Sequence: Synthetic peptide
  XENP019077 vhCDR2
EIRLKSNNYATHYAEPVKG

SEQ ID NO: 10126 - protein, 11 aa, Artificial Sequence
  Description of Artificial Sequence: Synthetic peptide
  XENP019077 vhCDR3
YYGNYGGYFDV

SEQ ID NO: 10127 - protein, 11 aa, Artificial Sequence
  Description of Artificial Sequence: Synthetic peptide
  XENP019077 vlCDR1
RASQSVSNDVA

SEQ ID NO: 10128 - protein, 7 aa, Artificial Sequence
  Description of Artificial Sequence: Synthetic peptide
  XENP019077 vlCDR2
YASHRYT

SEQ ID NO: 10129 - protein, 9 aa, Artificial Sequence
  Description of Artificial Sequence: Synthetic peptide
  XENP019077 vlCDR3
QQDYSSPRT

SEQ ID NO: 10130 - protein, 249 aa, Artificial Sequence
  Description of Artificial Sequence: Synthetic polypeptide
  XENP019078 1G6_H1.253_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10131 - protein, 122 aa, Artificial Sequence
  Description of Artificial Sequence: Synthetic polypeptide
  VH of XENP019078
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSS

SEQ ID NO: 10132 - protein, 107 aa, Artificial Sequence; identical to SEQ ID NO: 6247
  Description of Artificial Sequence: Synthetic polypeptide
  VL of XENP019078

SEQ ID NO: 10133 - protein, 5 aa, Artificial Sequence
  Description of Artificial Sequence: Synthetic peptide
  XENP019078 vhCDR1
NYWMN

SEQ ID NO: 10134 - protein, 19 aa, Artificial Sequence
  Description of Artificial Sequence: Synthetic peptide
  XENP019078 vhCDR2
EIRLKSNNYATHYAEPVKG

SEQ ID NO: 10135 - protein, 11 aa, Artificial Sequence
  Description of Artificial Sequence: Synthetic peptide
  XENP019078 vhCDR3
YYGNYGGYFDV

SEQ ID NO: 10136 - protein, 11 aa, Artificial Sequence
  Description of Artificial Sequence: Synthetic peptide
  XENP019078 vlCDR1
RASQSVSNDVA

SEQ ID NO: 10137 - protein, 7 aa, Artificial Sequence
  Description of Artificial Sequence: Synthetic peptide
  XENP019078 vlCDR2
YASHRYT

SEQ ID NO: 10138 - protein, 9 aa, Artificial Sequence
  Description of Artificial Sequence: Synthetic peptide
  XENP019078 vlCDR3
QQDYSSPRT

SEQ ID NO: 10139 - protein, 249 aa, Artificial Sequence
  Description of Artificial Sequence: Synthetic polypeptide
  XENP019079 1G6_H1.254_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10140 - protein, 122 aa, Artificial Sequence
  Description of Artificial Sequence: Synthetic polypeptide
  VH of XENP019079
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSS

SEQ ID NO: 10141 - protein, 107 aa, Artificial Sequence; identical to SEQ ID NO: 6247
  Description of Artificial Sequence: Synthetic polypeptide
  VL of XENP019079

SEQ ID NO: 10142 - protein, 5 aa, Artificial Sequence
  Description of Artificial Sequence: Synthetic peptide
  XENP019079 vhCDR1
NYWMN

SEQ ID NO: 10143 - protein, 19 aa, Artificial Sequence
  Description of Artificial Sequence: Synthetic peptide
  XENP019079 vhCDR2
EIRLKSNNYATHYAEPVKG

SEQ ID NO: 10144 - protein, 11 aa, Artificial Sequence
  Description of Artificial Sequence: Synthetic peptide
  XENP019079 vhCDR3
YYGNYGGYFDV

SEQ ID NO: 10145 - protein, 11 aa, Artificial Sequence
  Description of Artificial Sequence: Synthetic peptide
  XENP019079 vlCDR1
RASQSVSNDVA

SEQ ID NO: 10146 - protein, 7 aa, Artificial Sequence
  Description of Artificial Sequence: Synthetic peptide
  XENP019079 vlCDR2
YASHRYT

SEQ ID NO: 10147 - protein, 9 aa, Artificial Sequence
  Description of Artificial Sequence: Synthetic peptide
  XENP019079 vlCDR3
QQDYSSPRT

SEQ ID NO: 10148 - protein, 249 aa, Artificial Sequence
  Description of Artificial Sequence: Synthetic polypeptide
  XENP019080 1G6_H1.255_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10149 - protein, 122 aa, Artificial Sequence
  Description of Artificial Sequence: Synthetic polypeptide
  VH of XENP019080
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSS

SEQ ID NO: 10150 - protein, 107 aa, Artificial Sequence; identical to SEQ ID NO: 6247
  Description of Artificial Sequence: Synthetic polypeptide
  VL of XENP019080

SEQ ID NO: 10151 - protein, 5 aa, Artificial Sequence
  Description of Artificial Sequence: Synthetic peptide
  XENP019080 vhCDR1
NYWMN

SEQ ID NO: 10152 - protein, 19 aa, Artificial Sequence
  Description of Artificial Sequence: Synthetic peptide
  XENP019080 vhCDR2
EIRLKSNNYATHYAEPVKG

SEQ ID NO: 10153 - protein, 11 aa, Artificial Sequence
  Description of Artificial Sequence: Synthetic peptide
  XENP019080 vhCDR3
YYGNYGGYFDV

SEQ ID NO: 10154 - protein, 11 aa, Artificial Sequence
  Description of Artificial Sequence: Synthetic peptide
  XENP019080 vlCDR1
RASQSVSNDVA

SEQ ID NO: 10155 - protein, 7 aa, Artificial Sequence
  Description of Artificial Sequence: Synthetic peptide
  XENP019080 vlCDR2
YASHRYT

SEQ ID NO: 10156 - protein, 9 aa, Artificial Sequence
  Description of Artificial Sequence: Synthetic peptide
  XENP019080 vlCDR3
QQDYSSPRT

SEQ ID NO: 10157 - protein, 249 aa, Artificial Sequence
  Description of Artificial Sequence: Synthetic polypeptide
  XENP019081 1G6_H1.256_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10158 - protein, 122 aa, Artificial Sequence
  Description of Artificial Sequence: Synthetic polypeptide
  VH of XENP019081
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSS

SEQ ID NO: 10159 - protein, 107 aa, Artificial Sequence; identical to SEQ ID NO: 6247
  Description of Artificial Sequence: Synthetic polypeptide
  VL of XENP019081

SEQ ID NO: 10160 - protein, 5 aa, Artificial Sequence
  Description of Artificial Sequence: Synthetic peptide
  XENP019081 vhCDR1
NYWMN

SEQ ID NO: 10161 - protein, 19 aa, Artificial Sequence
  Description of Artificial Sequence: Synthetic peptide
  XENP019081 vhCDR2
EIRLKSNNYATHYAEPVKG

SEQ ID NO: 10162 - protein, 11 aa, Artificial Sequence
  Description of Artificial Sequence: Synthetic peptide
  XENP019081 vhCDR3
YYGNYGGYFDV

SEQ ID NO: 10163 - protein, 11 aa, Artificial Sequence
  Description of Artificial Sequence: Synthetic peptide
  XENP019081 vlCDR1
RASQSVSNDVA

SEQ ID NO: 10164 - protein, 7 aa, Artificial Sequence
  Description of Artificial Sequence: Synthetic peptide
  XENP019081 vlCDR2
YASHRYT

SEQ ID NO: 10165 - protein, 9 aa, Artificial Sequence
  Description of Artificial Sequence: Synthetic peptide
  XENP019081 vlCDR3
QQDYSSPRT

SEQ ID NO: 10166 - protein, 249 aa, Artificial Sequence
  Description of Artificial Sequence: Synthetic polypeptide
  XENP019082 1G6_H1.257_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10167 - protein, 122 aa, Artificial Sequence
  Description of Artificial Sequence: Synthetic polypeptide
  VH of XENP019082
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSS

SEQ ID NO: 10168 - protein, 107 aa, Artificial Sequence; identical to SEQ ID NO: 6247
  Description of Artificial Sequence: Synthetic polypeptide
  VL of XENP019082

SEQ ID NO: 10169 - protein, 5 aa, Artificial Sequence
  Description of Artificial Sequence: Synthetic peptide
  XENP019082 vhCDR1
NYWMN

SEQ ID NO: 10170 - protein, 19 aa, Artificial Sequence
  Description of Artificial Sequence: Synthetic peptide
  XENP019082 vhCDR2
EIRLKSNNYATHYAEPVKG

SEQ ID NO: 10171 - protein, 11 aa, Artificial Sequence
  Description of Artificial Sequence: Synthetic peptide
  XENP019082 vhCDR3
YYGNYGGYFDV

SEQ ID NO: 10172 - protein, 11 aa, Artificial Sequence
  Description of Artificial Sequence: Synthetic peptide
  XENP019082 vlCDR1
RASQSVSNDVA

SEQ ID NO: 10173 - protein, 7 aa, Artificial Sequence
  Description of Artificial Sequence: Synthetic peptide
  XENP019082 vlCDR2
YASHRYT

SEQ ID NO: 10174 - protein, 9 aa, Artificial Sequence
  Description of Artificial Sequence: Synthetic peptide
  XENP019082 vlCDR3
QQDYSSPRT

SEQ ID NO: 10175 - protein, 249 aa, Artificial Sequence
  Description of Artificial Sequence: Synthetic polypeptide
  XENP019083 1G6_H1.258_L1_scFv(GKPGS)4
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10176 - protein, 122 aa, Artificial Sequence
  Description of Artificial Sequence: Synthetic polypeptide
  VH of XENP019083
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10177 - protein, 107 aa, Artificial Sequence; identical to SEQ ID NO: 6247
  Description of Artificial Sequence: Synthetic polypeptide
  VL of XENP019083

SEQ ID NO: 10178 - protein, 5 aa, Artificial Sequence
  Description of Artificial Sequence: Synthetic peptide
  XENP019083 vhCDR1
NYWMN

SEQ ID NO: 10179 - protein, 19 aa, Artificial Sequence
  Description of Artificial Sequence: Synthetic peptide
  XENP019083 vhCDR2
EIRLKSNNYATHYAEPVKG

SEQ ID NO: 10180 - protein, 11 aa, Artificial Sequence
  Description of Artificial Sequence: Synthetic peptide
  XENP019083 vhCDR3
YYGNYGGYFDV

SEQ ID NO: 10181 - protein, 11 aa, Artificial Sequence
  Description of Artificial Sequence: Synthetic peptide
  XENP019083 vlCDR1
RASQSVSNDVA

SEQ ID NO: 10182 - protein, 7 aa, Artificial Sequence
  Description of Artificial Sequence: Synthetic peptide
  XENP019083 vlCDR2
YASHRYT

SEQ ID NO: 10183 - protein, 9 aa, Artificial Sequence
  Description of Artificial Sequence: Synthetic peptide
  XENP019083 vlCDR3
QQDYSSPRT

SEQ ID NO: 10184 - protein, 249 aa, Artificial Sequence
  Description of Artificial Sequence: Synthetic polypeptide
  XENP019084 1G6_H1.259_L1_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10185 - protein, 122 aa, Artificial Sequence
  Description of Artificial Sequence: Synthetic polypeptide
  VH of XENP019084
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSS

SEQ ID NO: 10186 - protein, 107 aa, Artificial Sequence; identical to SEQ ID NO: 6247
  Description of Artificial Sequence: Synthetic polypeptide
  VL of XENP019084

SEQ ID NO: 10187 - protein, 5 aa, Artificial Sequence
  Description of Artificial Sequence: Synthetic peptide
  XENP019084 vhCDR1
NYWMD

SEQ ID NO: 10188 - protein, 19 aa, Artificial Sequence
  Description of Artificial Sequence: Synthetic peptide
  XENP019084 vhCDR2
EIRLKSNNYATHYAEPVKG

SEQ ID NO: 10189 - protein, 11 aa, Artificial Sequence
  Description of Artificial Sequence: Synthetic peptide
  XENP019084 vhCDR3
YYGNYGGYFDV

SEQ ID NO: 10190 - protein, 11 aa, Artificial Sequence
  Description of Artificial Sequence: Synthetic peptide
  XENP019084 vlCDR1
RASQSVSNDVA

SEQ ID NO: 10191 - protein, 7 aa, Artificial Sequence
  Description of Artificial Sequence: Synthetic peptide
  XENP019084 vlCDR2
YASHRYT

SEQ ID NO: 10192 - protein, 9 aa, Artificial Sequence
  Description of Artificial Sequence: Synthetic peptide
  XENP019084 vlCDR3
QQDYSSPRT

SEQ ID NO: 10193 - protein, 249 aa, Artificial Sequence
  Description of Artificial Sequence: Synthetic polypeptide
  XENP019085 1G6_H1.260_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10194 - protein, 122 aa, Artificial Sequence
  Description of Artificial Sequence: Synthetic polypeptide
  VH of XENP019085
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSS

SEQ ID NO: 10195 - protein, 107 aa, Artificial Sequence; identical to SEQ ID NO: 6247
  Description of Artificial Sequence: Synthetic polypeptide
  VL of XENP019085

SEQ ID NO: 10196 - protein, 5 aa, Artificial Sequence
  Description of Artificial Sequence: Synthetic peptide
  XENP019085 vhCDR1
NYWMN

SEQ ID NO: 10197 - protein, 19 aa, Artificial Sequence
  Description of Artificial Sequence: Synthetic peptide
  XENP019085 vhCDR2
EIRLKSNNYATHYAEPVKG

SEQ ID NO: 10198 - protein, 11 aa, Artificial Sequence
  Description of Artificial Sequence: Synthetic peptide
  XENP019085 vhCDR3
YYGNYGGYFDV

SEQ ID NO: 10199 - protein, 11 aa, Artificial Sequence
  Description of Artificial Sequence: Synthetic peptide
  XENP019085 vlCDR1
RASQSVSNDVA

SEQ ID NO: 10200 - protein, 7 aa, Artificial Sequence
  Description of Artificial Sequence: Synthetic peptide
  XENP019085 vlCDR2
YASHRYT

SEQ ID NO: 10201 - protein, 9 aa, Artificial Sequence
  Description of Artificial Sequence: Synthetic peptide
  XENP019085 vlCDR3
QQDYSSPRT

SEQ ID NO: 10202 - protein, 249 aa, Artificial Sequence
  Description of Artificial Sequence: Synthetic polypeptide
  XENP019086 1G6_H1.261_L1_scFv(GKPGS)4
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10203 - protein, 122 aa, Artificial Sequence
  Description of Artificial Sequence: Synthetic polypeptide
  VH of XENP019086
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSS

SEQ ID NO: 10204 - protein, 107 aa, Artificial Sequence; identical to SEQ ID NO: 6247
  Description of Artificial Sequence: Synthetic polypeptide
  VL of XENP019086

SEQ ID NO: 10205 - protein, 5 aa, Artificial Sequence
  Description of Artificial Sequence: Synthetic peptide
  XENP019086 vhCDR1
NYWMN

SEQ ID NO: 10206 - protein, 19 aa, Artificial Sequence
  Description of Artificial Sequence: Synthetic peptide
  XENP019086 vhCDR2
EIRLKSNNYATHYAEPVKG

SEQ ID NO: 10207 - protein, 11 aa, Artificial Sequence
  Description of Artificial Sequence: Synthetic peptide
  XENP019086 vhCDR3
YYGNYGGYFDV

SEQ ID NO: 10208 - protein, 11 aa, Artificial Sequence
  Description of Artificial Sequence: Synthetic peptide
  XENP019086 vlCDR1
RASQSVSNDVA

SEQ ID NO: 10209 - protein, 7 aa, Artificial Sequence
  Description of Artificial Sequence: Synthetic peptide
  XENP019086 vlCDR2
YASHRYT

SEQ ID NO: 10210 - protein, 9 aa, Artificial Sequence
  Description of Artificial Sequence: Synthetic peptide
  XENP019086 vlCDR3
QQDYSSPRT

SEQ ID NO: 10211 - protein, 249 aa, Artificial Sequence
  Description of Artificial Sequence: Synthetic polypeptide
  XENP019087 1G6_H1.262_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10212 - protein, 122 aa, Artificial Sequence
  Description of Artificial Sequence: Synthetic polypeptide
  VH of XENP019087
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSS

SEQ ID NO: 10213 - protein, 107 aa, Artificial Sequence; identical to SEQ ID NO: 6247
  Description of Artificial Sequence: Synthetic polypeptide
  VL of XENP019087

SEQ ID NO: 10214 - protein, 5 aa, Artificial Sequence
  Description of Artificial Sequence: Synthetic peptide
  XENP019087 vhCDR1
NYWMN

SEQ ID NO: 10215 - protein, 19 aa, Artificial Sequence
  Description of Artificial Sequence: Synthetic peptide
  XENP019087 vhCDR2
EIRLKSNNYATHYAEPVKG

SEQ ID NO: 10216 - protein, 11 aa, Artificial Sequence
  Description of Artificial Sequence: Synthetic peptide
  XENP019087 vhCDR3
YYGNYGGYFDV

SEQ ID NO: 10217 - protein, 11 aa, Artificial Sequence
  Description of Artificial Sequence: Synthetic peptide
  XENP019087 vlCDR1
RASQSVSNDVA

SEQ ID NO: 10218 - protein, 7 aa, Artificial Sequence
  Description of Artificial Sequence: Synthetic peptide
  XENP019087 vlCDR2
YASHRYT

SEQ ID NO: 10219 - protein, 9 aa, Artificial Sequence
  Description of Artificial Sequence: Synthetic peptide
  XENP019087 vlCDR3
QQDYSSPRT

SEQ ID NO: 10220 - protein, 249 aa, Artificial Sequence
  Description of Artificial Sequence: Synthetic polypeptide
  XENP019088 1G6_H1.263_L1_scFv(GKPGS)4
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10221 - protein, 122 aa, Artificial Sequence
  Description of Artificial Sequence: Synthetic polypeptide
  VH of XENP019088
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSS

SEQ ID NO: 10222 - protein, 107 aa, Artificial Sequence; identical to SEQ ID NO: 6247
  Description of Artificial Sequence: Synthetic polypeptide
  VL of XENP019088

SEQ ID NO: 10223 - protein, 5 aa, Artificial Sequence
  Description of Artificial Sequence: Synthetic peptide
  XENP019088 vhCDR1
NYWMN

SEQ ID NO: 10224 - protein, 19 aa, Artificial Sequence
  Description of Artificial Sequence: Synthetic peptide
  XENP019088 vhCDR2
EIRLKSNNYATHYAEKVKG

SEQ ID NO: 10225 - protein, 11 aa, Artificial Sequence
  Description of Artificial Sequence: Synthetic peptide
  XENP019088 vhCDR3
YYGNYGGYFDV

SEQ ID NO: 10226 - protein, 11 aa, Artificial Sequence
  Description of Artificial Sequence: Synthetic peptide
  XENP019088 vlCDR1
RASQSVSNDVA

SEQ ID NO: 10227 - protein, 7 aa, Artificial Sequence
  Description of Artificial Sequence: Synthetic peptide
  XENP019088 vlCDR2
YASHRYT

SEQ ID NO: 10228 - protein, 9 aa, Artificial Sequence
  Description of Artificial Sequence: Synthetic peptide
  XENP019088 vlCDR3
QQDYSSPRT

SEQ ID NO: 10229 - protein, 249 aa, Artificial Sequence
  Description of Artificial Sequence: Synthetic polypeptide
  XENP019089 1G6_H1.264_L1_scFv(GKPGS)4
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10230 - protein, 122 aa, Artificial Sequence
  Description of Artificial Sequence: Synthetic polypeptide
  VH of XENP019089
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 10231 - protein, 107 aa, Artificial Sequence; identical to SEQ ID NO: 6247
  Description of Artificial Sequence: Synthetic polypeptide
  VL of XENP019089

SEQ ID NO: 10232 - protein, 5 aa, Artificial Sequence
  Description of Artificial Sequence: Synthetic peptide
  XENP019089 vhCDR1
NYWMN

SEQ ID NO: 10233 - protein, 19 aa, Artificial Sequence
  Description of Artificial Sequence: Synthetic peptide
  XENP019089 vhCDR2
EIRLKSNNYATHYAEPVKG

SEQ ID NO: 10234 - protein, 11 aa, Artificial Sequence
  Description of Artificial Sequence: Synthetic peptide
  XENP019089 vhCDR3
YYGNYGGYFDV

SEQ ID NO: 10235 - protein, 11 aa, Artificial Sequence
  Description of Artificial Sequence: Synthetic peptide
  XENP019089 vlCDR1
RASQSVSNDVA

SEQ ID NO: 10236 - protein, 7 aa, Artificial Sequence
  Description of Artificial Sequence: Synthetic peptide
  XENP019089 vlCDR2
YASHRYT

SEQ ID NO: 10237 - protein, 9 aa, Artificial Sequence
  Description of Artificial Sequence: Synthetic peptide
  XENP019089 vlCDR3
QQDYSSPRT

SEQ ID NO: 10238 - protein, 249 aa, Artificial Sequence
  Description of Artificial Sequence: Synthetic polypeptide
  XENP019090 1G6_H1.265_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10239 - protein, 122 aa, Artificial Sequence
  Description of Artificial Sequence: Synthetic polypeptide
  VH of XENP019090
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSS

SEQ ID NO: 10240 - protein, 107 aa, Artificial Sequence; identical to SEQ ID NO: 6247
  Description of Artificial Sequence: Synthetic polypeptide
  VL of XENP019090

SEQ ID NO: 10241 - protein, 5 aa, Artificial Sequence
  Description of Artificial Sequence: Synthetic peptide
  XENP019090 vhCDR1
NYWMN

SEQ ID NO: 10242 - protein, 19 aa, Artificial Sequence
  Description of Artificial Sequence: Synthetic peptide
  XENP019090 vhCDR2
EIRLKSNNYATHYAEPVKG

SEQ ID NO: 10243 - protein, 11 aa, Artificial Sequence
  Description of Artificial Sequence: Synthetic peptide
  XENP019090 vhCDR3
YYGNYGGYFDV

SEQ ID NO: 10244 - protein, 11 aa, Artificial Sequence
  Description of Artificial Sequence: Synthetic peptide
  XENP019090 vlCDR1
RASQSVSNDVA

SEQ ID NO: 10245 - protein, 7 aa, Artificial Sequence
  Description of Artificial Sequence: Synthetic peptide
  XENP019090 vlCDR2
YASHRYT

SEQ ID NO: 10246 - protein, 9 aa, Artificial Sequence
  Description of Artificial Sequence: Synthetic peptide
  XENP019090 vlCDR3
QQDYSSPRT

SEQ ID NO: 10247 - protein, 249 aa, Artificial Sequence
  Description of Artificial Sequence: Synthetic polypeptide
  XENP019091 1G6_H1.266_L1_scFv(GKPGS)4
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10248 - protein, 122 aa, Artificial Sequence
  Description of Artificial Sequence: Synthetic polypeptide
  VH of XENP019091
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSS

SEQ ID NO: 10249 - protein, 107 aa, Artificial Sequence; identical to SEQ ID NO: 6247
  Description of Artificial Sequence: Synthetic polypeptide
  VL of XENP019091

SEQ ID NO: 10250 - protein, 5 aa, Artificial Sequence
  Description of Artificial Sequence: Synthetic peptide
  XENP019091 vhCDR1
NYWMN

SEQ ID NO: 10251 - protein, 19 aa, Artificial Sequence
  Description of Artificial Sequence: Synthetic peptide
  XENP019091 vhCDR2
EIRLKSNNYATHYAQPVKD

SEQ ID NO: 10252 - protein, 11 aa, Artificial Sequence
  Description of Artificial Sequence: Synthetic peptide
  XENP019091 vhCDR3
YYGNYGGYFDV

SEQ ID NO: 10253 - protein, 11 aa, Artificial Sequence
  Description of Artificial Sequence: Synthetic peptide
  XENP019091 vlCDR1
RASQSVSNDVA

SEQ ID NO: 10254 - protein, 7 aa, Artificial Sequence
  Description of Artificial Sequence: Synthetic peptide
  XENP019091 vlCDR2
YASHRYT

SEQ ID NO: 10255 - protein, 9 aa, Artificial Sequence
  Description of Artificial Sequence: Synthetic peptide
  XENP019091 vlCDR3
QQDYSSPRT

SEQ ID NO: 10256 - protein, 249 aa, Artificial Sequence
  Description of Artificial Sequence: Synthetic polypeptide
  XENP019092 1G6_H1.267_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10257 - protein, 122 aa, Artificial Sequence
  Description of Artificial Sequence: Synthetic polypeptide
  VH of XENP019092
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSS

SEQ ID NO: 10258 - protein, 107 aa, Artificial Sequence; identical to SEQ ID NO: 6247
  Description of Artificial Sequence: Synthetic polypeptide
  VL of XENP019092

SEQ ID NO: 10259 - protein, 5 aa, Artificial Sequence
  Description of Artificial Sequence: Synthetic peptide
  XENP019092 vhCDR1
NYWMN

SEQ ID NO: 10260 - protein, 19 aa, Artificial Sequence
  Description of Artificial Sequence: Synthetic peptide
  XENP019092 vhCDR2
EIRLKSNNYATHYAEPVKG

SEQ ID NO: 10261 - protein, 11 aa, Artificial Sequence
  Description of Artificial Sequence: Synthetic peptide
  XENP019092 vhCDR3
YYGNYGGYFDV

SEQ ID NO: 10262 - protein, 11 aa, Artificial Sequence
  Description of Artificial Sequence: Synthetic peptide
  XENP019092 vlCDR1
RASQSVSNDVA

SEQ ID NO: 10263 - protein, 7 aa, Artificial Sequence
  Description of Artificial Sequence: Synthetic peptide
  XENP019092 vlCDR2
YASHRYT

SEQ ID NO: 10264 - protein, 9 aa, Artificial Sequence
  Description of Artificial Sequence: Synthetic peptide
  XENP019092 vlCDR3
QQDYSSPRT

SEQ ID NO: 10265 - protein, 249 aa, Artificial Sequence
  Description of Artificial Sequence: Synthetic polypeptide
  XENP019093 1G6_H1.268_L1_scFv(GKPGS)4
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10266 - protein, 122 aa, Artificial Sequence
  Description of Artificial Sequence: Synthetic polypeptide
  VH of XENP019093
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSS

SEQ ID NO: 10267 - protein, 107 aa, Artificial Sequence; identical to SEQ ID NO: 6247
  Description of Artificial Sequence: Synthetic polypeptide
  VL of XENP019093

SEQ ID NO: 10268 - protein, 5 aa, Artificial Sequence
  Description of Artificial Sequence: Synthetic peptide
  XENP019093 vhCDR1
NYWMN

SEQ ID NO: 10269 - protein, 19 aa, Artificial Sequence
  Description of Artificial Sequence: Synthetic peptide
  XENP019093 vhCDR2
EIRLKSNNYATHYAEPVKG

SEQ ID NO: 10270 - protein, 11 aa, Artificial Sequence
  Description of Artificial Sequence: Synthetic peptide
  XENP019093 vhCDR3
YYGNYGGYFDV

SEQ ID NO: 10271 - protein, 11 aa, Artificial Sequence
  Description of Artificial Sequence: Synthetic peptide
  XENP019093 vlCDR1
RASQSVSNDVA

SEQ ID NO: 10272 - protein, 7 aa, Artificial Sequence
  Description of Artificial Sequence: Synthetic peptide
  XENP019093 vlCDR2
YASHRYT

SEQ ID NO: 10273 - protein, 9 aa, Artificial Sequence
  Description of Artificial Sequence: Synthetic peptide
  XENP019093 vlCDR3
QQDYSSPRT

SEQ ID NO: 10274 - protein, 249 aa, Artificial Sequence
  Description of Artificial Sequence: Synthetic polypeptide
  XENP019094 1G6_H1.269_L1_scFv(GKPGS)4
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10275 - protein, 122 aa, Artificial Sequence
  Description of Artificial Sequence: Synthetic polypeptide
  VH of XENP019094
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSS

SEQ ID NO: 10276 - protein, 107 aa, Artificial Sequence; identical to SEQ ID NO: 6247
  Description of Artificial Sequence: Synthetic polypeptide
  VL of XENP019094

SEQ ID NO: 10277 - protein, 5 aa, Artificial Sequence
  Description of Artificial Sequence: Synthetic peptide
  XENP019094 vhCDR1
NFWMN

SEQ ID NO: 10278 - protein, 19 aa, Artificial Sequence
  Description of Artificial Sequence: Synthetic peptide
  XENP019094 vhCDR2
EIRLYSNNYATHYAEPVKG

SEQ ID NO: 10279 - protein, 11 aa, Artificial Sequence
  Description of Artificial Sequence: Synthetic peptide
  XENP019094 vhCDR3
YYGNYGGYFDV

SEQ ID NO: 10280 - protein, 11 aa, Artificial Sequence
  Description of Artificial Sequence: Synthetic peptide
  XENP019094 vlCDR1
RASQSVSNDVA

SEQ ID NO: 10281 - protein, 7 aa, Artificial Sequence
  Description of Artificial Sequence: Synthetic peptide
  XENP019094 vlCDR2
YASHRYT

SEQ ID NO: 10282 - protein, 9 aa, Artificial Sequence
  Description of Artificial Sequence: Synthetic peptide
  XENP019094 vlCDR3
QQDYSSPRT

SEQ ID NO: 10283 - protein, 249 aa, Artificial Sequence
  Description of Artificial Sequence: Synthetic polypeptide
  XENP019095 1G6_H1.270_L1_scFv(GKPGS)4
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10284 - protein, 122 aa, Artificial Sequence
  Description of Artificial Sequence: Synthetic polypeptide
  VH of XENP019095
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSS

SEQ ID NO: 10285 - protein, 107 aa, Artificial Sequence; identical to SEQ ID NO: 6247
  Description of Artificial Sequence: Synthetic polypeptide
  VL of XENP019095

SEQ ID NO: 10286 - protein, 5 aa, Artificial Sequence
  Description of Artificial Sequence: Synthetic peptide
  XENP019095 vhCDR1
NYWMN

SEQ ID NO: 10287 - protein, 19 aa, Artificial Sequence
  Description of Artificial Sequence: Synthetic peptide
  XENP019095 vhCDR2
EIRWYSNNYATHYAEPVKG

SEQ ID NO: 10288 - protein, 11 aa, Artificial Sequence
  Description of Artificial Sequence: Synthetic peptide
  XENP019095 vhCDR3
YYGNYGGYFDV

SEQ ID NO: 10289 - protein, 11 aa, Artificial Sequence
  Description of Artificial Sequence: Synthetic peptide
  XENP019095 vlCDR1
RASQSVSNDVA

SEQ ID NO: 10290 - protein, 7 aa, Artificial Sequence
  Description of Artificial Sequence: Synthetic peptide
  XENP019095 vlCDR2
YASHRYT

SEQ ID NO: 10291 - protein, 9 aa, Artificial Sequence
  Description of Artificial Sequence: Synthetic peptide
  XENP019095 vlCDR3
QQDYSSPRT

SEQ ID NO: 10292 - protein, 249 aa, Artificial Sequence
  Description of Artificial Sequence: Synthetic polypeptide
  XENP019096 1G6_H1.271_L1_scFv(GKPGS)4
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10293 - protein, 122 aa, Artificial Sequence
  Description of Artificial Sequence: Synthetic polypeptide
  VH of XENP019096
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSS

SEQ ID NO: 10294 - protein, 107 aa, Artificial Sequence; identical to SEQ ID NO: 6247
  Description of Artificial Sequence: Synthetic polypeptide
  VL of XENP019096

SEQ ID NO: 10295 - protein, 5 aa, Artificial Sequence
  Description of Artificial Sequence: Synthetic peptide
  XENP019096 vhCDR1
NYWMN

SEQ ID NO: 10296 - protein, 19 aa, Artificial Sequence
  Description of Artificial Sequence: Synthetic peptide
  XENP019096 vhCDR2
EIRLYSNNYATHYAEPVKG

SEQ ID NO: 10297 - protein, 11 aa, Artificial Sequence
  Description of Artificial Sequence: Synthetic peptide
  XENP019096 vhCDR3
YYGNYGGYFDV

SEQ ID NO: 10298 - protein, 11 aa, Artificial Sequence
  Description of Artificial Sequence: Synthetic peptide
  XENP019096 vlCDR1
RASQSVSNDVA

SEQ ID NO: 10299 - protein, 7 aa, Artificial Sequence
  Description of Artificial Sequence: Synthetic peptide
  XENP019096 vlCDR2
YASHRYT

SEQ ID NO: 10300 - protein, 9 aa, Artificial Sequence
  Description of Artificial Sequence: Synthetic peptide
  XENP019096 vlCDR3
QQDYSSPRT

SEQ ID NO: 10301 - protein, 249 aa, Artificial Sequence
  Description of Artificial Sequence: Synthetic polypeptide
  XENP019101 1G6_H1.272_L1_scFv(GKPGS)4
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10302 - protein, 122 aa, Artificial Sequence
  Description of Artificial Sequence: Synthetic polypeptide
  VH of XENP019101
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSS

SEQ ID NO: 10303 - protein, 107 aa, Artificial Sequence; identical to SEQ ID NO: 6247
  Description of Artificial Sequence: Synthetic polypeptide
  VL of XENP019101

SEQ ID NO: 10304 - protein, 5 aa, Artificial Sequence
  Description of Artificial Sequence: Synthetic peptide
  XENP019101 vhCDR1
NFWMN

SEQ ID NO: 10305 - protein, 19 aa, Artificial Sequence
  Description of Artificial Sequence: Synthetic peptide
  XENP019101 vhCDR2
EIRLYSNNYATHYAEPVKG

SEQ ID NO: 10306 - protein, 11 aa, Artificial Sequence
  Description of Artificial Sequence: Synthetic peptide
  XENP019101 vhCDR3
YYGNYGGYFDV

SEQ ID NO: 10307 - protein, 11 aa, Artificial Sequence
  Description of Artificial Sequence: Synthetic peptide
  XENP019101 vlCDR1
RASQSVSNDVA

SEQ ID NO: 10308 - protein, 7 aa, Artificial Sequence
  Description of Artificial Sequence: Synthetic peptide
  XENP019101 vlCDR2
YASHRYT

SEQ ID NO: 10309 - protein, 9 aa, Artificial Sequence
  Description of Artificial Sequence: Synthetic peptide
  XENP019101 vlCDR3
QQDYSSPRT

SEQ ID NO: 10310 - protein, 249 aa, Artificial Sequence
  Description of Artificial Sequence: Synthetic polypeptide
  XENP019102 1G6_H1.273_L1_scFv(GKPGS)4
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10311 - protein, 122 aa, Artificial Sequence
  Description of Artificial Sequence: Synthetic polypeptide
  VH of XENP019102
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSS

SEQ ID NO: 10312 - protein, 107 aa, Artificial Sequence; identical to SEQ ID NO: 6247
  Description of Artificial Sequence: Synthetic polypeptide
  VL of XENP019102

SEQ ID NO: 10313 - protein, 5 aa, Artificial Sequence
  Description of Artificial Sequence: Synthetic peptide
  XENP019102 vhCDR1
NFWMN

SEQ ID NO: 10314 - protein, 19 aa, Artificial Sequence
  Description of Artificial Sequence: Synthetic peptide
  XENP019102 vhCDR2
EIRWKSNNYATHYAEPVKG

SEQ ID NO: 10315 - protein, 11 aa, Artificial Sequence
  Description of Artificial Sequence: Synthetic peptide
  XENP019102 vhCDR3
YYGNYGGYFDV

SEQ ID NO: 10316 - protein, 11 aa, Artificial Sequence
  Description of Artificial Sequence: Synthetic peptide
  XENP019102 vlCDR1
RASQSVSNDVA

SEQ ID NO: 10317 - protein, 7 aa, Artificial Sequence
  Description of Artificial Sequence: Synthetic peptide
  XENP019102 vlCDR2
YASHRYT

SEQ ID NO: 10318 - protein, 9 aa, Artificial Sequence
  Description of Artificial Sequence: Synthetic peptide
  XENP019102 vlCDR3
QQDYSSPRT

SEQ ID NO: 10319 - protein, 249 aa, Artificial Sequence
  Description of Artificial Sequence: Synthetic polypeptide
  XENP019103 1G6_H1.274_L1_scFv(GKPGS)4
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10320 - protein, 122 aa, Artificial Sequence
  Description of Artificial Sequence: Synthetic polypeptide
  VH of XENP019103
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSS

SEQ ID NO: 10321 - protein, 107 aa, Artificial Sequence; identical to SEQ ID NO: 6247
  Description of Artificial Sequence: Synthetic polypeptide
  VL of XENP019103

SEQ ID NO: 10322 - protein, 5 aa, Artificial Sequence
  Description of Artificial Sequence: Synthetic peptide
  XENP019103 vhCDR1
NFWMN

SEQ ID NO: 10323 - protein, 19 aa, Artificial Sequence
  Description of Artificial Sequence: Synthetic peptide
  XENP019103 vhCDR2
EIRLKKNNYATHYAEPVKG

SEQ ID NO: 10324 - protein, 11 aa, Artificial Sequence
  Description of Artificial Sequence: Synthetic peptide
  XENP019103 vhCDR3
YYGNYGGYFDV

SEQ ID NO: 10325 - protein, 11 aa, Artificial Sequence
  Description of Artificial Sequence: Synthetic peptide
  XENP019103 vlCDR1
RASQSVSNDVA

SEQ ID NO: 10326 - protein, 7 aa, Artificial Sequence
  Description of Artificial Sequence: Synthetic peptide
  XENP019103 vlCDR2
YASHRYT

SEQ ID NO: 10327 - protein, 9 aa, Artificial Sequence
  Description of Artificial Sequence: Synthetic peptide
  XENP019103 vlCDR3
QQDYSSPRT

SEQ ID NO: 10328 - protein, 249 aa, Artificial Sequence
  Description of Artificial Sequence: Synthetic polypeptide
  XENP019104 1G6_H1.275_L1_scFv(GKPGS)4
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10329 - protein, 122 aa, Artificial Sequence
  Description of Artificial Sequence: Synthetic polypeptide
  VH of XENP019104
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSS

SEQ ID NO: 10330 - protein, 107 aa, Artificial Sequence; identical to SEQ ID NO: 6247
  Description of Artificial Sequence: Synthetic polypeptide
  VL of XENP019104

SEQ ID NO: 10331 - protein, 5 aa, Artificial Sequence
  Description of Artificial Sequence: Synthetic peptide
  XENP019104 vhCDR1
NFWMN

SEQ ID NO: 10332 - protein, 19 aa, Artificial Sequence
  Description of Artificial Sequence: Synthetic peptide
  XENP019104 vhCDR2
EIRWYSNNYATHYAEPVKG

SEQ ID NO: 10333 - protein, 11 aa, Artificial Sequence
  Description of Artificial Sequence: Synthetic peptide
  XENP019104 vhCDR3
YYGNYGGYFDV

SEQ ID NO: 10334 - protein, 11 aa, Artificial Sequence
  Description of Artificial Sequence: Synthetic peptide
  XENP019104 vlCDR1
RASQSVSNDVA

SEQ ID NO: 10335 - protein, 7 aa, Artificial Sequence
  Description of Artificial Sequence: Synthetic peptide
  XENP019104 vlCDR2
YASHRYT

SEQ ID NO: 10336 - protein, 9 aa, Artificial Sequence
  Description of Artificial Sequence: Synthetic peptide
  XENP019104 vlCDR3
QQDYSSPRT

SEQ ID NO: 10337 - protein, 249 aa, Artificial Sequence
  Description of Artificial Sequence: Synthetic polypeptide
  XENP019105 1G6_H1.276_L1_scFv(GKPGS)4
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10338 - protein, 122 aa, Artificial Sequence
  Description of Artificial Sequence: Synthetic polypeptide
  VH of XENP019105
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSS

SEQ ID NO: 10339 - protein, 107 aa, Artificial Sequence; identical to SEQ ID NO: 6247
  Description of Artificial Sequence: Synthetic polypeptide
  VL of XENP019105

SEQ ID NO: 10340 - protein, 5 aa, Artificial Sequence
  Description of Artificial Sequence: Synthetic peptide
  XENP019105 vhCDR1
NYWMN

SEQ ID NO: 10341 - protein, 19 aa, Artificial Sequence
  Description of Artificial Sequence: Synthetic peptide
  XENP019105 vhCDR2
EIRLKSNNYATHYAASVKG

SEQ ID NO: 10342 - protein, 11 aa, Artificial Sequence
  Description of Artificial Sequence: Synthetic peptide
  XENP019105 vhCDR3
YYGNYGGYFDV

SEQ ID NO: 10343 - protein, 11 aa, Artificial Sequence
  Description of Artificial Sequence: Synthetic peptide
  XENP019105 vlCDR1
RASQSVSNDVA

SEQ ID NO: 10344 - protein, 7 aa, Artificial Sequence
  Description of Artificial Sequence: Synthetic peptide
  XENP019105 vlCDR2
YASHRYT

SEQ ID NO: 10345 - protein, 9 aa, Artificial Sequence
  Description of Artificial Sequence: Synthetic peptide
  XENP019105 vlCDR3
QQDYSSPRT

SEQ ID NO: 10346 - protein, 249 aa, Artificial Sequence
  Description of Artificial Sequence: Synthetic polypeptide
  XENP019106 1G6_H1.277_L1_scFv(GKPGS)4
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10347 - protein, 122 aa, Artificial Sequence
  Description of Artificial Sequence: Synthetic polypeptide
  VH of XENP019106
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSS

SEQ ID NO: 10348 - protein, 107 aa, Artificial Sequence; identical to SEQ ID NO: 6247
  Description of Artificial Sequence: Synthetic polypeptide
  VL of XENP019106

SEQ ID NO: 10349 - protein, 5 aa, Artificial Sequence
  Description of Artificial Sequence: Synthetic peptide
  XENP019106 vhCDR1
NYWMN

SEQ ID NO: 10350 - protein, 19 aa, Artificial Sequence
  Description of Artificial Sequence: Synthetic peptide
  XENP019106 vhCDR2
EIRLKSNNYATHYADSVKG

SEQ ID NO: 10351 - protein, 11 aa, Artificial Sequence
  Description of Artificial Sequence: Synthetic peptide
  XENP019106 vhCDR3
YYGNYGGYFDV

SEQ ID NO: 10352 - protein, 11 aa, Artificial Sequence
  Description of Artificial Sequence: Synthetic peptide
  XENP019106 vlCDR1
RASQSVSNDVA

SEQ ID NO: 10353 - protein, 7 aa, Artificial Sequence
  Description of Artificial Sequence: Synthetic peptide
  XENP019106 vlCDR2
YASHRYT

SEQ ID NO: 10354 - protein, 9 aa, Artificial Sequence
  Description of Artificial Sequence: Synthetic peptide
  XENP019106 vlCDR3
QQDYSSPRT

SEQ ID NO: 10355 - protein, 249 aa, Artificial Sequence
  Description of Artificial Sequence: Synthetic polypeptide
  XENP019107 1G6_H1_L1.146_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10356 - protein, 122 aa, Artificial Sequence; identical to SEQ ID NO: 6246
  Description of Artificial Sequence: Synthetic polypeptide
  VH of XENP019107

SEQ ID NO: 10357 - protein, 107 aa, Artificial Sequence
  Description of Artificial Sequence: Synthetic polypeptide
  VL of XENP019107
SIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10358 - protein, 5 aa, Artificial Sequence
  Description of Artificial Sequence: Synthetic peptide
  XENP019107 vhCDR1
NYWMN

SEQ ID NO: 10359 - protein, 19 aa, Artificial Sequence
  Description of Artificial Sequence: Synthetic peptide
  XENP019107 vhCDR2
EIRLKSNNYATHYAEPVKG

SEQ ID NO: 10360 - protein, 11 aa, Artificial Sequence
  Description of Artificial Sequence: Synthetic peptide
  XENP019107 vhCDR3
YYGNYGGYFDV

SEQ ID NO: 10361 - protein, 11 aa, Artificial Sequence
  Description of Artificial Sequence: Synthetic peptide
  XENP019107 vlCDR1
RASQSVSNDVA

SEQ ID NO: 10362 - protein, 7 aa, Artificial Sequence
  Description of Artificial Sequence: Synthetic peptide
  XENP019107 vlCDR2
YASHRYT

SEQ ID NO: 10363 - protein, 9 aa, Artificial Sequence
  Description of Artificial Sequence: Synthetic peptide
  XENP019107 vlCDR3
QQDYSSPRT

SEQ ID NO: 10364 - protein, 249 aa, Artificial Sequence
  Description of Artificial Sequence: Synthetic polypeptide
  XENP019108 1G6_H1_L1.147_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10365 - protein, 122 aa, Artificial Sequence; identical to SEQ ID NO: 6246
  Description of Artificial Sequence: Synthetic polypeptide
  VH of XENP019108

SEQ ID NO: 10366 - protein, 107 aa, Artificial Sequence
  Description of Artificial Sequence: Synthetic polypeptide
  VL of XENP019108
SIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10367 - protein, 5 aa, Artificial Sequence
  Description of Artificial Sequence: Synthetic peptide
  XENP019108 vhCDR1
NYWMN

SEQ ID NO: 10368 - protein, 19 aa, Artificial Sequence
  Description of Artificial Sequence: Synthetic peptide
  XENP019108 vhCDR2
EIRLKSNNYATHYAEPVKG

SEQ ID NO: 10369 - protein, 11 aa, Artificial Sequence
  Description of Artificial Sequence: Synthetic peptide
  XENP019108 vhCDR3
YYGNYGGYFDV

SEQ ID NO: 10370 - protein, 11 aa, Artificial Sequence
  Description of Artificial Sequence: Synthetic peptide
  XENP019108 vlCDR1
RASQSVSNDVA

SEQ ID NO: 10371 - protein, 7 aa, Artificial Sequence
  Description of Artificial Sequence: Synthetic peptide
  XENP019108 vlCDR2
YASHRYT

SEQ ID NO: 10372 - protein, 9 aa, Artificial Sequence
  Description of Artificial Sequence: Synthetic peptide
  XENP019108 vlCDR3
QQDYSSPRT

SEQ ID NO: 10373 - protein, 249 aa, Artificial Sequence
  Description of Artificial Sequence: Synthetic polypeptide
  XENP019109 1G6_H1_L1.148_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10374 - protein, 122 aa, Artificial Sequence; identical to SEQ ID NO: 6246
  Description of Artificial Sequence: Synthetic polypeptide
  VH of XENP019109

SEQ ID NO: 10375 - protein, 107 aa, Artificial Sequence
  Description of Artificial Sequence: Synthetic polypeptide
  VL of XENP019109
SIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10376 - protein, 5 aa, Artificial Sequence
  Description of Artificial Sequence: Synthetic peptide
  XENP019109 vhCDR1
NYWMN

SEQ ID NO: 10377 - protein, 19 aa, Artificial Sequence
  Description of Artificial Sequence: Synthetic peptide
  XENP019109 vhCDR2
EIRLKSNNYATHYAEPVKG

SEQ ID NO: 10378 - protein, 11 aa, Artificial Sequence
  Description of Artificial Sequence: Synthetic peptide
  XENP019109 vhCDR3
YYGNYGGYFDV

SEQ ID NO: 10379 - protein, 11 aa, Artificial Sequence
  Description of Artificial Sequence: Synthetic peptide
  XENP019109 vlCDR1
RASQSVSNDVA

SEQ ID NO: 10380 - protein, 7 aa, Artificial Sequence
  Description of Artificial Sequence: Synthetic peptide
  XENP019109 vlCDR2
YASHRYT

SEQ ID NO: 10381 - protein, 9 aa, Artificial Sequence
  Description of Artificial Sequence: Synthetic peptide
  XENP019109 vlCDR3
QQDYSSPRT

SEQ ID NO: 10382 - protein, 249 aa, Artificial Sequence
  Description of Artificial Sequence: Synthetic polypeptide
  XENP019110 1G6_H1_L1.149_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10383 - protein, 122 aa, Artificial Sequence; identical to SEQ ID NO: 6246
  Description of Artificial Sequence: Synthetic polypeptide
  VH of XENP019110

SEQ ID NO: 10384 - protein, 107 aa, Artificial Sequence
  Description of Artificial Sequence: Synthetic polypeptide
  VL of XENP019110
SIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10385 - protein, 5 aa, Artificial Sequence
  Description of Artificial Sequence: Synthetic peptide
  XENP019110 vhCDR1
NYWMN

SEQ ID NO: 10386 - protein, 19 aa, Artificial Sequence
  Description of Artificial Sequence: Synthetic peptide
  XENP019110 vhCDR2
EIRLKSNNYATHYAEPVKG

SEQ ID NO: 10387 - protein, 11 aa, Artificial Sequence
  Description of Artificial Sequence: Synthetic peptide
  XENP019110 vhCDR3
YYGNYGGYFDV

SEQ ID NO: 10388 - protein, 11 aa, Artificial Sequence
  Description of Artificial Sequence: Synthetic peptide
  XENP019110 vlCDR1
RASQSVSNDVA

SEQ ID NO: 10389 - protein, 7 aa, Artificial Sequence
  Description of Artificial Sequence: Synthetic peptide
  XENP019110 vlCDR2
YASHRYT

SEQ ID NO: 10390 - protein, 9 aa, Artificial Sequence
  Description of Artificial Sequence: Synthetic peptide
  XENP019110 vlCDR3
QQDYSSPRT

SEQ ID NO: 10391 - protein, 249 aa, Artificial Sequence
  Description of Artificial Sequence: Synthetic polypeptide
  XENP019111 1G6_H1_L1.150_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10392 - protein, 122 aa, Artificial Sequence; identical to SEQ ID NO: 6246
  Description of Artificial Sequence: Synthetic polypeptide
  VH of XENP019111

SEQ ID NO: 10393 - protein, 107 aa, Artificial Sequence
  Description of Artificial Sequence: Synthetic polypeptide
  VL of XENP019111
SIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 10394 - protein, 5 aa, Artificial Sequence
  Description of Artificial Sequence: Synthetic peptide
  XENP019111 vhCDR1
NYWMN

SEQ ID NO: 10395 - protein, 19 aa, Artificial Sequence
  Description of Artificial Sequence: Synthetic peptide
  XENP019111 vhCDR2
EIRLKSNNYATHYAEPVKG

SEQ ID NO: 10396 - protein, 11 aa, Artificial Sequence
  Description of Artificial Sequence: Synthetic peptide
  XENP019111 vhCDR3
YYGNYGGYFDV

SEQ ID NO: 10397 - protein, 11 aa, Artificial Sequence
  Description of Artificial Sequence: Synthetic peptide
  XENP019111 vlCDR1
RASQSVSNDVA

SEQ ID NO: 10398 - protein, 7 aa, Artificial Sequence
  Description of Artificial Sequence: Synthetic peptide
  XENP019111 vlCDR2
YASHRYT

SEQ ID NO: 10399 - protein, 9 aa, Artificial Sequence
  Description of Artificial Sequence: Synthetic peptide
  XENP019111 vlCDR3
QQDYSSPRT

SEQ ID NO: 10400 - protein, 249 aa, Artificial Sequence
  Description of Artificial Sequence: Synthetic polypeptide
  XENP019112 1G6_H1_L1.151_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10401 - protein, 122 aa, Artificial Sequence; identical to SEQ ID NO: 6246
  Description of Artificial Sequence: Synthetic polypeptide
  VH of XENP019112

SEQ ID NO: 10402 - protein, 107 aa, Artificial Sequence
  Description of Artificial Sequence: Synthetic polypeptide
  VL of XENP019112
SIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10403 - protein, 5 aa, Artificial Sequence
  Description of Artificial Sequence: Synthetic peptide
  XENP019112 vhCDR1
NYWMN

SEQ ID NO: 10404 - protein, 19 aa, Artificial Sequence
  Description of Artificial Sequence: Synthetic peptide
  XENP019112 vhCDR2
EIRLKSNNYATHYAEPVKG

SEQ ID NO: 10405 - protein, 11 aa, Artificial Sequence
  Description of Artificial Sequence: Synthetic peptide
  XENP019112 vhCDR3
YYGNYGGYFDV

SEQ ID NO: 10406 - protein, 11 aa, Artificial Sequence
  Description of Artificial Sequence: Synthetic peptide
  XENP019112 vlCDR1
RASQSVSNDVA

SEQ ID NO: 10407 - protein, 7 aa, Artificial Sequence
  Description of Artificial Sequence: Synthetic peptide
  XENP019112 vlCDR2
YASHRYT

SEQ ID NO: 10408 - protein, 9 aa, Artificial Sequence
  Description of Artificial Sequence: Synthetic peptide
  XENP019112 vlCDR3
QQDYSSPRT

SEQ ID NO: 10409 - protein, 249 aa, Artificial Sequence
  Description of Artificial Sequence: Synthetic polypeptide
  XENP019113 1G6_H1_L1.152_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10410 - protein, 122 aa, Artificial Sequence; identical to SEQ ID NO: 6246
  Description of Artificial Sequence: Synthetic polypeptide
  VH of XENP019113

SEQ ID NO: 10411 - protein, 107 aa, Artificial Sequence
  Description of Artificial Sequence: Synthetic polypeptide
  VL of XENP019113
SIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10412 - protein, 5 aa, Artificial Sequence
  Description of Artificial Sequence: Synthetic peptide
  XENP019113 vhCDR1
NYWMN

SEQ ID NO: 10413 - protein, 19 aa, Artificial Sequence
  Description of Artificial Sequence: Synthetic peptide
  XENP019113 vhCDR2
EIRLKSNNYATHYAEPVKG

SEQ ID NO: 10414 - protein, 11 aa, Artificial Sequence
  Description of Artificial Sequence: Synthetic peptide
  XENP019113 vhCDR3
YYGNYGGYFDV

SEQ ID NO: 10415 - protein, 11 aa, Artificial Sequence
  Description of Artificial Sequence: Synthetic peptide
  XENP019113 vlCDR1
RASQSVSNDVA

SEQ ID NO: 10416 - protein, 7 aa, Artificial Sequence
  Description of Artificial Sequence: Synthetic peptide
  XENP019113 vlCDR2
YASHRYT

SEQ ID NO: 10417 - protein, 9 aa, Artificial Sequence
  Description of Artificial Sequence: Synthetic peptide
  XENP019113 vlCDR3
QQDYSSPRT

SEQ ID NO: 10418 - protein, 249 aa, Artificial Sequence
  Description of Artificial Sequence: Synthetic polypeptide
  XENP019114 1G6_H1_L1.153_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIK

SEQ ID NO: 10419 - protein, 122 aa, Artificial Sequence; identical to SEQ ID NO: 6246
  Description of Artificial Sequence: Synthetic polypeptide
  VH of XENP019114

SEQ ID NO: 10420 - protein, 107 aa, Artificial Sequence
  Description of Artificial Sequence: Synthetic polypeptide
  VL of XENP019114
SIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIK

SEQ ID NO: 10421 - protein, 5 aa, Artificial Sequence
  Description of Artificial Sequence: Synthetic peptide
  XENP019114 vhCDR1
NYWMN

SEQ ID NO: 10422 - protein, 19 aa, Artificial Sequence
  Description of Artificial Sequence: Synthetic peptide
  XENP019114 vhCDR2
EIRLKSNNYATHYAEPVKG

SEQ ID NO: 10423 - protein, 11 aa, Artificial Sequence
  Description of Artificial Sequence: Synthetic peptide
  XENP019114 vhCDR3
YYGNYGGYFDV

SEQ ID NO: 10424 - protein, 11 aa, Artificial Sequence
  Description of Artificial Sequence: Synthetic peptide
  XENP019114 vlCDR1
RASQSVSNDVA

SEQ ID NO: 10425 - protein, 7 aa, Artificial Sequence
  Description of Artificial Sequence: Synthetic peptide
  XENP019114 vlCDR2
YASHRYT

SEQ ID NO: 10426 - protein, 9 aa, Artificial Sequence
  Description of Artificial Sequence: Synthetic peptide
  XENP019114 vlCDR3
QQDYSSPRT

SEQ ID NO: 10427 - protein, 249 aa, Artificial Sequence
  Description of Artificial Sequence: Synthetic polypeptide
  XENP019115 1G6_H1_L1.154_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIK

SEQ ID NO: 10428 - protein, 122 aa, Artificial Sequence; identical to SEQ ID NO: 6246
  Description of Artificial Sequence: Synthetic polypeptide
  VH of XENP019115

SEQ ID NO: 10429 - protein, 107 aa, Artificial Sequence
  Description of Artificial Sequence: Synthetic polypeptide
  VL of XENP019115
SIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIK

SEQ ID NO: 10430 - protein, 5 aa, Artificial Sequence
  Description of Artificial Sequence: Synthetic peptide
  XENP019115 vhCDR1
NYWMN

SEQ ID NO: 10431 - protein, 19 aa, Artificial Sequence
  Description of Artificial Sequence: Synthetic peptide
  XENP019115 vhCDR2
EIRLKSNNYATHYAEPVKG

SEQ ID NO: 10432 - protein, 11 aa, Artificial Sequence
  Description of Artificial Sequence: Synthetic peptide
  XENP019115 vhCDR3
YYGNYGGYFDV

SEQ ID NO: 10433 - protein, 11 aa, Artificial Sequence
  Description of Artificial Sequence: Synthetic peptide
  XENP019115 vlCDR1
RASQSVSNDVA

SEQ ID NO: 10434 - protein, 9 aa, Artificial Sequence
  Description of Artificial Sequence: Synthetic peptide
  XENP019115 vlCDR2
VNYASHRYT

SEQ ID NO: 10435 - protein, 9 aa, Artificial Sequence
  Description of Artificial Sequence: Synthetic peptide
  XENP019115 vlCDR3
QQDYSSPRT

SEQ ID NO: 10436 - protein, 249 aa, Artificial Sequence
  Description of Artificial Sequence: Synthetic polypeptide
  XENP019116 1G6_H1_L1.155_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIK

SEQ ID NO: 10437 - protein, 122 aa, Artificial Sequence; identical to SEQ ID NO: 6246
  Description of Artificial Sequence: Synthetic polypeptide
  VH of XENP019116

SEQ ID NO: 10438 - protein, 107 aa, Artificial Sequence
  Description of Artificial Sequence: Synthetic polypeptide
  VL of XENP019116
SIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIK

SEQ ID NO: 10439 - protein, 5 aa, Artificial Sequence
  Description of Artificial Sequence: Synthetic peptide
  XENP019116 vhCDR1
NYWMN

SEQ ID NO: 10440 - protein, 19 aa, Artificial Sequence
  Description of Artificial Sequence: Synthetic peptide
  XENP019116 vhCDR2
EIRLKSNNYATHYAEPVKG

SEQ ID NO: 10441 - protein, 11 aa, Artificial Sequence
  Description of Artificial Sequence: Synthetic peptide
  XENP019116 vhCDR3
YYGNYGGYFDV

SEQ ID NO: 10442 - protein, 11 aa, Artificial Sequence
  Description of Artificial Sequence: Synthetic peptide
  XENP019116 vlCDR1
RASQSVSNDVA

SEQ ID NO: 10443 - protein, 7 aa, Artificial Sequence
  Description of Artificial Sequence: Synthetic peptide
  XENP019116 vlCDR2
YANHRYT

SEQ ID NO: 10444 - protein, 9 aa, Artificial Sequence
  Description of Artificial Sequence: Synthetic peptide
  XENP019116 vlCDR3
QQDYSSPRT

SEQ ID NO: 10445 - protein, 249 aa, Artificial Sequence
  Description of Artificial Sequence: Synthetic polypeptide
  XENP019117 1G6_H1_L1.156_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIK

SEQ ID NO: 10446 - protein, 122 aa, Artificial Sequence; identical to SEQ ID NO: 6246
  Description of Artificial Sequence: Synthetic polypeptide
  VH of XENP019117

SEQ ID NO: 10447 - protein, 107 aa, Artificial Sequence
  Description of Artificial Sequence: Synthetic polypeptide
  VL of XENP019117
SIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIK

SEQ ID NO: 10448 - protein, 5 aa, Artificial Sequence
  Description of Artificial Sequence: Synthetic peptide
  XENP019117 vhCDR1
NYWMN

SEQ ID NO: 10449 - protein, 19 aa, Artificial Sequence
  Description of Artificial Sequence: Synthetic peptide
  XENP019117 vhCDR2
EIRLKSNNYATHYAEPVKG

SEQ ID NO: 10450 - protein, 11 aa, Artificial Sequence
  Description of Artificial Sequence: Synthetic peptide
  XENP019117 vhCDR3
YYGNYGGYFDV

SEQ ID NO: 10451 - protein, 11 aa, Artificial Sequence
  Description of Artificial Sequence: Synthetic peptide
  XENP019117 vlCDR1
RASQSVSNDVA

SEQ ID NO: 10452 - protein, 7 aa, Artificial Sequence
  Description of Artificial Sequence: Synthetic peptide
  XENP019117 vlCDR2
YASHRYT

SEQ ID NO: 10453 - protein, 9 aa, Artificial Sequence
  Description of Artificial Sequence: Synthetic peptide
  XENP019117 vlCDR3
QQDYSSPRT

SEQ ID NO: 10454 - protein, 249 aa, Artificial Sequence
  Description of Artificial Sequence: Synthetic polypeptide
  XENP019118 1G6_H1_L1.157_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIK

SEQ ID NO: 10455 - protein, 122 aa, Artificial Sequence; identical to SEQ ID NO: 6246
  Description of Artificial Sequence: Synthetic polypeptide
  VH of XENP019118

SEQ ID NO: 10456 - protein, 107 aa, Artificial Sequence
  Description of Artificial Sequence: Synthetic polypeptide
  VL of XENP019118
SIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIK

SEQ ID NO: 10457 - protein, 5 aa, Artificial Sequence
  Description of Artificial Sequence: Synthetic peptide
  XENP019118 vhCDR1
NYWMN

SEQ ID NO: 10458 - protein, 19 aa, Artificial Sequence
  Description of Artificial Sequence: Synthetic peptide
  XENP019118 vhCDR2
EIRLKSNNYATHYAEPVKG

SEQ ID NO: 10459 - protein, 11 aa, Artificial Sequence
  Description of Artificial Sequence: Synthetic peptide
  XENP019118 vhCDR3
YYGNYGGYFDV

SEQ ID NO: 10460 - protein, 11 aa, Artificial Sequence
  Description of Artificial Sequence: Synthetic peptide
  XENP019118 vlCDR1
RASQSVSNDVA

SEQ ID NO: 10461 - protein, 7 aa, Artificial Sequence
  Description of Artificial Sequence: Synthetic peptide
  XENP019118 vlCDR2
YASHRYT

SEQ ID NO: 10462 - protein, 9 aa, Artificial Sequence
  Description of Artificial Sequence: Synthetic peptide
  XENP019118 vlCDR3
QQDYSSPRT

SEQ ID NO: 10463 - protein, 249 aa, Artificial Sequence
  Description of Artificial Sequence: Synthetic polypeptide
  XENP019119 1G6_H1_L1.158_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIK

SEQ ID NO: 10464 - protein, 122 aa, Artificial Sequence; identical to SEQ ID NO: 6246
  Description of Artificial Sequence: Synthetic polypeptide
  VH of XENP019119

SEQ ID NO: 10465 - protein, 107 aa, Artificial Sequence
  Description of Artificial Sequence: Synthetic polypeptide
  VL of XENP019119
SIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIK

SEQ ID NO: 10466 - protein, 5 aa, Artificial Sequence
  Description of Artificial Sequence: Synthetic peptide
  XENP019119 vhCDR1
NYWMN

SEQ ID NO: 10467 - protein, 19 aa, Artificial Sequence
  Description of Artificial Sequence: Synthetic peptide
  XENP019119 vhCDR2
EIRLKSNNYATHYAEPVKG

SEQ ID NO: 10468 - protein, 11 aa, Artificial Sequence
  Description of Artificial Sequence: Synthetic peptide
  XENP019119 vhCDR3
YYGNYGGYFDV

SEQ ID NO: 10469 - protein, 11 aa, Artificial Sequence
  Description of Artificial Sequence: Synthetic peptide
  XENP019119 vlCDR1
RASQSVSNDVA

SEQ ID NO: 10470 - protein, 7 aa, Artificial Sequence
  Description of Artificial Sequence: Synthetic peptide
  XENP019119 vlCDR2
YASHRYT

SEQ ID NO: 10471 - protein, 9 aa, Artificial Sequence
  Description of Artificial Sequence: Synthetic peptide
  XENP019119 vlCDR3
QQDYSSPRT

SEQ ID NO: 10472 - protein, 249 aa, Artificial Sequence
  Description of Artificial Sequence: Synthetic polypeptide
  XENP019120 1G6_H1_L1.159_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 10473 - protein, 122 aa, Artificial Sequence; identical to SEQ ID NO: 6246
  Description of Artificial Sequence: Synthetic polypeptide
  VH of XENP019120

SEQ ID NO: 10474 - protein, 107 aa, Artificial Sequence
  Description of Artificial Sequence: Synthetic polypeptide
  VL of XENP019120
SIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 10475 - protein, 5 aa, Artificial Sequence
  Description of Artificial Sequence: Synthetic peptide
  XENP019120 vhCDR1
NYWMN

SEQ ID NO: 10476 - protein, 19 aa, Artificial Sequence
  Description of Artificial Sequence: Synthetic peptide
  XENP019120 vhCDR2
EIRLKSNNYATHYAEPVKG

SEQ ID NO: 10477 - protein, 11 aa, Artificial Sequence
  Description of Artificial Sequence: Synthetic peptide
  XENP019120 vhCDR3
YYGNYGGYFDV

SEQ ID NO: 10478 - protein, 11 aa, Artificial Sequence
  Description of Artificial Sequence: Synthetic peptide
  XENP019120 vlCDR1
RASQSVSNDVA

SEQ ID NO: 10479 - protein, 7 aa, Artificial Sequence
  Description of Artificial Sequence: Synthetic peptide
  XENP019120 vlCDR2
YASHRYT

SEQ ID NO: 10480 - protein, 9 aa, Artificial Sequence
  Description of Artificial Sequence: Synthetic peptide
  XENP019120 vlCDR3
KQDYSSPRT

SEQ ID NO: 10481 - protein, 249 aa, Artificial Sequence
  Description of Artificial Sequence: Synthetic polypeptide
  XENP019121 1G6_H1_L1.160_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIK

SEQ ID NO: 10482 - protein, 122 aa, Artificial Sequence; identical to SEQ ID NO: 6246
  Description of Artificial Sequence: Synthetic polypeptide
  VH of XENP019121

SEQ ID NO: 10483 - protein, 107 aa, Artificial Sequence
  Description of Artificial Sequence: Synthetic polypeptide
  VL of XENP019121
SIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIK

SEQ ID NO: 10484 - protein, 5 aa, Artificial Sequence
  Description of Artificial Sequence: Synthetic peptide
  XENP019121 vhCDR1
NYWMN

SEQ ID NO: 10485 - protein, 19 aa, Artificial Sequence
  Description of Artificial Sequence: Synthetic peptide
  XENP019121 vhCDR2
EIRLKSNNYATHYAEPVKG

SEQ ID NO: 10486 - protein, 11 aa, Artificial Sequence
  Description of Artificial Sequence: Synthetic peptide
  XENP019121 vhCDR3
YYGNYGGYFDV

SEQ ID NO: 10487 - protein, 11 aa, Artificial Sequence
  Description of Artificial Sequence: Synthetic peptide
  XENP019121 vlCDR1
RASQSVSNDVA

SEQ ID NO: 10488 - protein, 7 aa, Artificial Sequence
  Description of Artificial Sequence: Synthetic peptide
  XENP019121 vlCDR2
YASHRYT

SEQ ID NO: 10489 - protein, 9 aa, Artificial Sequence
  Description of Artificial Sequence: Synthetic peptide
  XENP019121 vlCDR3
QKDYSSPRT

SEQ ID NO: 10490 - protein, 249 aa, Artificial Sequence
  Description of Artificial Sequence: Synthetic polypeptide
  XENP019122 1G6_H1_L1.161_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIK

SEQ ID NO: 10491 - protein, 122 aa, Artificial Sequence; identical to SEQ ID NO: 6246
  Description of Artificial Sequence: Synthetic polypeptide
  VH of XENP019122

SEQ ID NO: 10492 - protein, 107 aa, Artificial Sequence
  Description of Artificial Sequence: Synthetic polypeptide
  VL of XENP019122
SIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIK

SEQ ID NO: 10493 - protein, 5 aa, Artificial Sequence
  Description of Artificial Sequence: Synthetic peptide
  XENP019122 vhCDR1
NYWMN

SEQ ID NO: 10494 - protein, 19 aa, Artificial Sequence
  Description of Artificial Sequence: Synthetic peptide
  XENP019122 vhCDR2
EIRLKSNNYATHYAEPVKG

SEQ ID NO: 10495 - protein, 11 aa, Artificial Sequence
  Description of Artificial Sequence: Synthetic peptide
  XENP019122 vhCDR3
YYGNYGGYFDV

SEQ ID NO: 10496 - protein, 11 aa, Artificial Sequence
  Description of Artificial Sequence: Synthetic peptide
  XENP019122 vlCDR1
RASQSVSNDVA

SEQ ID NO: 10497 - protein, 7 aa, Artificial Sequence
  Description of Artificial Sequence: Synthetic peptide
  XENP019122 vlCDR2
YASHRYT

SEQ ID NO: 10498 - protein, 9 aa, Artificial Sequence
  Description of Artificial Sequence: Synthetic peptide
  XENP019122 vlCDR3
QNDYSSPRT

SEQ ID NO: 10499 - protein, 249 aa, Artificial Sequence
  Description of Artificial Sequence: Synthetic polypeptide
  XENP019123 1G6_H1_L1.162_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIK

SEQ ID NO: 10500 - protein, 122 aa, Artificial Sequence; identical to SEQ ID NO: 6246
  Description of Artificial Sequence: Synthetic polypeptide
  VH of XENP019123

SEQ ID NO: 10501 - protein, 107 aa, Artificial Sequence
  Description of Artificial Sequence: Synthetic polypeptide
  VL of XENP019123
SIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIK

SEQ ID NO: 10502 - protein, 5 aa, Artificial Sequence
  Description of Artificial Sequence: Synthetic peptide
  XENP019123 vhCDR1
NYWMN

SEQ ID NO: 10503 - protein, 19 aa, Artificial Sequence
  Description of Artificial Sequence: Synthetic peptide
  XENP019123 vhCDR2
EIRLKSNNYATHYAEPVKG

SEQ ID NO: 10504 - protein, 11 aa, Artificial Sequence
  Description of Artificial Sequence: Synthetic peptide
  XENP019123 vhCDR3
YYGNYGGYFDV

SEQ ID NO: 10505 - protein, 11 aa, Artificial Sequence
  Description of Artificial Sequence: Synthetic peptide
  XENP019123 vlCDR1
RASQSVSNDVA

SEQ ID NO: 10506 - protein, 7 aa, Artificial Sequence
  Description of Artificial Sequence: Synthetic peptide
  XENP019123 vlCDR2
YASHRYT

SEQ ID NO: 10507 - protein, 9 aa, Artificial Sequence
  Description of Artificial Sequence: Synthetic peptide
  XENP019123 vlCDR3
QRDYSSPRT

SEQ ID NO: 10508 - protein, 249 aa, Artificial Sequence
  Description of Artificial Sequence: Synthetic polypeptide
  XENP019124 1G6_H1_L1.163_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIK

SEQ ID NO: 10509 - protein, 122 aa, Artificial Sequence; identical to SEQ ID NO: 6246
  Description of Artificial Sequence: Synthetic polypeptide
  VH of XENP019124

SEQ ID NO: 10510 - protein, 107 aa, Artificial Sequence
  Description of Artificial Sequence: Synthetic polypeptide
  VL of XENP019124
SIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIK

SEQ ID NO: 10511 - protein, 5 aa, Artificial Sequence
  Description of Artificial Sequence: Synthetic peptide
  XENP019124 vhCDR1
NYWMN

SEQ ID NO: 10512 - protein, 19 aa, Artificial Sequence
  Description of Artificial Sequence: Synthetic peptide
  XENP019124 vhCDR2
EIRLKSNNYATHYAEPVKG

SEQ ID NO: 10513 - protein, 11 aa, Artificial Sequence
  Description of Artificial Sequence: Synthetic peptide
  XENP019124 vhCDR3
YYGNYGGYFDV

SEQ ID NO: 10514 - protein, 11 aa, Artificial Sequence
  Description of Artificial Sequence: Synthetic peptide
  XENP019124 vlCDR1
RASQSVSNDVA

SEQ ID NO: 10515 - protein, 7 aa, Artificial Sequence
  Description of Artificial Sequence: Synthetic peptide
  XENP019124 vlCDR2
YASHRYT

SEQ ID NO: 10516 - protein, 9 aa, Artificial Sequence
  Description of Artificial Sequence: Synthetic peptide
  XENP019124 vlCDR3
QQDYSSPRT

SEQ ID NO: 10517 - protein, 249 aa, Artificial Sequence
  Description of Artificial Sequence: Synthetic polypeptide
  XENP019125 1G6_H1_L1.164_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIK

SEQ ID NO: 10518 - protein, 122 aa, Artificial Sequence; identical to SEQ ID NO: 6246
  Description of Artificial Sequence: Synthetic polypeptide
  VH of XENP019125

SEQ ID NO: 10519 - protein, 107 aa, Artificial Sequence
  Description of Artificial Sequence: Synthetic polypeptide
  VL of XENP019125
SIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIK

SEQ ID NO: 10520 - protein, 5 aa, Artificial Sequence
  Description of Artificial Sequence: Synthetic peptide
  XENP019125 vhCDR1
NYWMN

SEQ ID NO: 10521 - protein, 19 aa, Artificial Sequence
  Description of Artificial Sequence: Synthetic peptide
  XENP019125 vhCDR2
EIRLKSNNYATHYAEPVKG

SEQ ID NO: 10522 - protein, 11 aa, Artificial Sequence
  Description of Artificial Sequence: Synthetic peptide
  XENP019125 vhCDR3
YYGNYGGYFDV

SEQ ID NO: 10523 - protein, 11 aa, Artificial Sequence
  Description of Artificial Sequence: Synthetic peptide
  XENP019125 vlCDR1
RASESVSNDVA

SEQ ID NO: 10524 - protein, 7 aa, Artificial Sequence
  Description of Artificial Sequence: Synthetic peptide
  XENP019125 vlCDR2
YASHRYT

SEQ ID NO: 10525 - protein, 9 aa, Artificial Sequence
  Description of Artificial Sequence: Synthetic peptide
  XENP019125 vlCDR3
QKDYSSPRT

SEQ ID NO: 10526 - protein, 249 aa, Artificial Sequence
  Description of Artificial Sequence: Synthetic polypeptide
  XENP019126 1G6_H1_L1.165_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIK

SEQ ID NO: 10527 - protein, 122 aa, Artificial Sequence; identical to SEQ ID NO: 6246
  Description of Artificial Sequence: Synthetic polypeptide
  VH of XENP019126

SEQ ID NO: 10528 - protein, 107 aa, Artificial Sequence
  Description of Artificial Sequence: Synthetic polypeptide
  VL of XENP019126
SIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIK

SEQ ID NO: 10529 - protein, 5 aa, Artificial Sequence
  Description of Artificial Sequence: Synthetic peptide
  XENP019126 vhCDR1
NYWMN

SEQ ID NO: 10530 - protein, 19 aa, Artificial Sequence
  Description of Artificial Sequence: Synthetic peptide
  XENP019126 vhCDR2
EIRLKSNNYATHYAEPVKG

SEQ ID NO: 10531 - protein, 11 aa, Artificial Sequence
  Description of Artificial Sequence: Synthetic peptide
  XENP019126 vhCDR3
YYGNYGGYFDV

SEQ ID NO: 10532 - protein, 11 aa, Artificial Sequence
  Description of Artificial Sequence: Synthetic peptide
  XENP019126 vlCDR1
RASESVSNDVA

SEQ ID NO: 10533 - protein, 7 aa, Artificial Sequence
  Description of Artificial Sequence: Synthetic peptide
  XENP019126 vlCDR2
YASHRYT

SEQ ID NO: 10534 - protein, 9 aa, Artificial Sequence
  Description of Artificial Sequence: Synthetic peptide
  XENP019126 vlCDR3
QQDYKSPRT

SEQ ID NO: 10535 - protein, 249 aa, Artificial Sequence
  Description of Artificial Sequence: Synthetic polypeptide
  XENP019127 1G6_H1_L1.166_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIK

SEQ ID NO: 10536 - protein, 122 aa, Artificial Sequence; identical to SEQ ID NO: 6246
  Description of Artificial Sequence: Synthetic polypeptide
  VH of XENP019127

SEQ ID NO: 10537 - protein, 107 aa, Artificial Sequence
  Description of Artificial Sequence: Synthetic polypeptide
  VL of XENP019127
SIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIK

SEQ ID NO: 10538 - protein, 5 aa, Artificial Sequence
  Description of Artificial Sequence: Synthetic peptide
  XENP019127 vhCDR1
NYWMN

SEQ ID NO: 10539 - protein, 19 aa, Artificial Sequence
  Description of Artificial Sequence: Synthetic peptide
  XENP019127 vhCDR2
EIRLKSNNYATHYAEPVKG

SEQ ID NO: 10540 - protein, 11 aa, Artificial Sequence
  Description of Artificial Sequence: Synthetic peptide
  XENP019127 vhCDR3
YYGNYGGYFDV

SEQ ID NO: 10541 - protein, 11 aa, Artificial Sequence
  Description of Artificial Sequence: Synthetic peptide
  XENP019127 vlCDR1
RASQSVSNDVA

SEQ ID NO: 10542 - protein, 7 aa, Artificial Sequence
  Description of Artificial Sequence: Synthetic peptide
  XENP019127 vlCDR2
YASHRYT

SEQ ID NO: 10543 - protein, 9 aa, Artificial Sequence
  Description of Artificial Sequence: Synthetic peptide
  XENP019127 vlCDR3
QQDYSSPRT

SEQ ID NO: 10544 - protein, 249 aa, Artificial Sequence
  Description of Artificial Sequence: Synthetic polypeptide
  XENP019128 1G6_H1_L1.167_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIK

SEQ ID NO: 10545 - protein, 122 aa, Artificial Sequence; identical to SEQ ID NO: 6246
  Description of Artificial Sequence: Synthetic polypeptide
  VH of XENP019128

SEQ ID NO: 10546 - protein, 107 aa, Artificial Sequence
  Description of Artificial Sequence: Synthetic polypeptide
  VL of XENP019128
SIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIK

SEQ ID NO: 10547 - protein, 5 aa, Artificial Sequence
  Description of Artificial Sequence: Synthetic peptide
  XENP019128 vhCDR1
NYWMN

SEQ ID NO: 10548 - protein, 19 aa, Artificial Sequence
  Description of Artificial Sequence: Synthetic peptide
  XENP019128 vhCDR2
EIRLKSNNYATHYAEPVKG

SEQ ID NO: 10549 - protein, 11 aa, Artificial Sequence
  Description of Artificial Sequence: Synthetic peptide
  XENP019128 vhCDR3
YYGNYGGYFDV

SEQ ID NO: 10550 - protein, 11 aa, Artificial Sequence
  Description of Artificial Sequence: Synthetic peptide
  XENP019128 vlCDR1
RASQSVSNDVA

SEQ ID NO: 10551 - protein, 7 aa, Artificial Sequence
  Description of Artificial Sequence: Synthetic peptide
  XENP019128 vlCDR2
YASHRYT

SEQ ID NO: 10552 - protein, 9 aa, Artificial Sequence
  Description of Artificial Sequence: Synthetic peptide
  XENP019128 vlCDR3
QQDYSSPRT

SEQ ID NO: 10553 - protein, 249 aa, Artificial Sequence
  Description of Artificial Sequence: Synthetic polypeptide
  XENP019129 1G6_H1_L1.168_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIK

SEQ ID NO: 10554 - protein, 122 aa, Artificial Sequence; identical to SEQ ID NO: 6246
  Description of Artificial Sequence: Synthetic polypeptide
  VH of XENP019129

SEQ ID NO: 10555 - protein, 107 aa, Artificial Sequence
  Description of Artificial Sequence: Synthetic polypeptide
  VL of XENP019129
SIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIK

SEQ ID NO: 10556 - protein, 5 aa, Artificial Sequence
  Description of Artificial Sequence: Synthetic peptide
  XENP019129 vhCDR1
NYWMN

SEQ ID NO: 10557 - protein, 19 aa, Artificial Sequence
  Description of Artificial Sequence: Synthetic peptide
  XENP019129 vhCDR2
EIRLKSNNYATHYAEPVKG

SEQ ID NO: 10558 - protein, 11 aa, Artificial Sequence
  Description of Artificial Sequence: Synthetic peptide
  XENP019129 vhCDR3
YYGNYGGYFDV

SEQ ID NO: 10559 - protein, 11 aa, Artificial Sequence
  Description of Artificial Sequence: Synthetic peptide
  XENP019129 vlCDR1
RASQSVSNDVA

SEQ ID NO: 10560 - protein, 7 aa, Artificial Sequence
  Description of Artificial Sequence: Synthetic peptide
  XENP019129 vlCDR2
YASWRYT

SEQ ID NO: 10561 - protein, 9 aa, Artificial Sequence
  Description of Artificial Sequence: Synthetic peptide
  XENP019129 vlCDR3
QQDFSSPRT

SEQ ID NO: 10562 - protein, 249 aa, Artificial Sequence
  Description of Artificial Sequence: Synthetic polypeptide
  XENP019130 1G6_H1_L1.169_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIK

SEQ ID NO: 10563 - protein, 122 aa, Artificial Sequence; identical to SEQ ID NO: 6246
  Description of Artificial Sequence: Synthetic polypeptide
  VH of XENP019130

SEQ ID NO: 10564 - protein, 107 aa, Artificial Sequence
  Description of Artificial Sequence: Synthetic polypeptide
  VL of XENP019130
SIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIK

SEQ ID NO: 10565 - protein, 5 aa, Artificial Sequence
  Description of Artificial Sequence: Synthetic peptide
  XENP019130 vhCDR1
NYWMN

SEQ ID NO: 10566 - protein, 19 aa, Artificial Sequence
  Description of Artificial Sequence: Synthetic peptide
  XENP019130 vhCDR2
EIRLKSNNYATHYAEPVKG

SEQ ID NO: 10567 - protein, 11 aa, Artificial Sequence
  Description of Artificial Sequence: Synthetic peptide
  XENP019130 vhCDR3
YYGNYGGYFDV

SEQ ID NO: 10568 - protein, 11 aa, Artificial Sequence
  Description of Artificial Sequence: Synthetic peptide
  XENP019130 vlCDR1
RASQSVSNDVA

SEQ ID NO: 10569 - protein, 7 aa, Artificial Sequence
  Description of Artificial Sequence: Synthetic peptide
  XENP019130 vlCDR2
YASWRYT

SEQ ID NO: 10570 - protein, 9 aa, Artificial Sequence
  Description of Artificial Sequence: Synthetic peptide
  XENP019130 vlCDR3
QQDWSSPRT

SEQ ID NO: 10571 - protein, 249 aa, Artificial Sequence
  Description of Artificial Sequence: Synthetic polypeptide
  XENP019131 1G6_H1_L1.170_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIK

SEQ ID NO: 10572 - protein, 122 aa, Artificial Sequence; identical to SEQ ID NO: 6246
  Description of Artificial Sequence: Synthetic polypeptide
  VH of XENP019131

SEQ ID NO: 10573 - protein, 107 aa, Artificial Sequence
  Description of Artificial Sequence: Synthetic polypeptide
  VL of XENP019131
SIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIK

SEQ ID NO: 10574 - protein, 5 aa, Artificial Sequence
  Description of Artificial Sequence: Synthetic peptide
  XENP019131 vhCDR1
NYWMN

SEQ ID NO: 10575 - protein, 19 aa, Artificial Sequence
  Description of Artificial Sequence: Synthetic peptide
  XENP019131 vhCDR2
EIRLKSNNYATHYAEPVKG

SEQ ID NO: 10576 - protein, 11 aa, Artificial Sequence
  Description of Artificial Sequence: Synthetic peptide
  XENP019131 vhCDR3
YYGNYGGYFDV

SEQ ID NO: 10577 - protein, 11 aa, Artificial Sequence
  Description of Artificial Sequence: Synthetic peptide
  XENP019131 vlCDR1
RASQSVSNDVA

SEQ ID NO: 10578 - protein, 7 aa, Artificial Sequence
  Description of Artificial Sequence: Synthetic peptide
  XENP019131 vlCDR2
YASWRYT

SEQ ID NO: 10579 - protein, 9 aa, Artificial Sequence
  Description of Artificial Sequence: Synthetic peptide
  XENP019131 vlCDR3
QQDGSSPRT

SEQ ID NO: 10580 - protein, 249 aa, Artificial Sequence
  Description of Artificial Sequence: Synthetic polypeptide
  XENP019132 1G6_H1_L1.171_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIK

SEQ ID NO: 10581 - protein, 122 aa, Artificial Sequence; identical to SEQ ID NO: 6246
  Description of Artificial Sequence: Synthetic polypeptide
  VH of XENP019132

SEQ ID NO: 10582 - protein, 107 aa, Artificial Sequence
  Description of Artificial Sequence: Synthetic polypeptide
  VL of XENP019132
SIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIK

SEQ ID NO: 10583 - protein, 5 aa, Artificial Sequence
  Description of Artificial Sequence: Synthetic peptide
  XENP019132 vhCDR1
NYWMN

SEQ ID NO: 10584 - protein, 19 aa, Artificial Sequence
  Description of Artificial Sequence: Synthetic peptide
  XENP019132 vhCDR2
EIRLKSNNYATHYAEPVKG

SEQ ID NO: 10585 - protein, 11 aa, Artificial Sequence
  Description of Artificial Sequence: Synthetic peptide
  XENP019132 vhCDR3
YYGNYGGYFDV

SEQ ID NO: 10586 - protein, 11 aa, Artificial Sequence
  Description of Artificial Sequence: Synthetic peptide
  XENP019132 vlCDR1
RASQSVSNDVA

SEQ ID NO: 10587 - protein, 7 aa, Artificial Sequence
  Description of Artificial Sequence: Synthetic peptide
  XENP019132 vlCDR2
YASHRYT

SEQ ID NO: 10588 - protein, 9 aa, Artificial Sequence
  Description of Artificial Sequence: Synthetic peptide
  XENP019132 vlCDR3
QQDWSSPRT

SEQ ID NO: 10589 - protein, 249 aa, Artificial Sequence
  Description of Artificial Sequence: Synthetic polypeptide
  XENP019133 1G6_H1_L1.172_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIK

SEQ ID NO: 10590 - protein, 122 aa, Artificial Sequence; identical to SEQ ID NO: 6246
  Description of Artificial Sequence: Synthetic polypeptide
  VH of XENP019133

SEQ ID NO: 10591 - protein, 107 aa, Artificial Sequence
  Description of Artificial Sequence: Synthetic polypeptide
  VL of XENP019133
SIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIK

SEQ ID NO: 10592 - protein, 5 aa, Artificial Sequence
  Description of Artificial Sequence: Synthetic peptide
  XENP019133 vhCDR1
NYWMN

SEQ ID NO: 10593 - protein, 19 aa, Artificial Sequence
  Description of Artificial Sequence: Synthetic peptide
  XENP019133 vhCDR2
EIRLKSNNYATHYAEPVKG

SEQ ID NO: 10594 - protein, 11 aa, Artificial Sequence
  Description of Artificial Sequence: Synthetic peptide
  XENP019133 vhCDR3
YYGNYGGYFDV

SEQ ID NO: 10595 - protein, 11 aa, Artificial Sequence
  Description of Artificial Sequence: Synthetic peptide
  XENP019133 vlCDR1
RASQSVSNDVA

SEQ ID NO: 10596 - protein, 7 aa, Artificial Sequence
  Description of Artificial Sequence: Synthetic peptide
  XENP019133 vlCDR2
YASHRYT

SEQ ID NO: 10597 - protein, 9 aa, Artificial Sequence
  Description of Artificial Sequence: Synthetic peptide
  XENP019133 vlCDR3
QQDFSSPRT

SEQ ID NO: 10598 - protein, 249 aa, Artificial Sequence
  Description of Artificial Sequence: Synthetic polypeptide
  XENP019134 1G6_H1_L1.173_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIK

SEQ ID NO: 10599 - protein, 122 aa, Artificial Sequence; identical to SEQ ID NO: 6246
  Description of Artificial Sequence: Synthetic polypeptide
  VH of XENP019134

SEQ ID NO: 10600 - protein, 107 aa, Artificial Sequence
  Description of Artificial Sequence: Synthetic polypeptide
  VL of XENP019134
SIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIK

SEQ ID NO: 10601 - protein, 5 aa, Artificial Sequence
  Description of Artificial Sequence: Synthetic peptide
  XENP019134 vhCDR1
NYWMN

SEQ ID NO: 10602 - protein, 19 aa, Artificial Sequence
  Description of Artificial Sequence: Synthetic peptide
  XENP019134 vhCDR2
EIRLKSNNYATHYAEPVKG

SEQ ID NO: 10603 - protein, 11 aa, Artificial Sequence
  Description of Artificial Sequence: Synthetic peptide
  XENP019134 vhCDR3
YYGNYGGYFDV

SEQ ID NO: 10604 - protein, 11 aa, Artificial Sequence
  Description of Artificial Sequence: Synthetic peptide
  XENP019134 vlCDR1
RASQSVSNDVA

SEQ ID NO: 10605 - protein, 7 aa, Artificial Sequence
  Description of Artificial Sequence: Synthetic peptide
  XENP019134 vlCDR2
YASHRYT

SEQ ID NO: 10606 - protein, 9 aa, Artificial Sequence
  Description of Artificial Sequence: Synthetic peptide
  XENP019134 vlCDR3
QQDFGSPRT

SEQ ID NO: 10607 - protein, 249 aa, Artificial Sequence
  Description of Artificial Sequence: Synthetic polypeptide
  XENP019135 1G6_H1_L1.174_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIK

SEQ ID NO: 10608 - protein, 122 aa, Artificial Sequence; identical to SEQ ID NO: 6246
  Description of Artificial Sequence: Synthetic polypeptide
  VH of XENP019135

SEQ ID NO: 10609 - protein, 107 aa, Artificial Sequence
  Description of Artificial Sequence: Synthetic polypeptide
  VL of XENP019135
SIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIK

SEQ ID NO: 10610 - protein, 5 aa, Artificial Sequence
  Description of Artificial Sequence: Synthetic peptide
  XENP019135 vhCDR1
NYWMN

SEQ ID NO: 10611 - protein, 19 aa, Artificial Sequence
  Description of Artificial Sequence: Synthetic peptide
  XENP019135 vhCDR2
EIRLKSNNYATHYAEPVKG

SEQ ID NO: 10612 - protein, 11 aa, Artificial Sequence
  Description of Artificial Sequence: Synthetic peptide
  XENP019135 vhCDR3
YYGNYGGYFDV

SEQ ID NO: 10613 - protein, 11 aa, Artificial Sequence
  Description of Artificial Sequence: Synthetic peptide
  XENP019135 vlCDR1
RASQSVSNDVA

SEQ ID NO: 10614 - protein, 7 aa, Artificial Sequence
  Description of Artificial Sequence: Synthetic peptide
  XENP019135 vlCDR2
YASHRYT

SEQ ID NO: 10615 - protein, 9 aa, Artificial Sequence
  Description of Artificial Sequence: Synthetic peptide
  XENP019135 vlCDR3
QQDWGSPRT

SEQ ID NO: 10616 - protein, 249 aa, Artificial Sequence
  Description of Artificial Sequence: Synthetic polypeptide
  XENP019136 1G6_H1_L1.175_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIK

SEQ ID NO: 10617 - protein, 122 aa, Artificial Sequence; identical to SEQ ID NO: 6246
  Description of Artificial Sequence: Synthetic polypeptide
  VH of XENP019136

SEQ ID NO: 10618 - protein, 107 aa, Artificial Sequence
  Description of Artificial Sequence: Synthetic polypeptide
  VL of XENP019136
SIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIK

SEQ ID NO: 10619 - protein, 5 aa, Artificial Sequence
  Description of Artificial Sequence: Synthetic peptide
  XENP019136 vhCDR1
NYWMN

SEQ ID NO: 10620 - protein, 19 aa, Artificial Sequence
  Description of Artificial Sequence: Synthetic peptide
  XENP019136 vhCDR2
EIRLKSNNYATHYAEPVKG

SEQ ID NO: 10621 - protein, 11 aa, Artificial Sequence
  Description of Artificial Sequence: Synthetic peptide
  XENP019136 vhCDR3
YYGNYGGYFDV

SEQ ID NO: 10622 - protein, 11 aa, Artificial Sequence
  Description of Artificial Sequence: Synthetic peptide
  XENP019136 vlCDR1
RASQSVGNDVA

SEQ ID NO: 10623 - protein, 7 aa, Artificial Sequence
  Description of Artificial Sequence: Synthetic peptide
  XENP019136 vlCDR2
YASHRYT

SEQ ID NO: 10624 - protein, 9 aa, Artificial Sequence
  Description of Artificial Sequence: Synthetic peptide
  XENP019136 vlCDR3
QQDWSSPRT

SEQ ID NO: 10625 - protein, 249 aa, Artificial Sequence
  Description of Artificial Sequence: Synthetic polypeptide
  XENP019137 1G6_H1_L1.176_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIK

SEQ ID NO: 10626 - protein, 122 aa, Artificial Sequence; identical to SEQ ID NO: 6246
  Description of Artificial Sequence: Synthetic polypeptide
  VH of XENP019137

SEQ ID NO: 10627 - protein, 107 aa, Artificial Sequence
  Description of Artificial Sequence: Synthetic polypeptide
  VL of XENP019137
SIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIK

SEQ ID NO: 10628 - protein, 5 aa, Artificial Sequence
  Description of Artificial Sequence: Synthetic peptide
  XENP019137 vhCDR1
NYWMN

SEQ ID NO: 10629 - protein, 19 aa, Artificial Sequence
  Description of Artificial Sequence: Synthetic peptide
  XENP019137 vhCDR2
EIRLKSNNYATHYAEPVKG

SEQ ID NO: 10630 - protein, 11 aa, Artificial Sequence
  Description of Artificial Sequence: Synthetic peptide
  XENP019137 vhCDR3
YYGNYGGYFDV

SEQ ID NO: 10631 - protein, 11 aa, Artificial Sequence
  Description of Artificial Sequence: Synthetic peptide
  XENP019137 vlCDR1
RASQSVGNDVA

SEQ ID NO: 10632 - protein, 7 aa, Artificial Sequence
  Description of Artificial Sequence: Synthetic peptide
  XENP019137 vlCDR2
YASWRYT

SEQ ID NO: 10633 - protein, 9 aa, Artificial Sequence
  Description of Artificial Sequence: Synthetic peptide
  XENP019137 vlCDR3
QQDYSSPRT

SEQ ID NO: 10634 - protein, 249 aa, Artificial Sequence
  Description of Artificial Sequence: Synthetic polypeptide
  XENP019138 1G6_H1_L1.177_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIK

SEQ ID NO: 10635 - protein, 122 aa, Artificial Sequence; identical to SEQ ID NO: 6246
  Description of Artificial Sequence: Synthetic polypeptide
  VH of XENP019138

SEQ ID NO: 10636 - protein, 107 aa, Artificial Sequence
  Description of Artificial Sequence: Synthetic polypeptide
  VL of XENP019138
SIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIK

SEQ ID NO: 10637 - protein, 5 aa, Artificial Sequence
  Description of Artificial Sequence: Synthetic peptide
  XENP019138 vhCDR1
NYWMN

SEQ ID NO: 10638 - protein, 19 aa, Artificial Sequence
  Description of Artificial Sequence: Synthetic peptide
  XENP019138 vhCDR2
EIRLKSNNYATHYAEPVKG

SEQ ID NO: 10639 - protein, 11 aa, Artificial Sequence
  Description of Artificial Sequence: Synthetic peptide
  XENP019138 vhCDR3
YYGNYGGYFDV

SEQ ID NO: 10640 - protein, 11 aa, Artificial Sequence
  Description of Artificial Sequence: Synthetic peptide
  XENP019138 vlCDR1
RASQSVGNDVA

SEQ ID NO: 10641 - protein, 7 aa, Artificial Sequence
  Description of Artificial Sequence: Synthetic peptide
  XENP019138 vlCDR2
YASHRYT

SEQ ID NO: 10642 - protein, 9 aa, Artificial Sequence
  Description of Artificial Sequence: Synthetic peptide
  XENP019138 vlCDR3
QQDFSSPRT

SEQ ID NO: 10643 - protein, 249 aa, Artificial Sequence
  Description of Artificial Sequence: Synthetic polypeptide
  XENP019139 1G6_H1_L1.178_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIK

SEQ ID NO: 10644 - protein, 122 aa, Artificial Sequence; identical to SEQ ID NO: 6246
  Description of Artificial Sequence: Synthetic polypeptide
  VH of XENP019139

SEQ ID NO: 10645 - protein, 107 aa, Artificial Sequence
  Description of Artificial Sequence: Synthetic polypeptide
  VL of XENP019139
SIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIK

SEQ ID NO: 10646 - protein, 5 aa, Artificial Sequence
  Description of Artificial Sequence: Synthetic peptide
  XENP019139 vhCDR1
NYWMN

SEQ ID NO: 10647 - protein, 19 aa, Artificial Sequence
  Description of Artificial Sequence: Synthetic peptide
  XENP019139 vhCDR2
EIRLKSNNYATHYAEPVKG

SEQ ID NO: 10648 - protein, 11 aa, Artificial Sequence
  Description of Artificial Sequence: Synthetic peptide
  XENP019139 vhCDR3
YYGNYGGYFDV

SEQ ID NO: 10649 - protein, 11 aa, Artificial Sequence
  Description of Artificial Sequence: Synthetic peptide
  XENP019139 vlCDR1
RASQSVGNDVA

SEQ ID NO: 10650 - protein, 7 aa, Artificial Sequence
  Description of Artificial Sequence: Synthetic peptide
  XENP019139 vlCDR2
YASHRYT

SEQ ID NO: 10651 - protein, 9 aa, Artificial Sequence
  Description of Artificial Sequence: Synthetic peptide
  XENP019139 vlCDR3
QQDGSSPRT

SEQ ID NO: 10652 - protein, 249 aa, Artificial Sequence
  Description of Artificial Sequence: Synthetic polypeptide
  XENP019140 1G6_H1_L1.179_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIK

SEQ ID NO: 10653 - protein, 122 aa, Artificial Sequence; identical to SEQ ID NO: 6246
  Description of Artificial Sequence: Synthetic polypeptide
  VH of XENP019140

SEQ ID NO: 10654 - protein, 107 aa, Artificial Sequence
  Description of Artificial Sequence: Synthetic polypeptide
  VL of XENP019140
SIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIK

SEQ ID NO: 10655 - protein, 5 aa, Artificial Sequence
  Description of Artificial Sequence: Synthetic peptide
  XENP019140 vhCDR1
NYWMN

SEQ ID NO: 10656 - protein, 19 aa, Artificial Sequence
  Description of Artificial Sequence: Synthetic peptide
  XENP019140 vhCDR2
EIRLKSNNYATHYAEPVKG

SEQ ID NO: 10657 - protein, 11 aa, Artificial Sequence
  Description of Artificial Sequence: Synthetic peptide
  XENP019140 vhCDR3
YYGNYGGYFDV

SEQ ID NO: 10658 - protein, 11 aa, Artificial Sequence
  Description of Artificial Sequence: Synthetic peptide
  XENP019140 vlCDR1
RASQSVSNDVA

SEQ ID NO: 10659 - protein, 7 aa, Artificial Sequence
  Description of Artificial Sequence: Synthetic peptide
  XENP019140 vlCDR2
YASWRYT

SEQ ID NO: 10660 - protein, 9 aa, Artificial Sequence
  Description of Artificial Sequence: Synthetic peptide
  XENP019140 vlCDR3
QQDFSSPRT

SEQ ID NO: 10661 - protein, 249 aa, Artificial Sequence
  Description of Artificial Sequence: Synthetic polypeptide
  XENP019141 1G6_H1_L1.180_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIK

SEQ ID NO: 10662 - protein, 122 aa, Artificial Sequence; identical to SEQ ID NO: 6246
  Description of Artificial Sequence: Synthetic polypeptide
  VH of XENP019141

SEQ ID NO: 10663 - protein, 107 aa, Artificial Sequence
  Description of Artificial Sequence: Synthetic polypeptide
  VL of XENP019141
SIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIK

SEQ ID NO: 10664 - protein, 5 aa, Artificial Sequence
  Description of Artificial Sequence: Synthetic peptide
  XENP019141 vhCDR1
NYWMN

SEQ ID NO: 10665 - protein, 19 aa, Artificial Sequence
  Description of Artificial Sequence: Synthetic peptide
  XENP019141 vhCDR2
EIRLKSNNYATHYAEPVKG

SEQ ID NO: 10666 - protein, 11 aa, Artificial Sequence
  Description of Artificial Sequence: Synthetic peptide
  XENP019141 vhCDR3
YYGNYGGYFDV

SEQ ID NO: 10667 - protein, 11 aa, Artificial Sequence
  Description of Artificial Sequence: Synthetic peptide
  XENP019141 vlCDR1
RASQSVSNDVA

SEQ ID NO: 10668 - protein, 7 aa, Artificial Sequence
  Description of Artificial Sequence: Synthetic peptide
  XENP019141 vlCDR2
YASWRYT

SEQ ID NO: 10669 - protein, 9 aa, Artificial Sequence
  Description of Artificial Sequence: Synthetic peptide
  XENP019141 vlCDR3
QQDWSSPRT

SEQ ID NO: 10670 - protein, 249 aa, Artificial Sequence
  Description of Artificial Sequence: Synthetic polypeptide
  XENP019142 1G6_H1_L1.181_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIK

SEQ ID NO: 10671 - protein, 122 aa, Artificial Sequence; identical to SEQ ID NO: 6246
  Description of Artificial Sequence: Synthetic polypeptide
  VH of XENP019142

SEQ ID NO: 10672 - protein, 107 aa, Artificial Sequence
  Description of Artificial Sequence: Synthetic polypeptide
  VL of XENP019142
SIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIK

SEQ ID NO: 10673 - protein, 5 aa, Artificial Sequence
  Description of Artificial Sequence: Synthetic peptide
  XENP019142 vhCDR1
NYWMN

SEQ ID NO: 10674 - protein, 19 aa, Artificial Sequence
  Description of Artificial Sequence: Synthetic peptide
  XENP019142 vhCDR2
EIRLKSNNYATHYAEPVKG

SEQ ID NO: 10675 - protein, 11 aa, Artificial Sequence
  Description of Artificial Sequence: Synthetic peptide
  XENP019142 vhCDR3
YYGNYGGYFDV

SEQ ID NO: 10676 - protein, 11 aa, Artificial Sequence
  Description of Artificial Sequence: Synthetic peptide
  XENP019142 vlCDR1
RASQSVSNDVA

SEQ ID NO: 10677 - protein, 7 aa, Artificial Sequence
  Description of Artificial Sequence: Synthetic peptide
  XENP019142 vlCDR2
YASWRYT

SEQ ID NO: 10678 - protein, 9 aa, Artificial Sequence
  Description of Artificial Sequence: Synthetic peptide
  XENP019142 vlCDR3
QQDGSSPRT

SEQ ID NO: 10679 - protein, 249 aa, Artificial Sequence
  Description of Artificial Sequence: Synthetic polypeptide
  XENP019143 1G6_H1_L1.182_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIK

SEQ ID NO: 10680 - protein, 122 aa, Artificial Sequence; identical to SEQ ID NO: 6246
  Description of Artificial Sequence: Synthetic polypeptide
  VH of XENP019143

SEQ ID NO: 10681 - protein, 107 aa, Artificial Sequence
  Description of Artificial Sequence: Synthetic polypeptide
  VL of XENP019143
SIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIK

SEQ ID NO: 10682 - protein, 5 aa, Artificial Sequence
  Description of Artificial Sequence: Synthetic peptide
  XENP019143 vhCDR1
NYWMN

SEQ ID NO: 10683 - protein, 19 aa, Artificial Sequence
  Description of Artificial Sequence: Synthetic peptide
  XENP019143 vhCDR2
EIRLKSNNYATHYAEPVKG

SEQ ID NO: 10684 - protein, 11 aa, Artificial Sequence
  Description of Artificial Sequence: Synthetic peptide
  XENP019143 vhCDR3
YYGNYGGYFDV

SEQ ID NO: 10685 - protein, 11 aa, Artificial Sequence
  Description of Artificial Sequence: Synthetic peptide
  XENP019143 vlCDR1
RASQSVGNDVA

SEQ ID NO: 10686 - protein, 7 aa, Artificial Sequence
  Description of Artificial Sequence: Synthetic peptide
  XENP019143 vlCDR2
YASWRYT

SEQ ID NO: 10687 - protein, 9 aa, Artificial Sequence
  Description of Artificial Sequence: Synthetic peptide
  XENP019143 vlCDR3
QQDWSSPRT

SEQ ID NO: 10688 - protein, 249 aa, Artificial Sequence
  Description of Artificial Sequence: Synthetic polypeptide
  XENP019144 1G6_H1_L1.183_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIK

SEQ ID NO: 10689 - protein, 122 aa, Artificial Sequence; identical to SEQ ID NO: 6246
  Description of Artificial Sequence: Synthetic polypeptide
  VH of XENP019144

SEQ ID NO: 10690 - protein, 107 aa, Artificial Sequence
  Description of Artificial Sequence: Synthetic polypeptide
  VL of XENP019144
SIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIK

SEQ ID NO: 10691 - protein, 5 aa, Artificial Sequence
  Description of Artificial Sequence: Synthetic peptide
  XENP019144 vhCDR1
NYWMN

SEQ ID NO: 10692 - protein, 19 aa, Artificial Sequence
  Description of Artificial Sequence: Synthetic peptide
  XENP019144 vhCDR2
EIRLKSNNYATHYAEPVKG

SEQ ID NO: 10693 - protein, 11 aa, Artificial Sequence
  Description of Artificial Sequence: Synthetic peptide
  XENP019144 vhCDR3
YYGNYGGYFDV

SEQ ID NO: 10694 - protein, 11 aa, Artificial Sequence
  Description of Artificial Sequence: Synthetic peptide
  XENP019144 vlCDR1
RASQSVGNDVA

SEQ ID NO: 10695 - protein, 7 aa, Artificial Sequence
  Description of Artificial Sequence: Synthetic peptide
  XENP019144 vlCDR2
YASWRYT

SEQ ID NO: 10696 - protein, 9 aa, Artificial Sequence
  Description of Artificial Sequence: Synthetic peptide
  XENP019144 vlCDR3
QQDFSSPRT

SEQ ID NO: 10697 - protein, 249 aa, Artificial Sequence
  Description of Artificial Sequence: Synthetic polypeptide
  XENP019145 1G6_H1_L1.184_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIK

SEQ ID NO: 10698 - protein, 122 aa, Artificial Sequence; identical to SEQ ID NO: 6246
  Description of Artificial Sequence: Synthetic polypeptide
  VH of XENP019145

SEQ ID NO: 10699 - protein, 107 aa, Artificial Sequence
  Description of Artificial Sequence: Synthetic polypeptide
  VL of XENP019145
SIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIK

SEQ ID NO: 10700 - protein, 5 aa, Artificial Sequence
  Description of Artificial Sequence: Synthetic peptide
  XENP019145 vhCDR1
NYWMN

SEQ ID NO: 10701 - protein, 19 aa, Artificial Sequence
  Description of Artificial Sequence: Synthetic peptide
  XENP019145 vhCDR2
EIRLKSNNYATHYAEPVKG

SEQ ID NO: 10702 - protein, 11 aa, Artificial Sequence
  Description of Artificial Sequence: Synthetic peptide
  XENP019145 vhCDR3
YYGNYGGYFDV

SEQ ID NO: 10703 - protein, 11 aa, Artificial Sequence
  Description of Artificial Sequence: Synthetic peptide
  XENP019145 vlCDR1
RASQSVGNDVA

SEQ ID NO: 10704 - protein, 7 aa, Artificial Sequence
  Description of Artificial Sequence: Synthetic peptide
  XENP019145 vlCDR2
YASWRYT

SEQ ID NO: 10705 - protein, 9 aa, Artificial Sequence
  Description of Artificial Sequence: Synthetic peptide
  XENP019145 vlCDR3
QQDGSSPRT

SEQ ID NO: 10706 - protein, 249 aa, Artificial Sequence
  Description of Artificial Sequence: Synthetic polypeptide
  XENP019146 1G6_H1_L1.185_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIK

SEQ ID NO: 10707 - protein, 122 aa, Artificial Sequence; identical to SEQ ID NO: 6246
  Description of Artificial Sequence: Synthetic polypeptide
  VH of XENP019146

SEQ ID NO: 10708 - protein, 107 aa, Artificial Sequence
  Description of Artificial Sequence: Synthetic polypeptide
  VL of XENP019146
EIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIK

SEQ ID NO: 10709 - protein, 5 aa, Artificial Sequence
  Description of Artificial Sequence: Synthetic peptide
  XENP019146 vhCDR1
NYWMN

SEQ ID NO: 10710 - protein, 19 aa, Artificial Sequence
  Description of Artificial Sequence: Synthetic peptide
  XENP019146 vhCDR2
EIRLKSNNYATHYAEPVKG

SEQ ID NO: 10711 - protein, 11 aa, Artificial Sequence
  Description of Artificial Sequence: Synthetic peptide
  XENP019146 vhCDR3
YYGNYGGYFDV

SEQ ID NO: 10712 - protein, 11 aa, Artificial Sequence
  Description of Artificial Sequence: Synthetic peptide
  XENP019146 vlCDR1
RASQSVSNDLA

SEQ ID NO: 10713 - protein, 7 aa, Artificial Sequence
  Description of Artificial Sequence: Synthetic peptide
  XENP019146 vlCDR2
YASHRYT

SEQ ID NO: 10714 - protein, 9 aa, Artificial Sequence
  Description of Artificial Sequence: Synthetic peptide
  XENP019146 vlCDR3
QQDYSSPRT

SEQ ID NO: 10715 - protein, 249 aa, Artificial Sequence
  Description of Artificial Sequence: Synthetic polypeptide
  XENP019147 1G6_H1_L1.186_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSDIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIK

SEQ ID NO: 10716 - protein, 122 aa, Artificial Sequence; identical to SEQ ID NO: 6246
  Description of Artificial Sequence: Synthetic polypeptide
  VH of XENP019147

SEQ ID NO: 10717 - protein, 107 aa, Artificial Sequence
  Description of Artificial Sequence: Synthetic polypeptide
  VL of XENP019147
DIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIK

SEQ ID NO: 10718 - protein, 5 aa, Artificial Sequence
  Description of Artificial Sequence: Synthetic peptide
  XENP019147 vhCDR1
NYWMN

SEQ ID NO: 10719 - protein, 19 aa, Artificial Sequence
  Description of Artificial Sequence: Synthetic peptide
  XENP019147 vhCDR2
EIRLKSNNYATHYAEPVKG

SEQ ID NO: 10720 - protein, 11 aa, Artificial Sequence
  Description of Artificial Sequence: Synthetic peptide
  XENP019147 vhCDR3
YYGNYGGYFDV

SEQ ID NO: 10721 - protein, 11 aa, Artificial Sequence
  Description of Artificial Sequence: Synthetic peptide
  XENP019147 vlCDR1
RASQSVSNDLA

SEQ ID NO: 10722 - protein, 7 aa, Artificial Sequence
  Description of Artificial Sequence: Synthetic peptide
  XENP019147 vlCDR2
YASHRYT

SEQ ID NO: 10723 - protein, 9 aa, Artificial Sequence
  Description of Artificial Sequence: Synthetic peptide
  XENP019147 vlCDR3
QQDYSSPRT

SEQ ID NO: 10724 - protein, 249 aa, Artificial Sequence
  Description of Artificial Sequence: Synthetic polypeptide
  XENP019148 1G6_H1.257_L1.152_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10725 - protein, 122 aa, Artificial Sequence; identical to SEQ ID NO: 10167
  Description of Artificial Sequence: Synthetic polypeptide
  VH of XENP019148

SEQ ID NO: 10726 - protein, 107 aa, Artificial Sequence; identical to SEQ ID NO: 10411
  Description of Artificial Sequence: Synthetic polypeptide
  VL of XENP019148

SEQ ID NO: 10727 - protein, 5 aa, Artificial Sequence
  Description of Artificial Sequence: Synthetic peptide
  XENP019148 vhCDR1
NYWMN

SEQ ID NO: 10728 - protein, 19 aa, Artificial Sequence
  Description of Artificial Sequence: Synthetic peptide
  XENP019148 vhCDR2
EIRLKSNNYATHYAEPVKG

SEQ ID NO: 10729 - protein, 11 aa, Artificial Sequence
  Description of Artificial Sequence: Synthetic peptide
  XENP019148 vhCDR3
YYGNYGGYFDV

SEQ ID NO: 10730 - protein, 11 aa, Artificial Sequence
  Description of Artificial Sequence: Synthetic peptide
  XENP019148 vlCDR1
RASQSVSNDVA

SEQ ID NO: 10731 - protein, 7 aa, Artificial Sequence
  Description of Artificial Sequence: Synthetic peptide
  XENP019148 vlCDR2
YASHRYT

SEQ ID NO: 10732 - protein, 9 aa, Artificial Sequence
  Description of Artificial Sequence: Synthetic peptide
  XENP019148 vlCDR3
QQDYSSPRT

SEQ ID NO: 10733 - protein, 249 aa, Artificial Sequence
  Description of Artificial Sequence: Synthetic polypeptide
  XENP019149 1G6_H1.257_L1.151_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10734 - protein, 122 aa, Artificial Sequence; identical to SEQ ID NO: 10167
  Description of Artificial Sequence: Synthetic polypeptide
  VH of XENP019149

SEQ ID NO: 10735 - protein, 107 aa, Artificial Sequence; identical to SEQ ID NO: 10402
  Description of Artificial Sequence: Synthetic polypeptide
  VL of XENP019149

SEQ ID NO: 10736 - protein, 5 aa, Artificial Sequence
  Description of Artificial Sequence: Synthetic peptide
  XENP019149 vhCDR1
NYWMN

SEQ ID NO: 10737 - protein, 19 aa, Artificial Sequence
  Description of Artificial Sequence: Synthetic peptide
  XENP019149 vhCDR2
EIRLKSNNYATHYAEPVKG

SEQ ID NO: 10738 - protein, 11 aa, Artificial Sequence
  Description of Artificial Sequence: Synthetic peptide
  XENP019149 vhCDR3
YYGNYGGYFDV

SEQ ID NO: 10739 - protein, 11 aa, Artificial Sequence
  Description of Artificial Sequence: Synthetic peptide
  XENP019149 vlCDR1
RASQSVSNDVA

SEQ ID NO: 10740 - protein, 7 aa, Artificial Sequence
  Description of Artificial Sequence: Synthetic peptide
  XENP019149 vlCDR2
YASHRYT

SEQ ID NO: 10741 - protein, 9 aa, Artificial Sequence
  Description of Artificial Sequence: Synthetic peptide
  XENP019149 vlCDR3
QQDYSSPRT

SEQ ID NO: 10742 - protein, 249 aa, Artificial Sequence
  Description of Artificial Sequence: Synthetic polypeptide
  XENP019150 1G6_H1.139_L1.134_scFv(GKPGS)4
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 10743 - protein, 122 aa, Artificial Sequence; identical to SEQ ID NO: 7602
  Description of Artificial Sequence: Synthetic polypeptide
  VH of XENP019150

SEQ ID NO: 10744 - protein, 107 aa, Artificial Sequence; identical to SEQ ID NO: 9700
  Description of Artificial Sequence: Synthetic polypeptide
  VL of XENP019150

SEQ ID NO: 10745 - protein, 5 aa, Artificial Sequence
  Description of Artificial Sequence: Synthetic peptide
  XENP019150 vhCDR1
NYWMN

SEQ ID NO: 10746 - protein, 19 aa, Artificial Sequence
  Description of Artificial Sequence: Synthetic peptide
  XENP019150 vhCDR2
EIRLKSNNYATDYAEPVKG

SEQ ID NO: 10747 - protein, 11 aa, Artificial Sequence
  Description of Artificial Sequence: Synthetic peptide
  XENP019150 vhCDR3
YYGNYGGYFDV

SEQ ID NO: 10748 - protein, 11 aa, Artificial Sequence
  Description of Artificial Sequence: Synthetic peptide
  XENP019150 vlCDR1
RASQSVSNDVA

SEQ ID NO: 10749 - protein, 7 aa, Artificial Sequence
  Description of Artificial Sequence: Synthetic peptide
  XENP019150 vlCDR2
YASHRYT

SEQ ID NO: 10750 - protein, 9 aa, Artificial Sequence
  Description of Artificial Sequence: Synthetic peptide
  XENP019150 vlCDR3
QQDYKSPRT

SEQ ID NO: 10751 - protein, 249 aa, Artificial Sequence
  Description of Artificial Sequence: Synthetic polypeptide
  XENP019151 1G6_H1.48_L1.187_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIK

SEQ ID NO: 10752 - protein, 122 aa, Artificial Sequence; identical to SEQ ID NO: 6786
  Description of Artificial Sequence: Synthetic polypeptide
  VH of XENP019151

SEQ ID NO: 10753 - protein, 107 aa, Artificial Sequence; identical to SEQ ID NO: 10411
  Description of Artificial Sequence: Synthetic polypeptide
  VL of XENP019151

SEQ ID NO: 10754 - protein, 11 aa, Artificial Sequence
  Description of Artificial Sequence: Synthetic peptide
  XENP019151 vlCDR1
RASQSVSNDVA

SEQ ID NO: 10755 - protein, 7 aa, Artificial Sequence
  Description of Artificial Sequence: Synthetic peptide
  XENP019151 vlCDR2
YASHRYT

SEQ ID NO: 10756 - protein, 9 aa, Artificial Sequence
  Description of Artificial Sequence: Synthetic peptide
  XENP019151 vlCDR3
QQDYSSPRT

SEQ ID NO: 10757 - protein, 249 aa, Artificial Sequence
  Description of Artificial Sequence: Synthetic polypeptide
  XENP019152 1G6_H1.48_L1.151_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIK

SEQ ID NO: 10758 - protein, 122 aa, Artificial Sequence; identical to SEQ ID NO: 6786
  Description of Artificial Sequence: Synthetic polypeptide
  VH of XENP019152

SEQ ID NO: 10759 - protein, 107 aa, Artificial Sequence; identical to SEQ ID NO: 10402
  Description of Artificial Sequence: Synthetic polypeptide
  VL of XENP019152

SEQ ID NO: 10760 - protein, 11 aa, Artificial Sequence
  Description of Artificial Sequence: Synthetic peptide
  XENP019152 vlCDR1
RASQSVSNDVA

SEQ ID NO: 10761 - protein, 7 aa, Artificial Sequence
  Description of Artificial Sequence: Synthetic peptide
  XENP019152 vlCDR2
YASHRYT

SEQ ID NO: 10762 - protein, 9 aa, Artificial Sequence
  Description of Artificial Sequence: Synthetic peptide
  XENP019152 vlCDR3
QQDYSSPRT

SEQ ID NO: 10763 - protein, 249 aa, Artificial Sequence
  Description of Artificial Sequence: Synthetic polypeptide
  XENP019153 1G6_H1.43_L1.159_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIK

SEQ ID NO: 10764 - protein, 122 aa, Artificial Sequence; identical to SEQ ID NO: 6741
  Description of Artificial Sequence: Synthetic polypeptide
  VH of XENP019153

SEQ ID NO: 10765 - protein, 107 aa, Artificial Sequence; identical to SEQ ID NO: 10474
  Description of Artificial Sequence: Synthetic polypeptide
  VL of XENP019153

SEQ ID NO: 10766 - protein, 5 aa, Artificial Sequence
  Description of Artificial Sequence: Synthetic peptide
  XENP019153 vhCDR1
NYWMD

SEQ ID NO: 10767 - protein, 19 aa, Artificial Sequence
  Description of Artificial Sequence: Synthetic peptide
  XENP019153 vhCDR2
EIRLKSNNYATHYAEPVKG

SEQ ID NO: 10768 - protein, 11 aa, Artificial Sequence
  Description of Artificial Sequence: Synthetic peptide
  XENP019153 vhCDR3
YYGNYGGYFDV

SEQ ID NO: 10769 - protein, 11 aa, Artificial Sequence
  Description of Artificial Sequence: Synthetic peptide
  XENP019153 vlCDR1
RASQSVSNDVA

SEQ ID NO: 10770 - protein, 7 aa, Artificial Sequence
  Description of Artificial Sequence: Synthetic peptide
  XENP019153 vlCDR2
YASHRYT

SEQ ID NO: 10771 - protein, 9 aa, Artificial Sequence
  Description of Artificial Sequence: Synthetic peptide
  XENP019153 vlCDR3
KQDYSSPRT

SEQ ID NO: 10772 - protein, 249 aa, Artificial Sequence
  Description of Artificial Sequence: Synthetic polypeptide
  XENP019154 1G6_H1.90_L1.119_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 10773 - protein, 122 aa, Artificial Sequence; identical to SEQ ID NO: 7161
  Description of Artificial Sequence: Synthetic polypeptide
  VH of XENP019154

SEQ ID NO: 10774 - protein, 107 aa, Artificial Sequence; identical to SEQ ID NO: 9565
  Description of Artificial Sequence: Synthetic polypeptide
  VL of XENP019154

SEQ ID NO: 10775 - protein, 5 aa, Artificial Sequence
  Description of Artificial Sequence: Synthetic peptide
  XENP019154 vhCDR1
NYWMN

SEQ ID NO: 10776 - protein, 19 aa, Artificial Sequence
  Description of Artificial Sequence: Synthetic peptide
  XENP019154 vhCDR2
EIRLYSNNYATHYAEPVKG

SEQ ID NO: 10777 - protein, 11 aa, Artificial Sequence
  Description of Artificial Sequence: Synthetic peptide
  XENP019154 vhCDR3
YYGNYGGYFDV

SEQ ID NO: 10778 - protein, 11 aa, Artificial Sequence
  Description of Artificial Sequence: Synthetic peptide
  XENP019154 vlCDR1
RASQSVSNDVA

SEQ ID NO: 10779 - protein, 7 aa, Artificial Sequence
  Description of Artificial Sequence: Synthetic peptide
  XENP019154 vlCDR2
YASHRYT

SEQ ID NO: 10780 - protein, 9 aa, Artificial Sequence
  Description of Artificial Sequence: Synthetic peptide
  XENP019154 vlCDR3
QQDWSSPRT

SEQ ID NO: 10781 - protein, 249 aa, Artificial Sequence
  Description of Artificial Sequence: Synthetic polypeptide
  XENP019155 1G6_H1.90_L1.23_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 10782 - protein, 122 aa, Artificial Sequence; identical to SEQ ID NO: 7161
  Description of Artificial Sequence: Synthetic polypeptide
  VH of XENP019155

SEQ ID NO: 10783 - protein, 107 aa, Artificial Sequence; identical to SEQ ID NO: 8701
  Description of Artificial Sequence: Synthetic polypeptide
  VL of XENP019155

SEQ ID NO: 10784 - protein, 5 aa, Artificial Sequence
  Description of Artificial Sequence: Synthetic peptide
  XENP019155 vhCDR1
NYWMN

SEQ ID NO: 10785 - protein, 19 aa, Artificial Sequence
  Description of Artificial Sequence: Synthetic peptide
  XENP019155 vhCDR2
EIRLYSNNYATHYAEPVKG

SEQ ID NO: 10786 - protein, 11 aa, Artificial Sequence
  Description of Artificial Sequence: Synthetic peptide
  XENP019155 vhCDR3
YYGNYGGYFDV

SEQ ID NO: 10787 - protein, 11 aa, Artificial Sequence
  Description of Artificial Sequence: Synthetic peptide
  XENP019155 vlCDR1
RASQSVGNDVA

SEQ ID NO: 10788 - protein, 7 aa, Artificial Sequence
  Description of Artificial Sequence: Synthetic peptide
  XENP019155 vlCDR2
YASHRYT

SEQ ID NO: 10789 - protein, 9 aa, Artificial Sequence
  Description of Artificial Sequence: Synthetic peptide
  XENP019155 vlCDR3
QQDYSSPRT

SEQ ID NO: 10790 - protein, 249 aa, Artificial Sequence
  Description of Artificial Sequence: Synthetic polypeptide
  XENP019156 1G6_H1.90_L1.67_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 10791 - protein, 122 aa, Artificial Sequence; identical to SEQ ID NO: 7161
  Description of Artificial Sequence: Synthetic polypeptide
  VH of XENP019156

SEQ ID NO: 10792 - protein, 107 aa, Artificial Sequence; identical to SEQ ID NO: 9097
  Description of Artificial Sequence: Synthetic polypeptide
  VL of XENP019156

SEQ ID NO: 10793 - protein, 5 aa, Artificial Sequence
  Description of Artificial Sequence: Synthetic peptide
  XENP019156 vhCDR1
NYWMN

SEQ ID NO: 10794 - protein, 19 aa, Artificial Sequence
  Description of Artificial Sequence: Synthetic peptide
  XENP019156 vhCDR2
EIRLYSNNYATHYAEPVKG

SEQ ID NO: 10795 - protein, 11 aa, Artificial Sequence
  Description of Artificial Sequence: Synthetic peptide
  XENP019156 vhCDR3
YYGNYGGYFDV

SEQ ID NO: 10796 - protein, 11 aa, Artificial Sequence
  Description of Artificial Sequence: Synthetic peptide
  XENP019156 vlCDR1
RASQSVSNDVA

SEQ ID NO: 10797 - protein, 7 aa, Artificial Sequence
  Description of Artificial Sequence: Synthetic peptide
  XENP019156 vlCDR2
YASWRYT

SEQ ID NO: 10798 - protein, 9 aa, Artificial Sequence
  Description of Artificial Sequence: Synthetic peptide
  XENP019156 vlCDR3
QQDYSSPRT

SEQ ID NO: 10799 - protein, 249 aa, Artificial Sequence
  Description of Artificial Sequence: Synthetic polypeptide
  XENP019157 1G6_H1.90_L1.94_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 10800 - protein, 122 aa, Artificial Sequence; identical to SEQ ID NO: 7161
  Description of Artificial Sequence: Synthetic polypeptide
  VH of XENP019157

SEQ ID NO: 10801 - protein, 107 aa, Artificial Sequence; identical to SEQ ID NO: 9340
  Description of Artificial Sequence: Synthetic polypeptide
  VL of XENP019157

SEQ ID NO: 10802 - protein, 5 aa, Artificial Sequence
  Description of Artificial Sequence: Synthetic peptide
  XENP019157 vhCDR1
NYWMN

SEQ ID NO: 10803 - protein, 19 aa, Artificial Sequence
  Description of Artificial Sequence: Synthetic peptide
  XENP019157 vhCDR2
EIRLYSNNYATHYAEPVKG

SEQ ID NO: 10804 - protein, 11 aa, Artificial Sequence
  Description of Artificial Sequence: Synthetic peptide
  XENP019157 vhCDR3
YYGNYGGYFDV

SEQ ID NO: 10805 - protein, 11 aa, Artificial Sequence
  Description of Artificial Sequence: Synthetic peptide
  XENP019157 vlCDR1
RASQSVSNDVA

SEQ ID NO: 10806 - protein, 7 aa, Artificial Sequence
  Description of Artificial Sequence: Synthetic peptide
  XENP019157 vlCDR2
YASHRYT

SEQ ID NO: 10807 - protein, 9 aa, Artificial Sequence
  Description of Artificial Sequence: Synthetic peptide
  XENP019157 vlCDR3
QQDYSSPRT

SEQ ID NO: 10808 - protein, 249 aa, Artificial Sequence
  Description of Artificial Sequence: Synthetic polypeptide
  XENP019158 1G6_H1.90_L1.116_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 10809 - protein, 122 aa, Artificial Sequence; identical to SEQ ID NO: 7161
  Description of Artificial Sequence: Synthetic polypeptide
  VH of XENP019158

SEQ ID NO: 10810 - protein, 107 aa, Artificial Sequence; identical to SEQ ID NO: 9538
  Description of Artificial Sequence: Synthetic polypeptide
  VL of XENP019158

SEQ ID NO: 10811 - protein, 5 aa, Artificial Sequence
  Description of Artificial Sequence: Synthetic peptide
  XENP019158 vhCDR1
NYWMN

SEQ ID NO: 10812 - protein, 19 aa, Artificial Sequence
  Description of Artificial Sequence: Synthetic peptide
  XENP019158 vhCDR2
EIRLYSNNYATHYAEPVKG

SEQ ID NO: 10813 - protein, 11 aa, Artificial Sequence
  Description of Artificial Sequence: Synthetic peptide
  XENP019158 vhCDR3
YYGNYGGYFDV

SEQ ID NO: 10814 - protein, 11 aa, Artificial Sequence
  Description of Artificial Sequence: Synthetic peptide
  XENP019158 vlCDR1
RASQSVSNDVA

SEQ ID NO: 10815 - protein, 7 aa, Artificial Sequence
  Description of Artificial Sequence: Synthetic peptide
  XENP019158 vlCDR2
YASHRYT

SEQ ID NO: 10816 - protein, 9 aa, Artificial Sequence
  Description of Artificial Sequence: Synthetic peptide
  XENP019158 vlCDR3
QQDFSSPRT

SEQ ID NO: 10817 - protein, 249 aa, Artificial Sequence; identical to SEQ ID NO: 10772
  Description of Artificial Sequence: Synthetic polypeptide
  XENP019159 1G6_H1.155_L1.119_scFv(GKPGS)4

SEQ ID NO: 10818 - protein, 122 aa, Artificial Sequence; identical to SEQ ID NO: 7161
  Description of Artificial Sequence: Synthetic polypeptide
  VH of XENP019159

SEQ ID NO: 10819 - protein, 107 aa, Artificial Sequence; identical to SEQ ID NO: 9565
  Description of Artificial Sequence: Synthetic polypeptide
  VL of XENP019159

SEQ ID NO: 10820 - protein, 5 aa, Artificial Sequence
  Description of Artificial Sequence: Synthetic peptide
  XENP019159 vhCDR1
NYWMN

SEQ ID NO: 10821 - protein, 19 aa, Artificial Sequence
  Description of Artificial Sequence: Synthetic peptide
  XENP019159 vhCDR2
EIRLYSNNYATHYAEPVKG

SEQ ID NO: 10822 - protein, 11 aa, Artificial Sequence
  Description of Artificial Sequence: Synthetic peptide
  XENP019159 vhCDR3
YYGNYGGYFDV

SEQ ID NO: 10823 - protein, 11 aa, Artificial Sequence
  Description of Artificial Sequence: Synthetic peptide
  XENP019159 vlCDR1
RASQSVSNDVA

SEQ ID NO: 10824 - protein, 7 aa, Artificial Sequence
  Description of Artificial Sequence: Synthetic peptide
  XENP019159 vlCDR2
YASHRYT

SEQ ID NO: 10825 - protein, 9 aa, Artificial Sequence
  Description of Artificial Sequence: Synthetic peptide
  XENP019159 vlCDR3
QQDWSSPRT

SEQ ID NO: 10826 - protein, 249 aa, Artificial Sequence
  Description of Artificial Sequence: Synthetic polypeptide
  XENP019182 1G6_H1_L1.190_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIK

SEQ ID NO: 10827 - protein, 122 aa, Artificial Sequence; identical to SEQ ID NO: 6246
  Description of Artificial Sequence: Synthetic polypeptide
  VH of XENP019182

SEQ ID NO: 10828 - protein, 107 aa, Artificial Sequence
  Description of Artificial Sequence: Synthetic polypeptide
  VL of XENP019182
SIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIK

SEQ ID NO: 10829 - protein, 5 aa, Artificial Sequence
  Description of Artificial Sequence: Synthetic peptide
  XENP019182 vhCDR1
NYWMN

SEQ ID NO: 10830 - protein, 19 aa, Artificial Sequence
  Description of Artificial Sequence: Synthetic peptide
  XENP019182 vhCDR2
EIRLKSNNYATHYAEPVKG

SEQ ID NO: 10831 - protein, 11 aa, Artificial Sequence
  Description of Artificial Sequence: Synthetic peptide
  XENP019182 vhCDR3
YYGNYGGYFDV

SEQ ID NO: 10832 - protein, 11 aa, Artificial Sequence
  Description of Artificial Sequence: Synthetic peptide
  XENP019182 vlCDR1
RASQSVGNDVA

SEQ ID NO: 10833 - protein, 7 aa, Artificial Sequence
  Description of Artificial Sequence: Synthetic peptide
  XENP019182 vlCDR2
YASHRYT

SEQ ID NO: 10834 - protein, 9 aa, Artificial Sequence
  Description of Artificial Sequence: Synthetic peptide
  XENP019182 vlCDR3
QQDFSSPRT

SEQ ID NO: 10835 - protein, 249 aa, Artificial Sequence
  Description of Artificial Sequence: Synthetic polypeptide
  XENP019183 1G6_H1_L1.191_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIK

SEQ ID NO: 10836 - protein, 122 aa, Artificial Sequence; identical to SEQ ID NO: 6246
  Description of Artificial Sequence: Synthetic polypeptide
  VH of XENP019183

SEQ ID NO: 10837 - protein, 107 aa, Artificial Sequence
  Description of Artificial Sequence: Synthetic polypeptide
  VL of XENP019183
SIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIK

SEQ ID NO: 10838 - protein, 5 aa, Artificial Sequence
  Description of Artificial Sequence: Synthetic peptide
  XENP019183 vhCDR1
NYWMN

SEQ ID NO: 10839 - protein, 19 aa, Artificial Sequence
  Description of Artificial Sequence: Synthetic peptide
  XENP019183 vhCDR2
EIRLKSNNYATHYAEPVKG

SEQ ID NO: 10840 - protein, 11 aa, Artificial Sequence
  Description of Artificial Sequence: Synthetic peptide
  XENP019183 vhCDR3
YYGNYGGYFDV

SEQ ID NO: 10841 - protein, 11 aa, Artificial Sequence
  Description of Artificial Sequence: Synthetic peptide
  XENP019183 vlCDR1
RASQSVGNDVA

SEQ ID NO: 10842 - protein, 7 aa, Artificial Sequence
  Description of Artificial Sequence: Synthetic peptide
  XENP019183 vlCDR2
YASHRYT

SEQ ID NO: 10843 - protein, 9 aa, Artificial Sequence
  Description of Artificial Sequence: Synthetic peptide
  XENP019183 vlCDR3
QQDWSSPRT

SEQ ID NO: 10844 - protein, 480 aa, Artificial Sequence
  Description of Artificial Sequence: Synthetic polypeptide
  XENP019202 1G6_H1.278_L1_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10845 - protein, 122 aa, Artificial Sequence
  Description of Artificial Sequence: Synthetic polypeptide
  VH of XENP019202
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 10846 - protein, 338 aa, Artificial Sequence
  Description of Artificial Sequence: Synthetic polypeptide
  VL of XENP019202
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10847 - protein, 5 aa, Artificial Sequence
  Description of Artificial Sequence: Synthetic peptide
  XENP019202 vhCDR1
NYWMN

SEQ ID NO: 10848 - protein, 19 aa, Artificial Sequence
  Description of Artificial Sequence: Synthetic peptide
  XENP019202 vhCDR2
EIRLYSNNYATHYAESVKG

SEQ ID NO: 10849 - protein, 11 aa, Artificial Sequence
  Description of Artificial Sequence: Synthetic peptide
  XENP019202 vhCDR3
YYGNYGGYFDV

SEQ ID NO: 10850 - protein, 11 aa, Artificial Sequence
  Description of Artificial Sequence: Synthetic peptide
  XENP019202 vlCDR1
RASQSVSNDVA

SEQ ID NO: 10851 - protein, 7 aa, Artificial Sequence
  Description of Artificial Sequence: Synthetic peptide
  XENP019202 vlCDR2
YASHRYT

SEQ ID NO: 10852 - protein, 9 aa, Artificial Sequence
  Description of Artificial Sequence: Synthetic peptide
  XENP019202 vlCDR3
QQDYSSPRT

SEQ ID NO: 10853 - protein, 249 aa, Artificial Sequence
  Description of Artificial Sequence: Synthetic polypeptide
  XENP019203 1G6_H1_L1.188_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 10854 - protein, 122 aa, Artificial Sequence; identical to SEQ ID NO: 6246
  Description of Artificial Sequence: Synthetic polypeptide
  VH of XENP019203

SEQ ID NO: 10855 - protein, 107 aa, Artificial Sequence
  Description of Artificial Sequence: Synthetic polypeptide
  VL of XENP019203
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 10856 - protein, 5 aa, Artificial Sequence
  Description of Artificial Sequence: Synthetic peptide
  XENP019203 vhCDR1
NYWMN

SEQ ID NO: 10857 - protein, 19 aa, Artificial Sequence
  Description of Artificial Sequence: Synthetic peptide
  XENP019203 vhCDR2
EIRLKSNNYATHYAEPVKG

SEQ ID NO: 10858 - protein, 11 aa, Artificial Sequence
  Description of Artificial Sequence: Synthetic peptide
  XENP019203 vhCDR3
YYGNYGGYFDV

SEQ ID NO: 10859 - protein, 11 aa, Artificial Sequence
  Description of Artificial Sequence: Synthetic peptide
  XENP019203 vlCDR1
RASQSVGNDVA

SEQ ID NO: 10860 - protein, 7 aa, Artificial Sequence
  Description of Artificial Sequence: Synthetic peptide
  XENP019203 vlCDR2
YASHRYT

SEQ ID NO: 10861 - protein, 9 aa, Artificial Sequence
  Description of Artificial Sequence: Synthetic peptide
  XENP019203 vlCDR3
QQDFSSPRT

SEQ ID NO: 10862 - protein, 249 aa, Artificial Sequence
  Description of Artificial Sequence: Synthetic polypeptide
  XENP019204 1G6_H1_L1.189_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10863 - protein, 122 aa, Artificial Sequence; identical to SEQ ID NO: 6246
  Description of Artificial Sequence: Synthetic polypeptide
  VH of XENP019204

SEQ ID NO: 10864 - protein, 107 aa, Artificial Sequence
  Description of Artificial Sequence: Synthetic polypeptide
  VL of XENP019204
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10865 - protein, 5 aa, Artificial Sequence
  Description of Artificial Sequence: Synthetic peptide
  XENP019204 vhCDR1
NYWMN

SEQ ID NO: 10866 - protein, 19 aa, Artificial Sequence
  Description of Artificial Sequence: Synthetic peptide
  XENP019204 vhCDR2
EIRLKSNNYATHYAEPVKG

SEQ ID NO: 10867 - protein, 11 aa, Artificial Sequence
  Description of Artificial Sequence: Synthetic peptide
  XENP019204 vhCDR3
YYGNYGGYFDV

SEQ ID NO: 10868 - protein, 11 aa, Artificial Sequence
  Description of Artificial Sequence: Synthetic peptide
  XENP019204 vlCDR1
RASQSVGNDVA

SEQ ID NO: 10869 - protein, 7 aa, Artificial Sequence
  Description of Artificial Sequence: Synthetic peptide
  XENP019204 vlCDR2
YASHRYT

SEQ ID NO: 10870 - protein, 9 aa, Artificial Sequence
  Description of Artificial Sequence: Synthetic peptide
  XENP019204 vlCDR3
QQDFSSPRT

SEQ ID NO: 10871 - protein, 249 aa, Artificial Sequence
  Description of Artificial Sequence: Synthetic polypeptide
  XENP019205 1G6_H1.278_L1.188_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIK

SEQ ID NO: 10872 - protein, 122 aa, Artificial Sequence; identical to SEQ ID NO: 10845
  Description of Artificial Sequence: Synthetic polypeptide
  VH of XENP019205

SEQ ID NO: 10873 - protein, 107 aa, Artificial Sequence; identical to SEQ ID NO: 10855
  Description of Artificial Sequence: Synthetic polypeptide
  VL of XENP019205

SEQ ID NO: 10874 - protein, 5 aa, Artificial Sequence
  Description of Artificial Sequence: Synthetic peptide
  XENP019205 vhCDR1
NYWMN

SEQ ID NO: 10875 - protein, 19 aa, Artificial Sequence
  Description of Artificial Sequence: Synthetic peptide
  XENP019205 vhCDR2
EIRLYSNNYATHYAESVKG

SEQ ID NO: 10876 - protein, 11 aa, Artificial Sequence
  Description of Artificial Sequence: Synthetic peptide
  XENP019205 vhCDR3
YYGNYGGYFDV

SEQ ID NO: 10877 - protein, 11 aa, Artificial Sequence
  Description of Artificial Sequence: Synthetic peptide
  XENP019205 vlCDR1
RASQSVGNDVA

SEQ ID NO: 10878 - protein, 7 aa, Artificial Sequence
  Description of Artificial Sequence: Synthetic peptide
  XENP019205 vlCDR2
YASHRYT

SEQ ID NO: 10879 - protein, 9 aa, Artificial Sequence
  Description of Artificial Sequence: Synthetic peptide
  XENP019205 vlCDR3
QQDFSSPRT

SEQ ID NO: 10880 - protein, 249 aa, Artificial Sequence
  Description of Artificial Sequence: Synthetic polypeptide
  XENP019206 1G6_H1.278_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10881 - protein, 122 aa, Artificial Sequence; identical to SEQ ID NO: 10845
  Description of Artificial Sequence: Synthetic polypeptide
  VH of XENP019206

SEQ ID NO: 10882 - protein, 107 aa, Artificial Sequence; identical to SEQ ID NO: 10864
  Description of Artificial Sequence: Synthetic polypeptide
  VL of XENP019206

SEQ ID NO: 10883 - protein, 5 aa, Artificial Sequence
  Description of Artificial Sequence: Synthetic peptide
  XENP019206 vhCDR1
NYWMN

SEQ ID NO: 10884 - protein, 19 aa, Artificial Sequence
  Description of Artificial Sequence: Synthetic peptide
  XENP019206 vhCDR2
EIRLYSNNYATHYAESVKG

SEQ ID NO: 10885 - protein, 11 aa, Artificial Sequence
  Description of Artificial Sequence: Synthetic peptide
  XENP019206 vhCDR3
YYGNYGGYFDV

SEQ ID NO: 10886 - protein, 11 aa, Artificial Sequence
  Description of Artificial Sequence: Synthetic peptide
  XENP019206 vlCDR1
RASQSVGNDVA

SEQ ID NO: 10887 - protein, 7 aa, Artificial Sequence
  Description of Artificial Sequence: Synthetic peptide
  XENP019206 vlCDR2
YASHRYT

SEQ ID NO: 10888 - protein, 9 aa, Artificial Sequence
  Description of Artificial Sequence: Synthetic peptide
  XENP019206 vlCDR3
QQDFSSPRT

SEQ ID NO: 10889 - protein, 249 aa, Artificial Sequence
  Description of Artificial Sequence: Synthetic polypeptide
  XENP019207 1G6_L1.188_H1.278_scFv(GKPGS)4
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 10890 - protein, 107 aa, Artificial Sequence; identical to SEQ ID NO: 10855
  Description of Artificial Sequence: Synthetic polypeptide
  VH of XENP019207

SEQ ID NO: 10891 - protein, 122 aa, Artificial Sequence; identical to SEQ ID NO: 10845
  Description of Artificial Sequence: Synthetic polypeptide
  VL of XENP019207

SEQ ID NO: 10892 - protein, 11 aa, Artificial Sequence
  Description of Artificial Sequence: Synthetic peptide
  XENP019207 vhCDR1
RASQSVGNDVA

SEQ ID NO: 10893 - protein, 7 aa, Artificial Sequence
  Description of Artificial Sequence: Synthetic peptide
  XENP019207 vhCDR2
YASHRYT

SEQ ID NO: 10894 - protein, 9 aa, Artificial Sequence
  Description of Artificial Sequence: Synthetic peptide
  XENP019207 vhCDR3
QQDFSSPRT

SEQ ID NO: 10895 - protein, 5 aa, Artificial Sequence
  Description of Artificial Sequence: Synthetic peptide
  XENP019207 vlCDR1
NYWMN

SEQ ID NO: 10896 - protein, 19 aa, Artificial Sequence
  Description of Artificial Sequence: Synthetic peptide
  XENP019207 vlCDR2
EIRLYSNNYATHYAESVKG

SEQ ID NO: 10897 - protein, 11 aa, Artificial Sequence
  Description of Artificial Sequence: Synthetic peptide
  XENP019207 vlCDR3
YYGNYGGYFDV

SEQ ID NO: 10898 - protein, 249 aa, Artificial Sequence
  Description of Artificial Sequence: Synthetic polypeptide
  XENP019208 1G6_L1.189_H1.278_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 10899 - protein, 107 aa, Artificial Sequence; identical to SEQ ID NO: 10864
  Description of Artificial Sequence: Synthetic polypeptide
  VH of XENP019208

SEQ ID NO: 10900 - protein, 122 aa, Artificial Sequence; identical to SEQ ID NO: 10845
  Description of Artificial Sequence: Synthetic polypeptide
  VL of XENP019208

SEQ ID NO: 10901 - protein, 11 aa, Artificial Sequence
  Description of Artificial Sequence: Synthetic peptide
  XENP019208 vhCDR1
RASQSVGNDVA

SEQ ID NO: 10902 - protein, 7 aa, Artificial Sequence
  Description of Artificial Sequence: Synthetic peptide
  XENP019208 vhCDR2
YASHRYT

SEQ ID NO: 10903 - protein, 9 aa, Artificial Sequence
  Description of Artificial Sequence: Synthetic peptide
  XENP019208 vhCDR3
QQDFSSPRT

SEQ ID NO: 10904 - protein, 5 aa, Artificial Sequence
  Description of Artificial Sequence: Synthetic peptide
  XENP019208 vlCDR1
NYWMN

SEQ ID NO: 10905 - protein, 19 aa, Artificial Sequence
  Description of Artificial Sequence: Synthetic peptide
  XENP019208 vlCDR2
EIRLYSNNYATHYAESVKG

SEQ ID NO: 10906 - protein, 11 aa, Artificial Sequence
  Description of Artificial Sequence: Synthetic peptide
  XENP019208 vlCDR3
YYGNYGGYFDV

SEQ ID NO: 10907 - protein, 249 aa, Artificial Sequence
  Description of Artificial Sequence: Synthetic polypeptide
  XENP019618 1G6_H1.279_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10908 - protein, 122 aa, Artificial Sequence
  Description of Artificial Sequence: Synthetic polypeptide
  VH of XENP019618
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 10909 - protein, 107 aa, Artificial Sequence; identical to SEQ ID NO: 10864
  Description of Artificial Sequence: Synthetic polypeptide
  VL of XENP019618

SEQ ID NO: 10910 - protein, 5 aa, Artificial Sequence
  Description of Artificial Sequence: Synthetic peptide
  XENP019618 vhCDR1
NYWMN

SEQ ID NO: 10911 - protein, 19 aa, Artificial Sequence
  Description of Artificial Sequence: Synthetic peptide
  XENP019618 vhCDR2
EIRLYSNNYATHYAESVKG

SEQ ID NO: 10912 - protein, 11 aa, Artificial Sequence
  Description of Artificial Sequence: Synthetic peptide
  XENP019618 vhCDR3
YYGNYGGYFDV

SEQ ID NO: 10913 - protein, 11 aa, Artificial Sequence
  Description of Artificial Sequence: Synthetic peptide
  XENP019618 vlCDR1
RASQSVGNDVA

SEQ ID NO: 10914 - protein, 7 aa, Artificial Sequence
  Description of Artificial Sequence: Synthetic peptide
  XENP019618 vlCDR2
YASHRYT

SEQ ID NO: 10915 - protein, 9 aa, Artificial Sequence
  Description of Artificial Sequence: Synthetic peptide
  XENP019618 vlCDR3
QQDFSSPRT

SEQ ID NO: 10916 - protein, 249 aa, Artificial Sequence
  Description of Artificial Sequence: Synthetic polypeptide
  XENP019619 1G6_H1.280_L1.189_scFv(GKPGS)4
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10917 - protein, 122 aa, Artificial Sequence
  Description of Artificial Sequence: Synthetic polypeptide
  VH of XENP019619
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 10918 - protein, 107 aa, Artificial Sequence; identical to SEQ ID NO: 10864
  Description of Artificial Sequence: Synthetic polypeptide
  VL of XENP019619

SEQ ID NO: 10919 - protein, 5 aa, Artificial Sequence
  Description of Artificial Sequence: Synthetic peptide
  XENP019619 vhCDR1
NYWMN

SEQ ID NO: 10920 - protein, 19 aa, Artificial Sequence
  Description of Artificial Sequence: Synthetic peptide
  XENP019619 vhCDR2
EIRLYSNNYATHYAESVKG

SEQ ID NO: 10921 - protein, 11 aa, Artificial Sequence
  Description of Artificial Sequence: Synthetic peptide
  XENP019619 vhCDR3
YYGNYGGYFDV

SEQ ID NO: 10922 - protein, 11 aa, Artificial Sequence
  Description of Artificial Sequence: Synthetic peptide
  XENP019619 vlCDR1
RASQSVGNDVA

SEQ ID NO: 10923 - protein, 7 aa, Artificial Sequence
  Description of Artificial Sequence: Synthetic peptide
  XENP019619 vlCDR2
YASHRYT

SEQ ID NO: 10924 - protein, 9 aa, Artificial Sequence
  Description of Artificial Sequence: Synthetic peptide
  XENP019619 vlCDR3
QQDFSSPRT

SEQ ID NO: 10925 - protein, 249 aa, Artificial Sequence
  Description of Artificial Sequence: Synthetic polypeptide
  XENP019620 1G6_H1.281_L1.189_scFv(GKPGS)4
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10926 - protein, 122 aa, Artificial Sequence
  Description of Artificial Sequence: Synthetic polypeptide
  VH of XENP019620
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 10927 - protein, 107 aa, Artificial Sequence; identical to SEQ ID NO: 10864
  Description of Artificial Sequence: Synthetic polypeptide
  VL of XENP019620

SEQ ID NO: 10928 - protein, 5 aa, Artificial Sequence
  Description of Artificial Sequence: Synthetic peptide
  XENP019620 vhCDR1
NYWMN

SEQ ID NO: 10929 - protein, 19 aa, Artificial Sequence
  Description of Artificial Sequence: Synthetic peptide
  XENP019620 vhCDR2
EIRLYSNNYATHYAESVKG

SEQ ID NO: 10930 - protein, 11 aa, Artificial Sequence
  Description of Artificial Sequence: Synthetic peptide
  XENP019620 vhCDR3
YYGNYGGYFDV

SEQ ID NO: 10931 - protein, 11 aa, Artificial Sequence
  Description of Artificial Sequence: Synthetic peptide
  XENP019620 vlCDR1
RASQSVGNDVA

SEQ ID NO: 10932 - protein, 7 aa, Artificial Sequence
  Description of Artificial Sequence: Synthetic peptide
  XENP019620 vlCDR2
YASHRYT

SEQ ID NO: 10933 - protein, 9 aa, Artificial Sequence
  Description of Artificial Sequence: Synthetic peptide
  XENP019620 vlCDR3
QQDFSSPRT

SEQ ID NO: 10934 - protein, 249 aa, Artificial Sequence
  Description of Artificial Sequence: Synthetic polypeptide
  XENP019621 1G6_H1.282_L1.189_scFv(GKPGS)4
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10935 - protein, 122 aa, Artificial Sequence
  Description of Artificial Sequence: Synthetic polypeptide
  VH of XENP019621
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 10936 - protein, 107 aa, Artificial Sequence; identical to SEQ ID NO: 10864
  Description of Artificial Sequence: Synthetic polypeptide
  VL of XENP019621

SEQ ID NO: 10937 - protein, 5 aa, Artificial Sequence
  Description of Artificial Sequence: Synthetic peptide
  XENP019621 vhCDR1
NYWMN

SEQ ID NO: 10938 - protein, 19 aa, Artificial Sequence
  Description of Artificial Sequence: Synthetic peptide
  XENP019621 vhCDR2
EIRLYSNNYATHYAESVKG

SEQ ID NO: 10939 - protein, 11 aa, Artificial Sequence
  Description of Artificial Sequence: Synthetic peptide
  XENP019621 vhCDR3
YYGNYGGYFDV

SEQ ID NO: 10940 - protein, 11 aa, Artificial Sequence
  Description of Artificial Sequence: Synthetic peptide
  XENP019621 vlCDR1
RASQSVGNDVA

SEQ ID NO: 10941 - protein, 7 aa, Artificial Sequence
  Description of Artificial Sequence: Synthetic peptide
  XENP019621 vlCDR2
YASHRYT

SEQ ID NO: 10942 - protein, 9 aa, Artificial Sequence
  Description of Artificial Sequence: Synthetic peptide
  XENP019621 vlCDR3
QQDFSSPRT

SEQ ID NO: 10943 - protein, 249 aa, Artificial Sequence
  Description of Artificial Sequence: Synthetic polypeptide
  XENP019622 1G6_H1.283_L1.189_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10944 - protein, 122 aa, Artificial Sequence
  Description of Artificial Sequence: Synthetic polypeptide
  VH of XENP019622
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSS

SEQ ID NO: 10945 - protein, 107 aa, Artificial Sequence; identical to SEQ ID NO: 10864
  Description of Artificial Sequence: Synthetic polypeptide
  VL of XENP019622

SEQ ID NO: 10946 - protein, 5 aa, Artificial Sequence
  Description of Artificial Sequence: Synthetic peptide
  XENP019622 vhCDR1
NYWMN

SEQ ID NO: 10947 - protein, 19 aa, Artificial Sequence
  Description of Artificial Sequence: Synthetic peptide
  XENP019622 vhCDR2
EIRLYSNNYATHYAESVKG

SEQ ID NO: 10948 - protein, 11 aa, Artificial Sequence
  Description of Artificial Sequence: Synthetic peptide
  XENP019622 vhCDR3
YYGNYGGYFDV

SEQ ID NO: 10949 - protein, 11 aa, Artificial Sequence
  Description of Artificial Sequence: Synthetic peptide
  XENP019622 vlCDR1
RASQSVGNDVA

SEQ ID NO: 10950 - protein, 7 aa, Artificial Sequence
  Description of Artificial Sequence: Synthetic peptide
  XENP019622 vlCDR2
YASHRYT

SEQ ID NO: 10951 - protein, 9 aa, Artificial Sequence
  Description of Artificial Sequence: Synthetic peptide
  XENP019622 vlCDR3
QQDFSSPRT

SEQ ID NO: 10952 - protein, 249 aa, Artificial Sequence
  Description of Artificial Sequence: Synthetic polypeptide
  XENP019623 1G6_H1.284_L1.189_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10953 - protein, 122 aa, Artificial Sequence
  Description of Artificial Sequence: Synthetic polypeptide
  VH of XENP019623
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 10954 - protein, 107 aa, Artificial Sequence; identical to SEQ ID NO: 10864
  Description of Artificial Sequence: Synthetic polypeptide
  VL of XENP019623

SEQ ID NO: 10955 - protein, 5 aa, Artificial Sequence
  Description of Artificial Sequence: Synthetic peptide
  XENP019623 vhCDR1
NYWMN

SEQ ID NO: 10956 - protein, 19 aa, Artificial Sequence
  Description of Artificial Sequence: Synthetic peptide
  XENP019623 vhCDR2
EIRLYSNNYATHYAESVKG

SEQ ID NO: 10957 - protein, 11 aa, Artificial Sequence
  Description of Artificial Sequence: Synthetic peptide
  XENP019623 vhCDR3
YYGNYGGYFDV

SEQ ID NO: 10958 - protein, 11 aa, Artificial Sequence
  Description of Artificial Sequence: Synthetic peptide
  XENP019623 vlCDR1
RASQSVGNDVA

SEQ ID NO: 10959 - protein, 7 aa, Artificial Sequence
  Description of Artificial Sequence: Synthetic peptide
  XENP019623 vlCDR2
YASHRYT

SEQ ID NO: 10960 - protein, 9 aa, Artificial Sequence
  Description of Artificial Sequence: Synthetic peptide
  XENP019623 vlCDR3
QQDFSSPRT

SEQ ID NO: 10961 - protein, 249 aa, Artificial Sequence
  Description of Artificial Sequence: Synthetic polypeptide
  XENP019624 1G6_H1.285_L1.189_scFv(GKPGS)4
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10962 - protein, 122 aa, Artificial Sequence
  Description of Artificial Sequence: Synthetic polypeptide
  VH of XENP019624
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSS

SEQ ID NO: 10963 - protein, 107 aa, Artificial Sequence; identical to SEQ ID NO: 10864
  Description of Artificial Sequence: Synthetic polypeptide
  VL of XENP019624

SEQ ID NO: 10964 - protein, 5 aa, Artificial Sequence
  Description of Artificial Sequence: Synthetic peptide
  XENP019624 vhCDR1
NYWMN

SEQ ID NO: 10965 - protein, 19 aa, Artificial Sequence
  Description of Artificial Sequence: Synthetic peptide
  XENP019624 vhCDR2
EIRLYSNNYATHYAESVKG

SEQ ID NO: 10966 - protein, 11 aa, Artificial Sequence
  Description of Artificial Sequence: Synthetic peptide
  XENP019624 vhCDR3
YYGNYGGYFDV

SEQ ID NO: 10967 - protein, 11 aa, Artificial Sequence
  Description of Artificial Sequence: Synthetic peptide
  XENP019624 vlCDR1
RASQSVGNDVA

SEQ ID NO: 10968 - protein, 7 aa, Artificial Sequence
  Description of Artificial Sequence: Synthetic peptide
  XENP019624 vlCDR2
YASHRYT

SEQ ID NO: 10969 - protein, 9 aa, Artificial Sequence
  Description of Artificial Sequence: Synthetic peptide
  XENP019624 vlCDR3
QQDFSSPRT

SEQ ID NO: 10970 - protein, 249 aa, Artificial Sequence
  Description of Artificial Sequence: Synthetic polypeptide
  XENP019625 1G6_H1.286_L1.189_scFv(GKPGS)4
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10971 - protein, 122 aa, Artificial Sequence
  Description of Artificial Sequence: Synthetic polypeptide
  VH of XENP019625
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSS

SEQ ID NO: 10972 - protein, 107 aa, Artificial Sequence; identical to SEQ ID NO: 10864
  Description of Artificial Sequence: Synthetic polypeptide
  VL of XENP019625

SEQ ID NO: 10973 - protein, 5 aa, Artificial Sequence
  Description of Artificial Sequence: Synthetic peptide
  XENP019625 vhCDR1
NYWMN

SEQ ID NO: 10974 - protein, 19 aa, Artificial Sequence
  Description of Artificial Sequence: Synthetic peptide
  XENP019625 vhCDR2
EIRLYSDNYATHYAESVKG

SEQ ID NO: 10975 - protein, 11 aa, Artificial Sequence
  Description of Artificial Sequence: Synthetic peptide
  XENP019625 vhCDR3
YYGNYGGYFDV

SEQ ID NO: 10976 - protein, 11 aa, Artificial Sequence
  Description of Artificial Sequence: Synthetic peptide
  XENP019625 vlCDR1
RASQSVGNDVA

SEQ ID NO: 10977 - protein, 7 aa, Artificial Sequence
  Description of Artificial Sequence: Synthetic peptide
  XENP019625 vlCDR2
YASHRYT

SEQ ID NO: 10978 - protein, 9 aa, Artificial Sequence
  Description of Artificial Sequence: Synthetic peptide
  XENP019625 vlCDR3
QQDFSSPRT

SEQ ID NO: 10979 - protein, 249 aa, Artificial Sequence
  Description of Artificial Sequence: Synthetic polypeptide
  XENP019626 1G6_H1.278_L1.192_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10980 - protein, 122 aa, Artificial Sequence; identical to SEQ ID NO: 10845
  Description of Artificial Sequence: Synthetic polypeptide
  VH of XENP019626

SEQ ID NO: 10981 - protein, 107 aa, Artificial Sequence
  Description of Artificial Sequence: Synthetic polypeptide
  VL of XENP019626
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 10982 - protein, 5 aa, Artificial Sequence
  Description of Artificial Sequence: Synthetic peptide
  XENP019626 vhCDR1
NYWMN

SEQ ID NO: 10983 - protein, 19 aa, Artificial Sequence
  Description of Artificial Sequence: Synthetic peptide
  XENP019626 vhCDR2
EIRLYSNNYATHYAESVKG

SEQ ID NO: 10984 - protein, 11 aa, Artificial Sequence
  Description of Artificial Sequence: Synthetic peptide
  XENP019626 vhCDR3
YYGNYGGYFDV

SEQ ID NO: 10985 - protein, 11 aa, Artificial Sequence
  Description of Artificial Sequence: Synthetic peptide
  XENP019626 vlCDR1
RASQSVGNDVA

SEQ ID NO: 10986 - protein, 7 aa, Artificial Sequence
  Description of Artificial Sequence: Synthetic peptide
  XENP019626 vlCDR2
YASHRYT

SEQ ID NO: 10987 - protein, 9 aa, Artificial Sequence
  Description of Artificial Sequence: Synthetic peptide
  XENP019626 vlCDR3
QQDFSSPRT

SEQ ID NO: 10988 - protein, 249 aa, Artificial Sequence
  Description of Artificial Sequence: Synthetic polypeptide
  XENP019627 1G6_H1.278_L1.193_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 10989 - protein, 122 aa, Artificial Sequence; identical to SEQ ID NO: 10845
  Description of Artificial Sequence: Synthetic polypeptide
  VH of XENP019627

SEQ ID NO: 10990 - protein, 107 aa, Artificial Sequence
  Description of Artificial Sequence: Synthetic polypeptide
  VL of XENP019627
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 10991 - protein, 5 aa, Artificial Sequence
  Description of Artificial Sequence: Synthetic peptide
  XENP019627 vhCDR1
NYWMN

SEQ ID NO: 10992 - protein, 19 aa, Artificial Sequence
  Description of Artificial Sequence: Synthetic peptide
  XENP019627 vhCDR2
EIRLYSNNYATHYAESVKG

SEQ ID NO: 10993 - protein, 11 aa, Artificial Sequence
  Description of Artificial Sequence: Synthetic peptide
  XENP019627 vhCDR3
YYGNYGGYFDV

SEQ ID NO: 10994 - protein, 11 aa, Artificial Sequence
  Description of Artificial Sequence: Synthetic peptide
  XENP019627 vlCDR1
RASQSVGNDVA

SEQ ID NO: 10995 - protein, 7 aa, Artificial Sequence
  Description of Artificial Sequence: Synthetic peptide
  XENP019627 vlCDR2
YASHRYT

SEQ ID NO: 10996 - protein, 9 aa, Artificial Sequence
  Description of Artificial Sequence: Synthetic peptide
  XENP019627 vlCDR3
QQDFSSPRT

SEQ ID NO: 10997 - protein, 249 aa, Artificial Sequence
  Description of Artificial Sequence: Synthetic polypeptide
  XENP019628 1G6_H1.278_L1.194_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 10998 - protein, 122 aa, Artificial Sequence; identical to SEQ ID NO: 10845
  Description of Artificial Sequence: Synthetic polypeptide
  VH of XENP019628

SEQ ID NO: 10999 - protein, 107 aa, Artificial Sequence
  Description of Artificial Sequence: Synthetic polypeptide
  VL of XENP019628
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11000 - protein, 5 aa, Artificial Sequence
  Description of Artificial Sequence: Synthetic peptide
  XENP019628 vhCDR1
NYWMN

SEQ ID NO: 11001 - protein, 19 aa, Artificial Sequence
  Description of Artificial Sequence: Synthetic peptide
  XENP019628 vhCDR2
EIRLYSNNYATHYAESVKG

SEQ ID NO: 11002 - protein, 11 aa, Artificial Sequence
  Description of Artificial Sequence: Synthetic peptide
  XENP019628 vhCDR3
YYGNYGGYFDV

SEQ ID NO: 11003 - protein, 11 aa, Artificial Sequence
  Description of Artificial Sequence: Synthetic peptide
  XENP019628 vlCDR1
RASQSVGNDVA

SEQ ID NO: 11004 - protein, 7 aa, Artificial Sequence
  Description of Artificial Sequence: Synthetic peptide
  XENP019628 vlCDR2
YASHRYT

SEQ ID NO: 11005 - protein, 9 aa, Artificial Sequence
  Description of Artificial Sequence: Synthetic peptide
  XENP019628 vlCDR3
QQDFSSPRT

SEQ ID NO: 11006 - protein, 249 aa, Artificial Sequence
  Description of Artificial Sequence: Synthetic polypeptide
  XENP019629 1G6_H1.278_L1.195_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIK

SEQ ID NO: 11007 - protein, 122 aa, Artificial Sequence; identical to SEQ ID NO: 10845
  Description of Artificial Sequence: Synthetic polypeptide
  VH of XENP019629

SEQ ID NO: 11008 - protein, 107 aa, Artificial Sequence
  Description of Artificial Sequence: Synthetic polypeptide
  VL of XENP019629
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIK

SEQ ID NO: 11009 - protein, 5 aa, Artificial Sequence
  Description of Artificial Sequence: Synthetic peptide
  XENP019629 vhCDR1
NYWMN

SEQ ID NO: 11010 - protein, 19 aa, Artificial Sequence
  Description of Artificial Sequence: Synthetic peptide
  XENP019629 vhCDR2
EIRLYSNNYATHYAESVKG

SEQ ID NO: 11011 - protein, 11 aa, Artificial Sequence
  Description of Artificial Sequence: Synthetic peptide
  XENP019629 vhCDR3
YYGNYGGYFDV

SEQ ID NO: 11012 - protein, 11 aa, Artificial Sequence
  Description of Artificial Sequence: Synthetic peptide
  XENP019629 vlCDR1
RASQSVGNDVA

SEQ ID NO: 11013 - protein, 9 aa, Artificial Sequence
  Description of Artificial Sequence: Synthetic peptide
  XENP019629 vlCDR2
CNYASHRYT

SEQ ID NO: 11014 - protein, 9 aa, Artificial Sequence
  Description of Artificial Sequence: Synthetic peptide
  XENP019629 vlCDR3
QQDFSSPRT

SEQ ID NO: 11015 - protein, 249 aa, Artificial Sequence
  Description of Artificial Sequence: Synthetic polypeptide
  XENP019630 1G6_H1.278_L1.196_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIK

SEQ ID NO: 11016 - protein, 122 aa, Artificial Sequence; identical to SEQ ID NO: 10845
  Description of Artificial Sequence: Synthetic polypeptide
  VH of XENP019630

SEQ ID NO: 11017 - protein, 107 aa, Artificial Sequence
  Description of Artificial Sequence: Synthetic polypeptide
  VL of XENP019630
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIK

SEQ ID NO: 11018 - protein, 5 aa, Artificial Sequence
  Description of Artificial Sequence: Synthetic peptide
  XENP019630 vhCDR1
NYWMN

SEQ ID NO: 11019 - protein, 19 aa, Artificial Sequence
  Description of Artificial Sequence: Synthetic peptide
  XENP019630 vhCDR2
EIRLYSNNYATHYAESVKG

SEQ ID NO: 11020 - protein, 11 aa, Artificial Sequence
  Description of Artificial Sequence: Synthetic peptide
  XENP019630 vhCDR3
YYGNYGGYFDV

SEQ ID NO: 11021 - protein, 11 aa, Artificial Sequence
  Description of Artificial Sequence: Synthetic peptide
  XENP019630 vlCDR1
RASQSVGNDVA

SEQ ID NO: 11022 - protein, 9 aa, Artificial Sequence
  Description of Artificial Sequence: Synthetic peptide
  XENP019630 vlCDR2
CNYASHRYT

SEQ ID NO: 11023 - protein, 9 aa, Artificial Sequence
  Description of Artificial Sequence: Synthetic peptide
  XENP019630 vlCDR3
QQDFSSPRT

SEQ ID NO: 11024 - protein, 249 aa, Artificial Sequence
  Description of Artificial Sequence: Synthetic polypeptide
  XENP019631 1G6_H1.278_L1.197_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIK

SEQ ID NO: 11025 - protein, 122 aa, Artificial Sequence; identical to SEQ ID NO: 10845
  Description of Artificial Sequence: Synthetic polypeptide
  VH of XENP019631

SEQ ID NO: 11026 - protein, 107 aa, Artificial Sequence
  Description of Artificial Sequence: Synthetic polypeptide
  VL of XENP019631
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIK

SEQ ID NO: 11027 - protein, 5 aa, Artificial Sequence
  Description of Artificial Sequence: Synthetic peptide
  XENP019631 vhCDR1
NYWMN

SEQ ID NO: 11028 - protein, 19 aa, Artificial Sequence
  Description of Artificial Sequence: Synthetic peptide
  XENP019631 vhCDR2
EIRLYSNNYATHYAESVKG

SEQ ID NO: 11029 - protein, 11 aa, Artificial Sequence
  Description of Artificial Sequence: Synthetic peptide
  XENP019631 vhCDR3
YYGNYGGYFDV

SEQ ID NO: 11030 - protein, 11 aa, Artificial Sequence
  Description of Artificial Sequence: Synthetic peptide
  XENP019631 vlCDR1
RASQSVGNDVA

SEQ ID NO: 11031 - protein, 9 aa, Artificial Sequence
  Description of Artificial Sequence: Synthetic peptide
  XENP019631 vlCDR2
CNYASHRYT

SEQ ID NO: 11032 - protein, 9 aa, Artificial Sequence
  Description of Artificial Sequence: Synthetic peptide
  XENP019631 vlCDR3
QQDFSSPRT

SEQ ID NO: 11033 - protein, 249 aa, Artificial Sequence
  Description of Artificial Sequence: Synthetic polypeptide
  XENP019632 1G6_H1.278_L1.198_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11034 - protein, 122 aa, Artificial Sequence; identical to SEQ ID NO: 10845
  Description of Artificial Sequence: Synthetic polypeptide
  VH of XENP019632

SEQ ID NO: 11035 - protein, 107 aa, Artificial Sequence
  Description of Artificial Sequence: Synthetic polypeptide
  VL of XENP019632
EIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11036 - protein, 5 aa, Artificial Sequence
  Description of Artificial Sequence: Synthetic peptide
  XENP019632 vhCDR1
NYWMN

SEQ ID NO: 11037 - protein, 19 aa, Artificial Sequence
  Description of Artificial Sequence: Synthetic peptide
  XENP019632 vhCDR2
EIRLYSNNYATHYAESVKG

SEQ ID NO: 11038 - protein, 11 aa, Artificial Sequence
  Description of Artificial Sequence: Synthetic peptide
  XENP019632 vhCDR3
YYGNYGGYFDV

SEQ ID NO: 11039 - protein, 11 aa, Artificial Sequence
  Description of Artificial Sequence: Synthetic peptide
  XENP019632 vlCDR1
RASQSVGNDVA

SEQ ID NO: 11040 - protein, 7 aa, Artificial Sequence
  Description of Artificial Sequence: Synthetic peptide
  XENP019632 vlCDR2
YASHRYT

SEQ ID NO: 11041 - protein, 9 aa, Artificial Sequence
  Description of Artificial Sequence: Synthetic peptide
  XENP019632 vlCDR3
QQDFSSPRT

SEQ ID NO: 11042 - protein, 249 aa, Artificial Sequence
  Description of Artificial Sequence: Synthetic polypeptide
  XENP019633 1G6_H1.278_L1.199_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11043 - protein, 122 aa, Artificial Sequence; identical to SEQ ID NO: 10845
  Description of Artificial Sequence: Synthetic polypeptide
  VH of XENP019633

SEQ ID NO: 11044 - protein, 107 aa, Artificial Sequence
  Description of Artificial Sequence: Synthetic polypeptide
  VL of XENP019633
EIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11045 - protein, 5 aa, Artificial Sequence
  Description of Artificial Sequence: Synthetic peptide
  XENP019633 vhCDR1
NYWMN

SEQ ID NO: 11046 - protein, 19 aa, Artificial Sequence
  Description of Artificial Sequence: Synthetic peptide
  XENP019633 vhCDR2
EIRLYSNNYATHYAESVKG

SEQ ID NO: 11047 - protein, 11 aa, Artificial Sequence
  Description of Artificial Sequence: Synthetic peptide
  XENP019633 vhCDR3
YYGNYGGYFDV

SEQ ID NO: 11048 - protein, 11 aa, Artificial Sequence
  Description of Artificial Sequence: Synthetic peptide
  XENP019633 vlCDR1
RASQSVGNDVA

SEQ ID NO: 11049 - protein, 7 aa, Artificial Sequence
  Description of Artificial Sequence: Synthetic peptide
  XENP019633 vlCDR2
YASHRYT

SEQ ID NO: 11050 - protein, 9 aa, Artificial Sequence
  Description of Artificial Sequence: Synthetic peptide
  XENP019633 vlCDR3
QQDFSSPRT

SEQ ID NO: 11051 - protein, 249 aa, Artificial Sequence
  Description of Artificial Sequence: Synthetic polypeptide
  XENP019634 1G6_H1.278_L1.200_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11052 - protein, 122 aa, Artificial Sequence; identical to SEQ ID NO: 10845
  Description of Artificial Sequence: Synthetic polypeptide
  VH of XENP019634

SEQ ID NO: 11053 - protein, 107 aa, Artificial Sequence
  Description of Artificial Sequence: Synthetic polypeptide
  VL of XENP019634
EIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11054 - protein, 5 aa, Artificial Sequence
  Description of Artificial Sequence: Synthetic peptide
  XENP019634 vhCDR1
NYWMN

SEQ ID NO: 11055 - protein, 19 aa, Artificial Sequence
  Description of Artificial Sequence: Synthetic peptide
  XENP019634 vhCDR2
EIRLYSNNYATHYAESVKG

SEQ ID NO: 11056 - protein, 11 aa, Artificial Sequence
  Description of Artificial Sequence: Synthetic peptide
  XENP019634 vhCDR3
YYGNYGGYFDV

SEQ ID NO: 11057 - protein, 11 aa, Artificial Sequence
  Description of Artificial Sequence: Synthetic peptide
  XENP019634 vlCDR1
RASQSVGNDVA

SEQ ID NO: 11058 - protein, 7 aa, Artificial Sequence
  Description of Artificial Sequence: Synthetic peptide
  XENP019634 vlCDR2
YASHRYT

SEQ ID NO: 11059 - protein, 9 aa, Artificial Sequence
  Description of Artificial Sequence: Synthetic peptide
  XENP019634 vlCDR3
QQDFSSPRT

SEQ ID NO: 11060 - protein, 249 aa, Artificial Sequence; identical to SEQ ID NO: 10979
  Description of Artificial Sequence: Synthetic polypeptide
  XENP019635 1G6_H1.278_L1.201_scFv(GKPGS)4

SEQ ID NO: 11061 - protein, 122 aa, Artificial Sequence; identical to SEQ ID NO: 10845
  Description of Artificial Sequence: Synthetic polypeptide
  VH of XENP019635

SEQ ID NO: 11062 - protein, 107 aa, Artificial Sequence; identical to SEQ ID NO: 10981
  Description of Artificial Sequence: Synthetic polypeptide
  VL of XENP019635

SEQ ID NO: 11063 - protein, 5 aa, Artificial Sequence
  Description of Artificial Sequence: Synthetic peptide
  XENP019635 vhCDR1
NYWMN

SEQ ID NO: 11064 - protein, 19 aa, Artificial Sequence
  Description of Artificial Sequence: Synthetic peptide
  XENP019635 vhCDR2
EIRLYSNNYATHYAESVKG

SEQ ID NO: 11065 - protein, 11 aa, Artificial Sequence
  Description of Artificial Sequence: Synthetic peptide
  XENP019635 vhCDR3
YYGNYGGYFDV

SEQ ID NO: 11066 - protein, 11 aa, Artificial Sequence
  Description of Artificial Sequence: Synthetic peptide
  XENP019635 vlCDR1
RASQSVGNDVA

SEQ ID NO: 11067 - protein, 7 aa, Artificial Sequence
  Description of Artificial Sequence: Synthetic peptide
  XENP019635 vlCDR2
YASHRYT

SEQ ID NO: 11068 - protein, 9 aa, Artificial Sequence
  Description of Artificial Sequence: Synthetic peptide
  XENP019635 vlCDR3
QQDFSSPRT

SEQ ID NO: 11069 - protein, 249 aa, Artificial Sequence
  Description of Artificial Sequence: Synthetic polypeptide
  XENP019636 1G6_H1.278_L1.202_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11070 - protein, 122 aa, Artificial Sequence; identical to SEQ ID NO: 10845
  Description of Artificial Sequence: Synthetic polypeptide
  VH of XENP019636

SEQ ID NO: 11071 - protein, 107 aa, Artificial Sequence
  Description of Artificial Sequence: Synthetic polypeptide
  VL of XENP019636
EIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11072 - protein, 5 aa, Artificial Sequence
  Description of Artificial Sequence: Synthetic peptide
  XENP019636 vhCDR1
NYWMN

SEQ ID NO: 11073 - protein, 19 aa, Artificial Sequence
  Description of Artificial Sequence: Synthetic peptide
  XENP019636 vhCDR2
EIRLYSNNYATHYAESVKG

SEQ ID NO: 11074 - protein, 11 aa, Artificial Sequence
  Description of Artificial Sequence: Synthetic peptide
  XENP019636 vhCDR3
YYGNYGGYFDV

SEQ ID NO: 11075 - protein, 11 aa, Artificial Sequence
  Description of Artificial Sequence: Synthetic peptide
  XENP019636 vlCDR1
RASQSVGNDVA

SEQ ID NO: 11076 - protein, 7 aa, Artificial Sequence
  Description of Artificial Sequence: Synthetic peptide
  XENP019636 vlCDR2
YASHRYT

SEQ ID NO: 11077 - protein, 9 aa, Artificial Sequence
  Description of Artificial Sequence: Synthetic peptide
  XENP019636 vlCDR3
QQDFSSPRT

SEQ ID NO: 11078 - protein, 249 aa, Artificial Sequence
  Description of Artificial Sequence: Synthetic polypeptide
  XENP019637 1G6_H1.278_L1.203_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11079 - protein, 122 aa, Artificial Sequence; identical to SEQ ID NO: 10845
  Description of Artificial Sequence: Synthetic polypeptide
  VH of XENP019637

SEQ ID NO: 11080 - protein, 107 aa, Artificial Sequence
  Description of Artificial Sequence: Synthetic polypeptide
  VL of XENP019637
EIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11081 - protein, 5 aa, Artificial Sequence
  Description of Artificial Sequence: Synthetic peptide
  XENP019637 vhCDR1
NYWMN

SEQ ID NO: 11082 - protein, 19 aa, Artificial Sequence
  Description of Artificial Sequence: Synthetic peptide
  XENP019637 vhCDR2
EIRLYSNNYATHYAESVKG

SEQ ID NO: 11083 - protein, 11 aa, Artificial Sequence
  Description of Artificial Sequence: Synthetic peptide
  XENP019637 vhCDR3
YYGNYGGYFDV

SEQ ID NO: 11084 - protein, 11 aa, Artificial Sequence
  Description of Artificial Sequence: Synthetic peptide
  XENP019637 vlCDR1
RASQSVGNDVA

SEQ ID NO: 11085 - protein, 7 aa, Artificial Sequence
  Description of Artificial Sequence: Synthetic peptide
  XENP019637 vlCDR2
YASHRYT

SEQ ID NO: 11086 - protein, 9 aa, Artificial Sequence
  Description of Artificial Sequence: Synthetic peptide
  XENP019637 vlCDR3
QQDFSSPRT

SEQ ID NO: 11087 - protein, 249 aa, Artificial Sequence
  Description of Artificial Sequence: Synthetic polypeptide
  XENP019638 1G6_H1.278_L1.204_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11088 - protein, 122 aa, Artificial Sequence; identical to SEQ ID NO: 10845
  Description of Artificial Sequence: Synthetic polypeptide
  VH of XENP019638

SEQ ID NO: 11089 - protein, 107 aa, Artificial Sequence
  Description of Artificial Sequence: Synthetic polypeptide
  VL of XENP019638
EIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11090 - protein, 5 aa, Artificial Sequence
  Description of Artificial Sequence: Synthetic peptide
  XENP019638 vhCDR1
NYWMN

SEQ ID NO: 11091 - protein, 19 aa, Artificial Sequence
  Description of Artificial Sequence: Synthetic peptide
  XENP019638 vhCDR2
EIRLYSNNYATHYAESVKG

SEQ ID NO: 11092 - protein, 11 aa, Artificial Sequence
  Description of Artificial Sequence: Synthetic peptide
  XENP019638 vhCDR3
YYGNYGGYFDV

SEQ ID NO: 11093 - protein, 11 aa, Artificial Sequence
  Description of Artificial Sequence: Synthetic peptide
  XENP019638 vlCDR1
RASQSVGNDVA

SEQ ID NO: 11094 - protein, 7 aa, Artificial Sequence
  Description of Artificial Sequence: Synthetic peptide
  XENP019638 vlCDR2
YASHRYT

SEQ ID NO: 11095 - protein, 9 aa, Artificial Sequence
  Description of Artificial Sequence: Synthetic peptide
  XENP019638 vlCDR3
QQDFSSPRT

SEQ ID NO: 11096 - protein, 249 aa, Artificial Sequence
  Description of Artificial Sequence: Synthetic polypeptide
  XENP019639 1G6_H1.278_L1.205_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIK

SEQ ID NO: 11097 - protein, 122 aa, Artificial Sequence; identical to SEQ ID NO: 10845
  Description of Artificial Sequence: Synthetic polypeptide
  VH of XENP019639

SEQ ID NO: 11098 - protein, 107 aa, Artificial Sequence
  Description of Artificial Sequence: Synthetic polypeptide
  VL of XENP019639
EIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIK

SEQ ID NO: 11099 - protein, 5 aa, Artificial Sequence
  Description of Artificial Sequence: Synthetic peptide
  XENP019639 vhCDR1
NYWMN

SEQ ID NO: 11100 - protein, 19 aa, Artificial Sequence
  Description of Artificial Sequence: Synthetic peptide
  XENP019639 vhCDR2
EIRLYSNNYATHYAESVKG

SEQ ID NO: 11101 - protein, 11 aa, Artificial Sequence
  Description of Artificial Sequence: Synthetic peptide
  XENP019639 vhCDR3
YYGNYGGYFDV

SEQ ID NO: 11102 - protein, 11 aa, Artificial Sequence
  Description of Artificial Sequence: Synthetic peptide
  XENP019639 vlCDR1
RASQSVGNDVA

SEQ ID NO: 11103 - protein, 7 aa, Artificial Sequence
  Description of Artificial Sequence: Synthetic peptide
  XENP019639 vlCDR2
YASHRYT

SEQ ID NO: 11104 - protein, 9 aa, Artificial Sequence
  Description of Artificial Sequence: Synthetic peptide
  XENP019639 vlCDR3
QQDFSSPRT

SEQ ID NO: 11105 - protein, 249 aa, Artificial Sequence
  Description of Artificial Sequence: Synthetic polypeptide
  XENP019640 1G6_H1.278_L1.206_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIK

SEQ ID NO: 11106 - protein, 122 aa, Artificial Sequence; identical to SEQ ID NO: 10845
  Description of Artificial Sequence: Synthetic polypeptide
  VH of XENP019640

SEQ ID NO: 11107 - protein, 107 aa, Artificial Sequence
  Description of Artificial Sequence: Synthetic polypeptide
  VL of XENP019640
EIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIK

SEQ ID NO: 11108 - protein, 5 aa, Artificial Sequence
  Description of Artificial Sequence: Synthetic peptide
  XENP019640 vhCDR1
NYWMN

SEQ ID NO: 11109 - protein, 19 aa, Artificial Sequence
  Description of Artificial Sequence: Synthetic peptide
  XENP019640 vhCDR2
EIRLYSNNYATHYAESVKG

SEQ ID NO: 11110 - protein, 11 aa, Artificial Sequence
  Description of Artificial Sequence: Synthetic peptide
  XENP019640 vhCDR3
YYGNYGGYFDV

SEQ ID NO: 11111 - protein, 11 aa, Artificial Sequence
  Description of Artificial Sequence: Synthetic peptide
  XENP019640 vlCDR1
RASQSVGNDVA

SEQ ID NO: 11112 - protein, 7 aa, Artificial Sequence
  Description of Artificial Sequence: Synthetic peptide
  XENP019640 vlCDR2
YASHRYT

SEQ ID NO: 11113 - protein, 9 aa, Artificial Sequence
  Description of Artificial Sequence: Synthetic peptide
  XENP019640 vlCDR3
QQDFSSPRT

SEQ ID NO: 11114 - protein, 249 aa, Artificial Sequence
  Description of Artificial Sequence: Synthetic polypeptide
  XENP019641 1G6_H1.278_L1.207_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIK

SEQ ID NO: 11115 - protein, 122 aa, Artificial Sequence; identical to SEQ ID NO: 10845
  Description of Artificial Sequence: Synthetic polypeptide
  VH of XENP019641

SEQ ID NO: 11116 - protein, 107 aa, Artificial Sequence
  Description of Artificial Sequence: Synthetic polypeptide
  VL of XENP019641
EIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIK

SEQ ID NO: 11117 - protein, 5 aa, Artificial Sequence
  Description of Artificial Sequence: Synthetic peptide
  XENP019641 vhCDR1
NYWMN

SEQ ID NO: 11118 - protein, 19 aa, Artificial Sequence
  Description of Artificial Sequence: Synthetic peptide
  XENP019641 vhCDR2
EIRLYSNNYATHYAESVKG

SEQ ID NO: 11119 - protein, 11 aa, Artificial Sequence
  Description of Artificial Sequence: Synthetic peptide
  XENP019641 vhCDR3
YYGNYGGYFDV

SEQ ID NO: 11120 - protein, 11 aa, Artificial Sequence
  Description of Artificial Sequence: Synthetic peptide
  XENP019641 vlCDR1
RASQSVGNDVA

SEQ ID NO: 11121 - protein, 7 aa, Artificial Sequence
  Description of Artificial Sequence: Synthetic peptide
  XENP019641 vlCDR2
YASHRYT

SEQ ID NO: 11122 - protein, 9 aa, Artificial Sequence
  Description of Artificial Sequence: Synthetic peptide
  XENP019641 vlCDR3
QQDFSSPRT

SEQ ID NO: 11123 - protein, 249 aa, Artificial Sequence
  Description of Artificial Sequence: Synthetic polypeptide
  XENP019642 1G6_H1.278_L1.208_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIK

SEQ ID NO: 11124 - protein, 122 aa, Artificial Sequence; identical to SEQ ID NO: 10845
  Description of Artificial Sequence: Synthetic polypeptide
  VH of XENP019642

SEQ ID NO: 11125 - protein, 107 aa, Artificial Sequence
  Description of Artificial Sequence: Synthetic polypeptide
  VL of XENP019642
EIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIK

SEQ ID NO: 11126 - protein, 5 aa, Artificial Sequence
  Description of Artificial Sequence: Synthetic peptide
  XENP019642 vhCDR1
NYWMN

SEQ ID NO: 11127 - protein, 19 aa, Artificial Sequence
  Description of Artificial Sequence: Synthetic peptide
  XENP019642 vhCDR2
EIRLYSNNYATHYAESVKG

SEQ ID NO: 11128 - protein, 11 aa, Artificial Sequence
  Description of Artificial Sequence: Synthetic peptide
  XENP019642 vhCDR3
YYGNYGGYFDV

SEQ ID NO: 11129 - protein, 11 aa, Artificial Sequence
  Description of Artificial Sequence: Synthetic peptide
  XENP019642 vlCDR1
RASQSVGNDVA

SEQ ID NO: 11130 - protein, 7 aa, Artificial Sequence
  Description of Artificial Sequence: Synthetic peptide
  XENP019642 vlCDR2
YASHRYT

SEQ ID NO: 11131 - protein, 9 aa, Artificial Sequence
  Description of Artificial Sequence: Synthetic peptide
  XENP019642 vlCDR3
QQDFSSPRT

SEQ ID NO: 11132 - protein, 249 aa, Artificial Sequence
  Description of Artificial Sequence: Synthetic polypeptide
  XENP019643 1G6_L1.189_H1.279_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 11133 - protein, 107 aa, Artificial Sequence; identical to SEQ ID NO: 10864
  Description of Artificial Sequence: Synthetic polypeptide
  VH of XENP019643

SEQ ID NO: 11134 - protein, 122 aa, Artificial Sequence; identical to SEQ ID NO: 10908
  Description of Artificial Sequence: Synthetic polypeptide
  VL of XENP019643

SEQ ID NO: 11135 - protein, 11 aa, Artificial Sequence
  Description of Artificial Sequence: Synthetic peptide
  XENP019643 vhCDR1
RASQSVGNDVA

SEQ ID NO: 11136 - protein, 7 aa, Artificial Sequence
  Description of Artificial Sequence: Synthetic peptide
  XENP019643 vhCDR2
YASHRYT

SEQ ID NO: 11137 - protein, 9 aa, Artificial Sequence
  Description of Artificial Sequence: Synthetic peptide
  XENP019643 vhCDR3
QQDFSSPRT

SEQ ID NO: 11138 - protein, 5 aa, Artificial Sequence
  Description of Artificial Sequence: Synthetic peptide
  XENP019643 vlCDR1
NYWMN

SEQ ID NO: 11139 - protein, 19 aa, Artificial Sequence
  Description of Artificial Sequence: Synthetic peptide
  XENP019643 vlCDR2
EIRLYSNNYATHYAESVKG

SEQ ID NO: 11140 - protein, 11 aa, Artificial Sequence
  Description of Artificial Sequence: Synthetic peptide
  XENP019643 vlCDR3
YYGNYGGYFDV

SEQ ID NO: 11141 - protein, 249 aa, Artificial Sequence
  Description of Artificial Sequence: Synthetic polypeptide
  XENP019644 1G6_L1.189_H1.280_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 11142 - protein, 107 aa, Artificial Sequence; identical to SEQ ID NO: 10864
  Description of Artificial Sequence: Synthetic polypeptide
  VH of XENP019644

SEQ ID NO: 11143 - protein, 122 aa, Artificial Sequence; identical to SEQ ID NO: 10917
  Description of Artificial Sequence: Synthetic polypeptide
  VL of XENP019644

SEQ ID NO: 11144 - protein, 11 aa, Artificial Sequence
  Description of Artificial Sequence: Synthetic peptide
  XENP019644 vhCDR1
RASQSVGNDVA

SEQ ID NO: 11145 - protein, 7 aa, Artificial Sequence
  Description of Artificial Sequence: Synthetic peptide
  XENP019644 vhCDR2
YASHRYT

SEQ ID NO: 11146 - protein, 9 aa, Artificial Sequence
  Description of Artificial Sequence: Synthetic peptide
  XENP019644 vhCDR3
QQDFSSPRT

SEQ ID NO: 11147 - protein, 5 aa, Artificial Sequence
  Description of Artificial Sequence: Synthetic peptide
  XENP019644 vlCDR1
NYWMN

SEQ ID NO: 11148 - protein, 19 aa, Artificial Sequence
  Description of Artificial Sequence: Synthetic peptide
  XENP019644 vlCDR2
EIRLYSNNYATHYAESVKG

SEQ ID NO: 11149 - protein, 11 aa, Artificial Sequence
  Description of Artificial Sequence: Synthetic peptide
  XENP019644 vlCDR3
YYGNYGGYFDV

SEQ ID NO: 11150 - protein, 249 aa, Artificial Sequence
  Description of Artificial Sequence: Synthetic polypeptide
  XENP019645 1G6_L1.189_H1.281_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 11151 - protein, 107 aa, Artificial Sequence; identical to SEQ ID NO: 10864
  Description of Artificial Sequence: Synthetic polypeptide
  VH of XENP019645

SEQ ID NO: 11152 - protein, 122 aa, Artificial Sequence; identical to SEQ ID NO: 10926
  Description of Artificial Sequence: Synthetic polypeptide
  VL of XENP019645

SEQ ID NO: 11153 - protein, 11 aa, Artificial Sequence
  Description of Artificial Sequence: Synthetic peptide
  XENP019645 vhCDR1
RASQSVGNDVA

SEQ ID NO: 11154 - protein, 7 aa, Artificial Sequence
  Description of Artificial Sequence: Synthetic peptide
  XENP019645 vhCDR2
YASHRYT

SEQ ID NO: 11155 - protein, 9 aa, Artificial Sequence
  Description of Artificial Sequence: Synthetic peptide
  XENP019645 vhCDR3
QQDFSSPRT

SEQ ID NO: 11156 - protein, 5 aa, Artificial Sequence
  Description of Artificial Sequence: Synthetic peptide
  XENP019645 vlCDR1
NYWMN

SEQ ID NO: 11157 - protein, 19 aa, Artificial Sequence
  Description of Artificial Sequence: Synthetic peptide
  XENP019645 vlCDR2
EIRLYSNNYATHYAESVKG

SEQ ID NO: 11158 - protein, 11 aa, Artificial Sequence
  Description of Artificial Sequence: Synthetic peptide
  XENP019645 vlCDR3
YYGNYGGYFDV

SEQ ID NO: 11159 - protein, 249 aa, Artificial Sequence
  Description of Artificial Sequence: Synthetic polypeptide
  XENP019646 1G6_L1.189_H1.282_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 11160 - protein, 107 aa, Artificial Sequence; identical to SEQ ID NO: 10864
  Description of Artificial Sequence: Synthetic polypeptide
  VH of XENP019646

SEQ ID NO: 11161 - protein, 122 aa, Artificial Sequence; identical to SEQ ID NO: 10935
  Description of Artificial Sequence: Synthetic polypeptide
  VL of XENP019646

SEQ ID NO: 11162 - protein, 11 aa, Artificial Sequence
  Description of Artificial Sequence: Synthetic peptide
  XENP019646 vhCDR1
RASQSVGNDVA

SEQ ID NO: 11163 - protein, 7 aa, Artificial Sequence
  Description of Artificial Sequence: Synthetic peptide
  XENP019646 vhCDR2
YASHRYT

SEQ ID NO: 11164 - protein, 9 aa, Artificial Sequence
  Description of Artificial Sequence: Synthetic peptide
  XENP019646 vhCDR3
QQDFSSPRT

SEQ ID NO: 11165 - protein, 5 aa, Artificial Sequence
  Description of Artificial Sequence: Synthetic peptide
  XENP019646 vlCDR1
NYWMN

SEQ ID NO: 11166 - protein, 19 aa, Artificial Sequence
  Description of Artificial Sequence: Synthetic peptide
  XENP019646 vlCDR2
EIRLYSNNYATHYAESVKG

SEQ ID NO: 11167 - protein, 11 aa, Artificial Sequence
  Description of Artificial Sequence: Synthetic peptide
  XENP019646 vlCDR3
YYGNYGGYFDV

SEQ ID NO: 11168 - protein, 249 aa, Artificial Sequence
  Description of Artificial Sequence: Synthetic polypeptide
  XENP019647 1G6_L1.189_H1.283_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSS

SEQ ID NO: 11169 - protein, 107 aa, Artificial Sequence; identical to SEQ ID NO: 10864
  Description of Artificial Sequence: Synthetic polypeptide
  VH of XENP019647

SEQ ID NO: 11170 - protein, 122 aa, Artificial Sequence; identical to SEQ ID NO: 10944
  Description of Artificial Sequence: Synthetic polypeptide
  VL of XENP019647

SEQ ID NO: 11171 - protein, 11 aa, Artificial Sequence
  Description of Artificial Sequence: Synthetic peptide
  XENP019647 vhCDR1
RASQSVGNDVA

SEQ ID NO: 11172 - protein, 7 aa, Artificial Sequence
  Description of Artificial Sequence: Synthetic peptide
  XENP019647 vhCDR2
YASHRYT

SEQ ID NO: 11173 - protein, 9 aa, Artificial Sequence
  Description of Artificial Sequence: Synthetic peptide
  XENP019647 vhCDR3
QQDFSSPRT

SEQ ID NO: 11174 - protein, 5 aa, Artificial Sequence
  Description of Artificial Sequence: Synthetic peptide
  XENP019647 vlCDR1
NYWMN

SEQ ID NO: 11175 - protein, 19 aa, Artificial Sequence
  Description of Artificial Sequence: Synthetic peptide
  XENP019647 vlCDR2
EIRLYSNNYATHYAESVKG

SEQ ID NO: 11176 - protein, 11 aa, Artificial Sequence
  Description of Artificial Sequence: Synthetic peptide
  XENP019647 vlCDR3
YYGNYGGYFDV

SEQ ID NO: 11177 - protein, 249 aa, Artificial Sequence
  Description of Artificial Sequence: Synthetic polypeptide
  XENP019648 1G6_L1.189_H1.284_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 11178 - protein, 107 aa, Artificial Sequence; identical to SEQ ID NO: 10864
  Description of Artificial Sequence: Synthetic polypeptide
  VH of XENP019648

SEQ ID NO: 11179 - protein, 122 aa, Artificial Sequence; identical to SEQ ID NO: 10953
  Description of Artificial Sequence: Synthetic polypeptide
  VL of XENP019648

SEQ ID NO: 11180 - protein, 11 aa, Artificial Sequence
  Description of Artificial Sequence: Synthetic peptide
  XENP019648 vhCDR1
RASQSVGNDVA

SEQ ID NO: 11181 - protein, 7 aa, Artificial Sequence
  Description of Artificial Sequence: Synthetic peptide
  XENP019648 vhCDR2
YASHRYT

SEQ ID NO: 11182 - protein, 9 aa, Artificial Sequence
  Description of Artificial Sequence: Synthetic peptide
  XENP019648 vhCDR3
QQDFSSPRT

SEQ ID NO: 11183 - protein, 5 aa, Artificial Sequence
  Description of Artificial Sequence: Synthetic peptide
  XENP019648 vlCDR1
NYWMN

SEQ ID NO: 11184 - protein, 19 aa, Artificial Sequence
  Description of Artificial Sequence: Synthetic peptide
  XENP019648 vlCDR2
EIRLYSNNYATHYAESVKG

SEQ ID NO: 11185 - protein, 11 aa, Artificial Sequence
  Description of Artificial Sequence: Synthetic peptide
  XENP019648 vlCDR3
YYGNYGGYFDV

SEQ ID NO: 11186 - protein, 249 aa, Artificial Sequence
  Description of Artificial Sequence: Synthetic polypeptide
  XENP019649 1G6_L1.189_H1.285_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSS

SEQ ID NO: 11187 - protein, 107 aa, Artificial Sequence; identical to SEQ ID NO: 10864
  Description of Artificial Sequence: Synthetic polypeptide
  VH of XENP019649

SEQ ID NO: 11188 - protein, 122 aa, Artificial Sequence; identical to SEQ ID NO: 10962
  Description of Artificial Sequence: Synthetic polypeptide
  VL of XENP019649

SEQ ID NO: 11189 - protein, 11 aa, Artificial Sequence
  Description of Artificial Sequence: Synthetic peptide
  XENP019649 vhCDR1
RASQSVGNDVA

SEQ ID NO: 11190 - protein, 7 aa, Artificial Sequence
  Description of Artificial Sequence: Synthetic peptide
  XENP019649 vhCDR2
YASHRYT

SEQ ID NO: 11191 - protein, 9 aa, Artificial Sequence
  Description of Artificial Sequence: Synthetic peptide
  XENP019649 vhCDR3
QQDFSSPRT

SEQ ID NO: 11192 - protein, 5 aa, Artificial Sequence
  Description of Artificial Sequence: Synthetic peptide
  XENP019649 vlCDR1
NYWMN

SEQ ID NO: 11193 - protein, 19 aa, Artificial Sequence
  Description of Artificial Sequence: Synthetic peptide
  XENP019649 vlCDR2
EIRLYSNNYATHYAESVKG

SEQ ID NO: 11194 - protein, 11 aa, Artificial Sequence
  Description of Artificial Sequence: Synthetic peptide
  XENP019649 vlCDR3
YYGNYGGYFDV

SEQ ID NO: 11195 - protein, 249 aa, Artificial Sequence
  Description of Artificial Sequence: Synthetic polypeptide
  XENP019650 1G6_L1.192_H1.278_scFv(GKPGS)4
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11196 - protein, 107 aa, Artificial Sequence; identical to SEQ ID NO: 10981
  Description of Artificial Sequence: Synthetic polypeptide
  VH of XENP019650

SEQ ID NO: 11197 - protein, 122 aa, Artificial Sequence; identical to SEQ ID NO: 10845
  Description of Artificial Sequence: Synthetic polypeptide
  VL of XENP019650

SEQ ID NO: 11198 - protein, 11 aa, Artificial Sequence
  Description of Artificial Sequence: Synthetic peptide
  XENP019650 vhCDR1
RASQSVGNDVA

SEQ ID NO: 11199 - protein, 7 aa, Artificial Sequence
  Description of Artificial Sequence: Synthetic peptide
  XENP019650 vhCDR2
YASHRYT

SEQ ID NO: 11200 - protein, 9 aa, Artificial Sequence
  Description of Artificial Sequence: Synthetic peptide
  XENP019650 vhCDR3
QQDFSSPRT

SEQ ID NO: 11201 - protein, 5 aa, Artificial Sequence
  Description of Artificial Sequence: Synthetic peptide
  XENP019650 vlCDR1
NYWMN

SEQ ID NO: 11202 - protein, 19 aa, Artificial Sequence
  Description of Artificial Sequence: Synthetic peptide
  XENP019650 vlCDR2
EIRLYSNNYATHYAESVKG

SEQ ID NO: 11203 - protein, 11 aa, Artificial Sequence
  Description of Artificial Sequence: Synthetic peptide
  XENP019650 vlCDR3
YYGNYGGYFDV

SEQ ID NO: 11204 - protein, 249 aa, Artificial Sequence
  Description of Artificial Sequence: Synthetic polypeptide
  XENP019651 1G6_L1.193_H1.278_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11205 - protein, 107 aa, Artificial Sequence; identical to SEQ ID NO: 10990
  Description of Artificial Sequence: Synthetic polypeptide
  VH of XENP019651

SEQ ID NO: 11206 - protein, 122 aa, Artificial Sequence; identical to SEQ ID NO: 10845
  Description of Artificial Sequence: Synthetic polypeptide
  VL of XENP019651

SEQ ID NO: 11207 - protein, 11 aa, Artificial Sequence
  Description of Artificial Sequence: Synthetic peptide
  XENP019651 vhCDR1
RASQSVGNDVA

SEQ ID NO: 11208 - protein, 7 aa, Artificial Sequence
  Description of Artificial Sequence: Synthetic peptide
  XENP019651 vhCDR2
YASHRYT

SEQ ID NO: 11209 - protein, 9 aa, Artificial Sequence
  Description of Artificial Sequence: Synthetic peptide
  XENP019651 vhCDR3
QQDFSSPRT

SEQ ID NO: 11210 - protein, 5 aa, Artificial Sequence
  Description of Artificial Sequence: Synthetic peptide
  XENP019651 vlCDR1
NYWMN

SEQ ID NO: 11211 - protein, 19 aa, Artificial Sequence
  Description of Artificial Sequence: Synthetic peptide
  XENP019651 vlCDR2
EIRLYSNNYATHYAESVKG

SEQ ID NO: 11212 - protein, 11 aa, Artificial Sequence
  Description of Artificial Sequence: Synthetic peptide
  XENP019651 vlCDR3
YYGNYGGYFDV

SEQ ID NO: 11213 - protein, 249 aa, Artificial Sequence
  Description of Artificial Sequence: Synthetic polypeptide
  XENP019652 1G6_L1.194_H1.278_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11214 - protein, 107 aa, Artificial Sequence; identical to SEQ ID NO: 10999
  Description of Artificial Sequence: Synthetic polypeptide
  VH of XENP019652

SEQ ID NO: 11215 - protein, 122 aa, Artificial Sequence; identical to SEQ ID NO: 10845
  Description of Artificial Sequence: Synthetic polypeptide
  VL of XENP019652

SEQ ID NO: 11216 - protein, 11 aa, Artificial Sequence
  Description of Artificial Sequence: Synthetic peptide
  XENP019652 vhCDR1
RASQSVGNDVA

SEQ ID NO: 11217 - protein, 7 aa, Artificial Sequence
  Description of Artificial Sequence: Synthetic peptide
  XENP019652 vhCDR2
YASHRYT

SEQ ID NO: 11218 - protein, 9 aa, Artificial Sequence
  Description of Artificial Sequence: Synthetic peptide
  XENP019652 vhCDR3
QQDFSSPRT

SEQ ID NO: 11219 - protein, 5 aa, Artificial Sequence
  Description of Artificial Sequence: Synthetic peptide
  XENP019652 vlCDR1
NYWMN

SEQ ID NO: 11220 - protein, 19 aa, Artificial Sequence
  Description of Artificial Sequence: Synthetic peptide
  XENP019652 vlCDR2
EIRLYSNNYATHYAESVKG

SEQ ID NO: 11221 - protein, 11 aa, Artificial Sequence
  Description of Artificial Sequence: Synthetic peptide
  XENP019652 vlCDR3
YYGNYGGYFDV

SEQ ID NO: 11222 - protein, 249 aa, Artificial Sequence
  Description of Artificial Sequence: Synthetic polypeptide
  XENP019653 1G6_L1.195_H1.278_scFv(GKPGS)4
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11223 - protein, 107 aa, Artificial Sequence; identical to SEQ ID NO: 11008
  Description of Artificial Sequence: Synthetic polypeptide
  VH of XENP019653

SEQ ID NO: 11224 - protein, 122 aa, Artificial Sequence; identical to SEQ ID NO: 10845
  Description of Artificial Sequence: Synthetic polypeptide
  VL of XENP019653

SEQ ID NO: 11225 - protein, 11 aa, Artificial Sequence
  Description of Artificial Sequence: Synthetic peptide
  XENP019653 vhCDR1
RASQSVGNDVA

SEQ ID NO: 11226 - protein, 9 aa, Artificial Sequence
  Description of Artificial Sequence: Synthetic peptide
  XENP019653 vhCDR2
CNYASHRYT

SEQ ID NO: 11227 - protein, 9 aa, Artificial Sequence
  Description of Artificial Sequence: Synthetic peptide
  XENP019653 vhCDR3
QQDFSSPRT

SEQ ID NO: 11228 - protein, 5 aa, Artificial Sequence
  Description of Artificial Sequence: Synthetic peptide
  XENP019653 vlCDR1
NYWMN

SEQ ID NO: 11229 - protein, 19 aa, Artificial Sequence
  Description of Artificial Sequence: Synthetic peptide
  XENP019653 vlCDR2
EIRLYSNNYATHYAESVKG

SEQ ID NO: 11230 - protein, 11 aa, Artificial Sequence
  Description of Artificial Sequence: Synthetic peptide
  XENP019653 vlCDR3
YYGNYGGYFDV

SEQ ID NO: 11231 - protein, 249 aa, Artificial Sequence
  Description of Artificial Sequence: Synthetic polypeptide
  XENP019654 1G6_L1.196_H1.278_scFv(GKPGS)4
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11232 - protein, 107 aa, Artificial Sequence; identical to SEQ ID NO: 11017
  Description of Artificial Sequence: Synthetic polypeptide
  VH of XENP019654

SEQ ID NO: 11233 - protein, 122 aa, Artificial Sequence; identical to SEQ ID NO: 10845
  Description of Artificial Sequence: Synthetic polypeptide
  VL of XENP019654

SEQ ID NO: 11234 - protein, 11 aa, Artificial Sequence
  Description of Artificial Sequence: Synthetic peptide
  XENP019654 vhCDR1
RASQSVGNDVA

SEQ ID NO: 11235 - protein, 9 aa, Artificial Sequence
  Description of Artificial Sequence: Synthetic peptide
  XENP019654 vhCDR2
CNYASHRYT

SEQ ID NO: 11236 - protein, 9 aa, Artificial Sequence
  Description of Artificial Sequence: Synthetic peptide
  XENP019654 vhCDR3
QQDFSSPRT

SEQ ID NO: 11237 - protein, 5 aa, Artificial Sequence
  Description of Artificial Sequence: Synthetic peptide
  XENP019654 vlCDR1
NYWMN

SEQ ID NO: 11238 - protein, 19 aa, Artificial Sequence
  Description of Artificial Sequence: Synthetic peptide
  XENP019654 vlCDR2
EIRLYSNNYATHYAESVKG

SEQ ID NO: 11239 - protein, 11 aa, Artificial Sequence
  Description of Artificial Sequence: Synthetic peptide
  XENP019654 vlCDR3
YYGNYGGYFDV

SEQ ID NO: 11240 - protein, 249 aa, Artificial Sequence
  Description of Artificial Sequence: Synthetic polypeptide
  XENP019655 1G6_L1.197_H1.278_scFv(GKPGS)4
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSS

SEQ ID NO: 11241 - protein, 107 aa, Artificial Sequence; identical to SEQ ID NO: 11026
  Description of Artificial Sequence: Synthetic polypeptide
  VH of XENP019655

SEQ ID NO: 11242 - protein, 122 aa, Artificial Sequence; identical to SEQ ID NO: 10845
  Description of Artificial Sequence: Synthetic polypeptide
  VL of XENP019655

SEQ ID NO: 11243 - protein, 11 aa, Artificial Sequence
  Description of Artificial Sequence: Synthetic peptide
  XENP019655 vhCDR1
RASQSVGNDVA

SEQ ID NO: 11244 - protein, 9 aa, Artificial Sequence
  Description of Artificial Sequence: Synthetic peptide
  XENP019655 vhCDR2
CNYASHRYT

SEQ ID NO: 11245 - protein, 9 aa, Artificial Sequence
  Description of Artificial Sequence: Synthetic peptide
  XENP019655 vhCDR3
QQDFSSPRT

SEQ ID NO: 11246 - protein, 5 aa, Artificial Sequence
  Description of Artificial Sequence: Synthetic peptide
  XENP019655 vlCDR1
NYWMN

SEQ ID NO: 11247 - protein, 19 aa, Artificial Sequence
  Description of Artificial Sequence: Synthetic peptide
  XENP019655 vlCDR2
EIRLYSNNYATHYAESVKG

SEQ ID NO: 11248 - protein, 11 aa, Artificial Sequence
  Description of Artificial Sequence: Synthetic peptide
  XENP019655 vlCDR3
YYGNYGGYFDV

SEQ ID NO: 11249 - protein, 249 aa, Artificial Sequence
  Description of Artificial Sequence: Synthetic polypeptide
  XENP019656 1G6_H1.278_L1.189_scFv_linkerV1
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11250 - protein, 122 aa, Artificial Sequence; identical to SEQ ID NO: 10845
  Description of Artificial Sequence: Synthetic polypeptide
  VH of XENP019656

SEQ ID NO: 11251 - protein, 107 aa, Artificial Sequence; identical to SEQ ID NO: 10864
  Description of Artificial Sequence: Synthetic polypeptide
  VL of XENP019656

SEQ ID NO: 11252 - protein, 5 aa, Artificial Sequence
  Description of Artificial Sequence: Synthetic peptide
  XENP019656 vhCDR1
NYWMN

SEQ ID NO: 11253 - protein, 19 aa, Artificial Sequence
  Description of Artificial Sequence: Synthetic peptide
  XENP019656 vhCDR2
EIRLYSNNYATHYAESVKG

SEQ ID NO: 11254 - protein, 11 aa, Artificial Sequence
  Description of Artificial Sequence: Synthetic peptide
  XENP019656 vhCDR3
YYGNYGGYFDV

SEQ ID NO: 11255 - protein, 11 aa, Artificial Sequence
  Description of Artificial Sequence: Synthetic peptide
  XENP019656 vlCDR1
RASQSVGNDVA

SEQ ID NO: 11256 - protein, 7 aa, Artificial Sequence
  Description of Artificial Sequence: Synthetic peptide
  XENP019656 vlCDR2
YASHRYT

SEQ ID NO: 11257 - protein, 9 aa, Artificial Sequence
  Description of Artificial Sequence: Synthetic peptide
  XENP019656 vlCDR3
QQDFSSPRT

SEQ ID NO: 11258 - protein, 247 aa, Artificial Sequence
  Description of Artificial Sequence: Synthetic polypeptide
  XENP019657 1G6_H1.278_L1.189_scFv_linkerV2
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11259 - protein, 122 aa, Artificial Sequence; identical to SEQ ID NO: 10845
  Description of Artificial Sequence: Synthetic polypeptide
  VH of XENP019657

SEQ ID NO: 11260 - protein, 107 aa, Artificial Sequence; identical to SEQ ID NO: 10864
  Description of Artificial Sequence: Synthetic polypeptide
  VL of XENP019657

SEQ ID NO: 11261 - protein, 5 aa, Artificial Sequence
  Description of Artificial Sequence: Synthetic peptide
  XENP019657 vhCDR1
NYWMN

SEQ ID NO: 11262 - protein, 19 aa, Artificial Sequence
  Description of Artificial Sequence: Synthetic peptide
  XENP019657 vhCDR2
EIRLYSNNYATHYAESVKG

SEQ ID NO: 11263 - protein, 11 aa, Artificial Sequence
  Description of Artificial Sequence: Synthetic peptide
  XENP019657 vhCDR3
YYGNYGGYFDV

SEQ ID NO: 11264 - protein, 11 aa, Artificial Sequence
  Description of Artificial Sequence: Synthetic peptide
  XENP019657 vlCDR1
RASQSVGNDVA

SEQ ID NO: 11265 - protein, 7 aa, Artificial Sequence
  Description of Artificial Sequence: Synthetic peptide
  XENP019657 vlCDR2
YASHRYT

SEQ ID NO: 11266 - protein, 9 aa, Artificial Sequence
  Description of Artificial Sequence: Synthetic peptide
  XENP019657 vlCDR3
QQDFSSPRT

SEQ ID NO: 11267 - protein, 244 aa, Artificial Sequence
  Description of Artificial Sequence: Synthetic polypeptide
  XENP019658 1G6_H1.278_L1.189_scFv_linkerV3
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11268 - protein, 122 aa, Artificial Sequence; identical to SEQ ID NO: 10845
  Description of Artificial Sequence: Synthetic polypeptide
  VH of XENP019658

SEQ ID NO: 11269 - protein, 107 aa, Artificial Sequence; identical to SEQ ID NO: 10864
  Description of Artificial Sequence: Synthetic polypeptide
  VL of XENP019658

SEQ ID NO: 11270 - protein, 5 aa, Artificial Sequence
  Description of Artificial Sequence: Synthetic peptide
  XENP019658 vhCDR1
NYWMN

SEQ ID NO: 11271 - protein, 19 aa, Artificial Sequence
  Description of Artificial Sequence: Synthetic peptide
  XENP019658 vhCDR2
EIRLYSNNYATHYAESVKG

SEQ ID NO: 11272 - protein, 11 aa, Artificial Sequence
  Description of Artificial Sequence: Synthetic peptide
  XENP019658 vhCDR3
YYGNYGGYFDV

SEQ ID NO: 11273 - protein, 11 aa, Artificial Sequence
  Description of Artificial Sequence: Synthetic peptide
  XENP019658 vlCDR1
RASQSVGNDVA

SEQ ID NO: 11274 - protein, 7 aa, Artificial Sequence
  Description of Artificial Sequence: Synthetic peptide
  XENP019658 vlCDR2
YASHRYT

SEQ ID NO: 11275 - protein, 9 aa, Artificial Sequence
  Description of Artificial Sequence: Synthetic peptide
  XENP019658 vlCDR3
QQDFSSPRT

SEQ ID NO: 11276 - protein, 251 aa, Artificial Sequence
  Description of Artificial Sequence: Synthetic polypeptide
  XENP019659 1G6_H1.278_L1.189_scFv_linkerV4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11277 - protein, 122 aa, Artificial Sequence; identical to SEQ ID NO: 10845
  Description of Artificial Sequence: Synthetic polypeptide
  VH of XENP019659

SEQ ID NO: 11278 - protein, 107 aa, Artificial Sequence; identical to SEQ ID NO: 10864
  Description of Artificial Sequence: Synthetic polypeptide
  VL of XENP019659

SEQ ID NO: 11279 - protein, 5 aa, Artificial Sequence
  Description of Artificial Sequence: Synthetic peptide
  XENP019659 vhCDR1
NYWMN

SEQ ID NO: 11280 - protein, 19 aa, Artificial Sequence
  Description of Artificial Sequence: Synthetic peptide
  XENP019659 vhCDR2
EIRLYSNNYATHYAESVKG

SEQ ID NO: 11281 - protein, 11 aa, Artificial Sequence
  Description of Artificial Sequence: Synthetic peptide
  XENP019659 vhCDR3
YYGNYGGYFDV

SEQ ID NO: 11282 - protein, 11 aa, Artificial Sequence
  Description of Artificial Sequence: Synthetic peptide
  XENP019659 vlCDR1
RASQSVGNDVA

SEQ ID NO: 11283 - protein, 7 aa, Artificial Sequence
  Description of Artificial Sequence: Synthetic peptide
  XENP019659 vlCDR2
YASHRYT

SEQ ID NO: 11284 - protein, 9 aa, Artificial Sequence
  Description of Artificial Sequence: Synthetic peptide
  XENP019659 vlCDR3
QQDFSSPRT

SEQ ID NO: 11285 - protein, 252 aa, Artificial Sequence
  Description of Artificial Sequence: Synthetic polypeptide
  XENP019660 1G6_H1.278_L1.189_scFv_linkerV5
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11286 - protein, 122 aa, Artificial Sequence; identical to SEQ ID NO: 10845
  Description of Artificial Sequence: Synthetic polypeptide
  VH of XENP019660

SEQ ID NO: 11287 - protein, 108 aa, Artificial Sequence
  Description of Artificial Sequence: Synthetic polypeptide
  VL of XENP019660
SEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11288 - protein, 5 aa, Artificial Sequence
  Description of Artificial Sequence: Synthetic peptide
  XENP019660 vhCDR1
NYWMN

SEQ ID NO: 11289 - protein, 19 aa, Artificial Sequence
  Description of Artificial Sequence: Synthetic peptide
  XENP019660 vhCDR2
EIRLYSNNYATHYAESVKG

SEQ ID NO: 11290 - protein, 11 aa, Artificial Sequence
  Description of Artificial Sequence: Synthetic peptide
  XENP019660 vhCDR3
YYGNYGGYFDV

SEQ ID NO: 11291 - protein, 11 aa, Artificial Sequence
  Description of Artificial Sequence: Synthetic peptide
  XENP019660 vlCDR1
RASQSVGNDVA

SEQ ID NO: 11292 - protein, 7 aa, Artificial Sequence
  Description of Artificial Sequence: Synthetic peptide
  XENP019660 vlCDR2
YASHRYT

SEQ ID NO: 11293 - protein, 9 aa, Artificial Sequence
  Description of Artificial Sequence: Synthetic peptide
  XENP019660 vlCDR3
QQDFSSPRT

SEQ ID NO: 11294 - protein, 253 aa, Artificial Sequence
  Description of Artificial Sequence: Synthetic polypeptide
  XENP019661 1G6_H1.278_L1.189_scFv_linkerV6
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11295 - protein, 122 aa, Artificial Sequence; identical to SEQ ID NO: 10845
  Description of Artificial Sequence: Synthetic polypeptide
  VH of XENP019661

SEQ ID NO: 11296 - protein, 107 aa, Artificial Sequence; identical to SEQ ID NO: 10864
  Description of Artificial Sequence: Synthetic polypeptide
  VL of XENP019661

SEQ ID NO: 11297 - protein, 5 aa, Artificial Sequence
  Description of Artificial Sequence: Synthetic peptide
  XENP019661 vhCDR1
NYWMN

SEQ ID NO: 11298 - protein, 19 aa, Artificial Sequence
  Description of Artificial Sequence: Synthetic peptide
  XENP019661 vhCDR2
EIRLYSNNYATHYAESVKG

SEQ ID NO: 11299 - protein, 11 aa, Artificial Sequence
  Description of Artificial Sequence: Synthetic peptide
  XENP019661 vhCDR3
YYGNYGGYFDV

SEQ ID NO: 11300 - protein, 11 aa, Artificial Sequence
  Description of Artificial Sequence: Synthetic peptide
  XENP019661 vlCDR1
RASQSVGNDVA

SEQ ID NO: 11301 - protein, 7 aa, Artificial Sequence
  Description of Artificial Sequence: Synthetic peptide
  XENP019661 vlCDR2
YASHRYT

SEQ ID NO: 11302 - protein, 9 aa, Artificial Sequence
  Description of Artificial Sequence: Synthetic peptide
  XENP019661 vlCDR3
QQDFSSPRT

SEQ ID NO: 11303 - protein, 254 aa, Artificial Sequence
  Description of Artificial Sequence: Synthetic polypeptide
  XENP019662 1G6_H1.278_L1.189_scFv_linkerV7
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSGGGGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11304 - protein, 122 aa, Artificial Sequence; identical to SEQ ID NO: 10845
  Description of Artificial Sequence: Synthetic polypeptide
  VH of XENP019662

SEQ ID NO: 11305 - protein, 107 aa, Artificial Sequence; identical to SEQ ID NO: 10864
  Description of Artificial Sequence: Synthetic polypeptide
  VL of XENP019662

SEQ ID NO: 11306 - protein, 5 aa, Artificial Sequence
  Description of Artificial Sequence: Synthetic peptide
  XENP019662 vhCDR1
NYWMN

SEQ ID NO: 11307 - protein, 19 aa, Artificial Sequence
  Description of Artificial Sequence: Synthetic peptide
  XENP019662 vhCDR2
EIRLYSNNYATHYAESVKG

SEQ ID NO: 11308 - protein, 11 aa, Artificial Sequence
  Description of Artificial Sequence: Synthetic peptide
  XENP019662 vhCDR3
YYGNYGGYFDV

SEQ ID NO: 11309 - protein, 11 aa, Artificial Sequence
  Description of Artificial Sequence: Synthetic peptide
  XENP019662 vlCDR1
RASQSVGNDVA

SEQ ID NO: 11310 - protein, 7 aa, Artificial Sequence
  Description of Artificial Sequence: Synthetic peptide
  XENP019662 vlCDR2
YASHRYT

SEQ ID NO: 11311 - protein, 9 aa, Artificial Sequence
  Description of Artificial Sequence: Synthetic peptide
  XENP019662 vlCDR3
QQDFSSPRT

SEQ ID NO: 11312 - protein, 242 aa, Artificial Sequence
  Description of Artificial Sequence: Synthetic polypeptide
  XENP019663 1G6_H1.278_L1.189_scFv_linkerV8
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIK

SEQ ID NO: 11313 - protein, 122 aa, Artificial Sequence; identical to SEQ ID NO: 10845
  Description of Artificial Sequence: Synthetic polypeptide
  VH of XENP019663

SEQ ID NO: 11314 - protein, 107 aa, Artificial Sequence; identical to SEQ ID NO: 10864
  Description of Artificial Sequence: Synthetic polypeptide
  VL of XENP019663

SEQ ID NO: 11315 - protein, 5 aa, Artificial Sequence
  Description of Artificial Sequence: Synthetic peptide
  XENP019663 vhCDR1
NYWMN

SEQ ID NO: 11316 - protein, 19 aa, Artificial Sequence
  Description of Artificial Sequence: Synthetic peptide
  XENP019663 vhCDR2
EIRLYSNNYATHYAESVKG

SEQ ID NO: 11317 - protein, 11 aa, Artificial Sequence
  Description of Artificial Sequence: Synthetic peptide
  XENP019663 vhCDR3
YYGNYGGYFDV

SEQ ID NO: 11318 - protein, 11 aa, Artificial Sequence
  Description of Artificial Sequence: Synthetic peptide
  XENP019663 vlCDR1
RASQSVGNDVA

SEQ ID NO: 11319 - protein, 7 aa, Artificial Sequence
  Description of Artificial Sequence: Synthetic peptide
  XENP019663 vlCDR2
YASHRYT

SEQ ID NO: 11320 - protein, 9 aa, Artificial Sequence
  Description of Artificial Sequence: Synthetic peptide
  XENP019663 vlCDR3
QQDFSSPRT

SEQ ID NO: 11321 - protein, 249 aa, Artificial Sequence
  Description of Artificial Sequence: Synthetic polypeptide
  XENP019664 1G6_H1.287_L1.209_scFv(GKPGS)4
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIK

SEQ ID NO: 11322 - protein, 122 aa, Artificial Sequence
  Description of Artificial Sequence: Synthetic polypeptide
  VH of XENP019664
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSS

SEQ ID NO: 11323 - protein, 107 aa, Artificial Sequence
  Description of Artificial Sequence: Synthetic polypeptide
  VL of XENP019664
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIK

SEQ ID NO: 11324 - protein, 5 aa, Artificial Sequence
  Description of Artificial Sequence: Synthetic peptide
  XENP019664 vhCDR1
NYWMN

SEQ ID NO: 11325 - protein, 19 aa, Artificial Sequence
  Description of Artificial Sequence: Synthetic peptide
  XENP019664 vhCDR2
EIRLYSNNYATHYAESVKG

SEQ ID NO: 11326 - protein, 11 aa, Artificial Sequence
  Description of Artificial Sequence: Synthetic peptide
  XENP019664 vhCDR3
YYGNYGGYFDV

SEQ ID NO: 11327 - protein, 11 aa, Artificial Sequence
  Description of Artificial Sequence: Synthetic peptide
  XENP019664 vlCDR1
RASQSVGNDVA

SEQ ID NO: 11328 - protein, 7 aa, Artificial Sequence
  Description of Artificial Sequence: Synthetic peptide
  XENP019664 vlCDR2
YASHRYT

SEQ ID NO: 11329 - protein, 9 aa, Artificial Sequence
  Description of Artificial Sequence: Synthetic peptide
  XENP019664 vlCDR3
QQDFSSPRT

SEQ ID NO: 11330 - protein, 249 aa, Artificial Sequence
  Description of Artificial Sequence: Synthetic polypeptide
  XENP019665 1G6_L1.209_H1.287_scFv(GKPGS)4
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGQGTLVTVSS

SEQ ID NO: 11331 - protein, 107 aa, Artificial Sequence; identical to SEQ ID NO: 11323
  Description of Artificial Sequence: Synthetic polypeptide
  VH of XENP019665

SEQ ID NO: 11332 - protein, 122 aa, Artificial Sequence; identical to SEQ ID NO: 11322
  Description of Artificial Sequence: Synthetic polypeptide
  VL of XENP019665

SEQ ID NO: 11333 - protein, 11 aa, Artificial Sequence
  Description of Artificial Sequence: Synthetic peptide
  XENP019665 vhCDR1
RASQSVGNDVA

SEQ ID NO: 11334 - protein, 7 aa, Artificial Sequence
  Description of Artificial Sequence: Synthetic peptide
  XENP019665 vhCDR2
YASHRYT

SEQ ID NO: 11335 - protein, 9 aa, Artificial Sequence
  Description of Artificial Sequence: Synthetic peptide
  XENP019665 vhCDR3
QQDFSSPRT

SEQ ID NO: 11336 - protein, 5 aa, Artificial Sequence
  Description of Artificial Sequence: Synthetic peptide
  XENP019665 vlCDR1
NYWMN

SEQ ID NO: 11337 - protein, 19 aa, Artificial Sequence
  Description of Artificial Sequence: Synthetic peptide
  XENP019665 vlCDR2
EIRLYSNNYATHYAESVKG

SEQ ID NO: 11338 - protein, 11 aa, Artificial Sequence
  Description of Artificial Sequence: Synthetic peptide
  XENP019665 vlCDR3
YYGNYGGYFDV

SEQ ID NO: 11339 - protein, 249 aa, Artificial Sequence
  Description of Artificial Sequence: Synthetic polypeptide
  XENP019666 1G6_H1.284_L1.194_scFv(GKPGS)4
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11340 - protein, 122 aa, Artificial Sequence; identical to SEQ ID NO: 10953
  Description of Artificial Sequence: Synthetic polypeptide
  VH of XENP019666

SEQ ID NO: 11341 - protein, 107 aa, Artificial Sequence; identical to SEQ ID NO: 10999
  Description of Artificial Sequence: Synthetic polypeptide
  VL of XENP019666

SEQ ID NO: 11342 - protein, 5 aa, Artificial Sequence
  Description of Artificial Sequence: Synthetic peptide
  XENP019666 vhCDR1
NYWMN

SEQ ID NO: 11343 - protein, 19 aa, Artificial Sequence
  Description of Artificial Sequence: Synthetic peptide
  XENP019666 vhCDR2
EIRLYSNNYATHYAESVKG

SEQ ID NO: 11344 - protein, 11 aa, Artificial Sequence
  Description of Artificial Sequence: Synthetic peptide
  XENP019666 vhCDR3
YYGNYGGYFDV

SEQ ID NO: 11345 - protein, 11 aa, Artificial Sequence
  Description of Artificial Sequence: Synthetic peptide
  XENP019666 vlCDR1
RASQSVGNDVA

SEQ ID NO: 11346 - protein, 7 aa, Artificial Sequence
  Description of Artificial Sequence: Synthetic peptide
  XENP019666 vlCDR2
YASHRYT

SEQ ID NO: 11347 - protein, 9 aa, Artificial Sequence
  Description of Artificial Sequence: Synthetic peptide
  XENP019666 vlCDR3
QQDFSSPRT

SEQ ID NO: 11348 - protein, 249 aa, Artificial Sequence
  Description of Artificial Sequence: Synthetic polypeptide
  XENP019667 1G6_L1.194_H1.284_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSS

SEQ ID NO: 11349 - protein, 107 aa, Artificial Sequence; identical to SEQ ID NO: 10999
  Description of Artificial Sequence: Synthetic polypeptide
  VH of XENP019667

SEQ ID NO: 11350 - protein, 122 aa, Artificial Sequence; identical to SEQ ID NO: 10953
  Description of Artificial Sequence: Synthetic polypeptide
  VL of XENP019667

SEQ ID NO: 11351 - protein, 11 aa, Artificial Sequence
  Description of Artificial Sequence: Synthetic peptide
  XENP019667 vhCDR1
RASQSVGNDVA

SEQ ID NO: 11352 - protein, 7 aa, Artificial Sequence
  Description of Artificial Sequence: Synthetic peptide
  XENP019667 vhCDR2
YASHRYT

SEQ ID NO: 11353 - protein, 9 aa, Artificial Sequence
  Description of Artificial Sequence: Synthetic peptide
  XENP019667 vhCDR3
QQDFSSPRT

SEQ ID NO: 11354 - protein, 5 aa, Artificial Sequence
  Description of Artificial Sequence: Synthetic peptide
  XENP019667 vlCDR1
NYWMN

SEQ ID NO: 11355 - protein, 19 aa, Artificial Sequence
  Description of Artificial Sequence: Synthetic peptide
  XENP019667 vlCDR2
EIRLYSNNYATHYAESVKG

SEQ ID NO: 11356 - protein, 11 aa, Artificial Sequence
  Description of Artificial Sequence: Synthetic peptide
  XENP019667 vlCDR3
YYGNYGGYFDV

SEQ ID NO: 11357 - protein, 249 aa, Artificial Sequence
  Description of Artificial Sequence: Synthetic polypeptide
  XENP019668 1G6_H1.288_L1.210_scFv(GKPGS)4
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 11358 - protein, 122 aa, Artificial Sequence
  Description of Artificial Sequence: Synthetic polypeptide
  VH of XENP019668
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 11359 - protein, 107 aa, Artificial Sequence
  Description of Artificial Sequence: Synthetic polypeptide
  VL of XENP019668
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIK

SEQ ID NO: 11360 - protein, 5 aa, Artificial Sequence
  Description of Artificial Sequence: Synthetic peptide
  XENP019668 vhCDR1
NYWMN

SEQ ID NO: 11361 - protein, 19 aa, Artificial Sequence
  Description of Artificial Sequence: Synthetic peptide
  XENP019668 vhCDR2
EIRLYSNNYATHYAESVKG

SEQ ID NO: 11362 - protein, 11 aa, Artificial Sequence
  Description of Artificial Sequence: Synthetic peptide
  XENP019668 vhCDR3
YYGNYGGYFDV

SEQ ID NO: 11363 - protein, 11 aa, Artificial Sequence
  Description of Artificial Sequence: Synthetic peptide
  XENP019668 vlCDR1
RASQSVGNDVA

SEQ ID NO: 11364 - protein, 7 aa, Artificial Sequence
  Description of Artificial Sequence: Synthetic peptide
  XENP019668 vlCDR2
YASHRYT

SEQ ID NO: 11365 - protein, 9 aa, Artificial Sequence
  Description of Artificial Sequence: Synthetic peptide
  XENP019668 vlCDR3
QQDFSSPRT

SEQ ID NO: 11366 - protein, 249 aa, Artificial Sequence
  Description of Artificial Sequence: Synthetic polypeptide
  XENP019669 1G6_L1.210_H1.288_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 11367 - protein, 107 aa, Artificial Sequence; identical to SEQ ID NO: 11359
  Description of Artificial Sequence: Synthetic polypeptide
  VH of XENP019669

SEQ ID NO: 11368 - protein, 122 aa, Artificial Sequence; identical to SEQ ID NO: 11358
  Description of Artificial Sequence: Synthetic polypeptide
  VL of XENP019669

SEQ ID NO: 11369 - protein, 11 aa, Artificial Sequence
  Description of Artificial Sequence: Synthetic peptide
  XENP019669 vhCDR1
RASQSVGNDVA

SEQ ID NO: 11370 - protein, 7 aa, Artificial Sequence
  Description of Artificial Sequence: Synthetic peptide
  XENP019669 vhCDR2
YASHRYT

SEQ ID NO: 11371 - protein, 9 aa, Artificial Sequence
  Description of Artificial Sequence: Synthetic peptide
  XENP019669 vhCDR3
QQDFSSPRT

SEQ ID NO: 11372 - protein, 5 aa, Artificial Sequence
  Description of Artificial Sequence: Synthetic peptide
  XENP019669 vlCDR1
NYWMN

SEQ ID NO: 11373 - protein, 19 aa, Artificial Sequence
  Description of Artificial Sequence: Synthetic peptide
  XENP019669 vlCDR2
EIRLYSNNYATHYAESVKG

SEQ ID NO: 11374 - protein, 11 aa, Artificial Sequence
  Description of Artificial Sequence: Synthetic peptide
  XENP019669 vlCDR3
YYGNYGGYFDV

SEQ ID NO: 11375 - protein, 249 aa, Artificial Sequence
  Description of Artificial Sequence: Synthetic polypeptide
  XENP019690 1G6_H1.279_L1.194_scFv(GKPGS)4
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11376 - protein, 122 aa, Artificial Sequence; identical to SEQ ID NO: 10908
  Description of Artificial Sequence: Synthetic polypeptide
  VH of XENP019690

SEQ ID NO: 11377 - protein, 107 aa, Artificial Sequence; identical to SEQ ID NO: 10999
  Description of Artificial Sequence: Synthetic polypeptide
  VL of XENP019690

SEQ ID NO: 11378 - protein, 5 aa, Artificial Sequence
  Description of Artificial Sequence: Synthetic peptide
  XENP019690 vhCDR1
NYWMN

SEQ ID NO: 11379 - protein, 19 aa, Artificial Sequence
  Description of Artificial Sequence: Synthetic peptide
  XENP019690 vhCDR2
EIRLYSNNYATHYAESVKG

SEQ ID NO: 11380 - protein, 11 aa, Artificial Sequence
  Description of Artificial Sequence: Synthetic peptide
  XENP019690 vhCDR3
YYGNYGGYFDV

SEQ ID NO: 11381 - protein, 11 aa, Artificial Sequence
  Description of Artificial Sequence: Synthetic peptide
  XENP019690 vlCDR1
RASQSVGNDVA

SEQ ID NO: 11382 - protein, 7 aa, Artificial Sequence
  Description of Artificial Sequence: Synthetic peptide
  XENP019690 vlCDR2
YASHRYT

SEQ ID NO: 11383 - protein, 9 aa, Artificial Sequence
  Description of Artificial Sequence: Synthetic peptide
  XENP019690 vlCDR3
QQDFSSPRT

SEQ ID NO: 11384 - protein, 249 aa, Artificial Sequence
  Description of Artificial Sequence: Synthetic polypeptide
  XENP019691 1G6_H1.282_L1.194_scFv(GKPGS)4
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 11385 - protein, 122 aa, Artificial Sequence; identical to SEQ ID NO: 10935
  Description of Artificial Sequence: Synthetic polypeptide
  VH of XENP019691

SEQ ID NO: 11386 - protein, 107 aa, Artificial Sequence; identical to SEQ ID NO: 10999
  Description of Artificial Sequence: Synthetic polypeptide
  VL of XENP019691

SEQ ID NO: 11387 - protein, 5 aa, Artificial Sequence
  Description of Artificial Sequence: Synthetic peptide
  XENP019691 vhCDR1
NYWMN

SEQ ID NO: 11388 - protein, 19 aa, Artificial Sequence
  Description of Artificial Sequence: Synthetic peptide
  XENP019691 vhCDR2
EIRLYSNNYATHYAESVKG

SEQ ID NO: 11389 - protein, 11 aa, Artificial Sequence
  Description of Artificial Sequence: Synthetic peptide
  XENP019691 vhCDR3
YYGNYGGYFDV

SEQ ID NO: 11390 - protein, 11 aa, Artificial Sequence
  Description of Artificial Sequence: Synthetic peptide
  XENP019691 vlCDR1
RASQSVGNDVA

SEQ ID NO: 11391 - protein, 7 aa, Artificial Sequence
  Description of Artificial Sequence: Synthetic peptide
  XENP019691 vlCDR2
YASHRYT

SEQ ID NO: 11392 - protein, 9 aa, Artificial Sequence
  Description of Artificial Sequence: Synthetic peptide
  XENP019691 vlCDR3
QQDFSSPRT

SEQ ID NO: 11393 - protein, 249 aa, Artificial Sequence
  Description of Artificial Sequence: Synthetic polypeptide
  XENP019692 1G6_L1.194_H1.279_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 11394 - protein, 107 aa, Artificial Sequence; identical to SEQ ID NO: 10999
  Description of Artificial Sequence: Synthetic polypeptide
  VH of XENP019692

SEQ ID NO: 11395 - protein, 122 aa, Artificial Sequence; identical to SEQ ID NO: 10908
  Description of Artificial Sequence: Synthetic polypeptide
  VL of XENP019692

SEQ ID NO: 11396 - protein, 11 aa, Artificial Sequence
  Description of Artificial Sequence: Synthetic peptide
  XENP019692 vhCDR1
RASQSVGNDVA

SEQ ID NO: 11397 - protein, 7 aa, Artificial Sequence
  Description of Artificial Sequence: Synthetic peptide
  XENP019692 vhCDR2
YASHRYT

SEQ ID NO: 11398 - protein, 9 aa, Artificial Sequence
  Description of Artificial Sequence: Synthetic peptide
  XENP019692 vhCDR3
QQDFSSPRT

SEQ ID NO: 11399 - protein, 5 aa, Artificial Sequence
  Description of Artificial Sequence: Synthetic peptide
  XENP019692 vlCDR1
NYWMN

SEQ ID NO: 11400 - protein, 19 aa, Artificial Sequence
  Description of Artificial Sequence: Synthetic peptide
  XENP019692 vlCDR2
EIRLYSNNYATHYAESVKG

SEQ ID NO: 11401 - protein, 11 aa, Artificial Sequence
  Description of Artificial Sequence: Synthetic peptide
  XENP019692 vlCDR3
YYGNYGGYFDV

SEQ ID NO: 11402 - protein, 249 aa, Artificial Sequence
  Description of Artificial Sequence: Synthetic polypeptide
  XENP019693 1G6_L1.194_H1.282_scFv(GKPGS)4
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSS

SEQ ID NO: 11403 - protein, 107 aa, Artificial Sequence; identical to SEQ ID NO: 10999
  Description of Artificial Sequence: Synthetic polypeptide
  VH of XENP019693

SEQ ID NO: 11404 - protein, 122 aa, Artificial Sequence; identical to SEQ ID NO: 10935
  Description of Artificial Sequence: Synthetic polypeptide
  VL of XENP019693

SEQ ID NO: 11405 - protein, 11 aa, Artificial Sequence
  Description of Artificial Sequence: Synthetic peptide
  XENP019693 vhCDR1
RASQSVGNDVA

SEQ ID NO: 11406 - protein, 7 aa, Artificial Sequence
  Description of Artificial Sequence: Synthetic peptide
  XENP019693 vhCDR2
YASHRYT

SEQ ID NO: 11407 - protein, 9 aa, Artificial Sequence
  Description of Artificial Sequence: Synthetic peptide
  XENP019693 vhCDR3
QQDFSSPRT

SEQ ID NO: 11408 - protein, 5 aa, Artificial Sequence
  Description of Artificial Sequence: Synthetic peptide
  XENP019693 vlCDR1
NYWMN

SEQ ID NO: 11409 - protein, 19 aa, Artificial Sequence
  Description of Artificial Sequence: Synthetic peptide
  XENP019693 vlCDR2
EIRLYSNNYATHYAESVKG

SEQ ID NO: 11410 - protein, 11 aa, Artificial Sequence
  Description of Artificial Sequence: Synthetic peptide
  XENP019693 vlCDR3
YYGNYGGYFDV

SEQ ID NO: 11411 - protein, 247 aa, Artificial Sequence
  Description of Artificial Sequence: Synthetic polypeptide
  XENP020162 2E9_H1L1_scFv(GKPGS)4
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 11412 - protein, 120 aa, Artificial Sequence
  Description of Artificial Sequence: Synthetic polypeptide
  VH of XENP020162
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSS

SEQ ID NO: 11413 - protein, 107 aa, Artificial Sequence
  Description of Artificial Sequence: Synthetic polypeptide
  VL of XENP020162
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 11414 - protein, 5 aa, Artificial Sequence
  Description of Artificial Sequence: Synthetic peptide
  XENP020162 vhCDR1
NYWLG

SEQ ID NO: 11415 - protein, 17 aa, Artificial Sequence
  Description of Artificial Sequence: Synthetic peptide
  XENP020162 vhCDR2
NFYPGSSNTYYNEKFQG

SEQ ID NO: 11416 - protein, 11 aa, Artificial Sequence
  Description of Artificial Sequence: Synthetic peptide
  XENP020162 vhCDR3
HYGTNYRYFDV

SEQ ID NO: 11417 - protein, 11 aa, Artificial Sequence
  Description of Artificial Sequence: Synthetic peptide
  XENP020162 vlCDR1
RASQSVSNDVA

SEQ ID NO: 11418 - protein, 7 aa, Artificial Sequence
  Description of Artificial Sequence: Synthetic peptide
  XENP020162 vlCDR2
YASNRYT

SEQ ID NO: 11419 - protein, 9 aa, Artificial Sequence
  Description of Artificial Sequence: Synthetic peptide
  XENP020162 vlCDR3
QQDYSSPYT

SEQ ID NO: 11420 - protein, 247 aa, Artificial Sequence
  Description of Artificial Sequence: Synthetic polypeptide
  XENP020163 2E9_H2L1_scFv(GKPGS)4
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSSGKPGSGKPGSGKPGSGKPGSDIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIK

SEQ ID NO: 11421 - protein, 120 aa, Artificial Sequence
  Description of Artificial Sequence: Synthetic polypeptide
  VH of XENP020163
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSS

SEQ ID NO: 11422 - protein, 107 aa, Artificial Sequence; identical to SEQ ID NO: 11413
  Description of Artificial Sequence: Synthetic polypeptide
  VL of XENP020163

SEQ ID NO: 11423 - protein, 5 aa, Artificial Sequence
  Description of Artificial Sequence: Synthetic peptide
  XENP020163 vhCDR1
NYWLG

SEQ ID NO: 11424 - protein, 17 aa, Artificial Sequence
  Description of Artificial Sequence: Synthetic peptide
  XENP020163 vhCDR2
NFYPGSSNTYYNPSFQG

SEQ ID NO: 11425 - protein, 11 aa, Artificial Sequence
  Description of Artificial Sequence: Synthetic peptide
  XENP020163 vhCDR3
HYGTNYRYFDV

SEQ ID NO: 11426 - protein, 11 aa, Artificial Sequence
  Description of Artificial Sequence: Synthetic peptide
  XENP020163 vlCDR1
RASQSVSNDVA

SEQ ID NO: 11427 - protein, 7 aa, Artificial Sequence
  Description of Artificial Sequence: Synthetic peptide
  XENP020163 vlCDR2
YASNRYT

SEQ ID NO: 11428 - protein, 9 aa, Artificial Sequence
  Description of Artificial Sequence: Synthetic peptide
  XENP020163 vlCDR3
QQDYSSPYT

SEQ ID NO: 11429 - protein, 242 aa, Artificial Sequence
  Description of Artificial Sequence: Synthetic polypeptide
  XENP020164 3C11(PD-1)_H1L1_scFv(GKPGS)4
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSSGKPGSGKPGSGKPGSGKPGSDIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIK

SEQ ID NO: 11430 - protein, 115 aa, Artificial Sequence
  Description of Artificial Sequence: Synthetic polypeptide
  VH of XENP020164
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSS

SEQ ID NO: 11431 - protein, 107 aa, Artificial Sequence
  Description of Artificial Sequence: Synthetic polypeptide
  VL of XENP020164
DIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIK

SEQ ID NO: 11432 - protein, 5 aa, Artificial Sequence
  Description of Artificial Sequence: Synthetic peptide
  XENP020164 vhCDR1
SYWMH

SEQ ID NO: 11433 - protein, 17 aa, Artificial Sequence
  Description of Artificial Sequence: Synthetic peptide
  XENP020164 vhCDR2
AIYPGNIATSYNQKFQG

SEQ ID NO: 11434 - protein, 6 aa, Artificial Sequence
  Description of Artificial Sequence: Synthetic peptide
  XENP020164 vhCDR3
SYVMDY

SEQ ID NO: 11435 - protein, 11 aa, Artificial Sequence
  Description of Artificial Sequence: Synthetic peptide
  XENP020164 vlCDR1
QASQDINSYLS

SEQ ID NO: 11436 - protein, 7 aa, Artificial Sequence
  Description of Artificial Sequence: Synthetic peptide
  XENP020164 vlCDR2
RANRLVD

SEQ ID NO: 11437 - protein, 9 aa, Artificial Sequence
  Description of Artificial Sequence: Synthetic peptide
  XENP020164 vlCDR3
LQYDEFPYT

SEQ ID NO: 11438 - protein, 239 aa, Artificial Sequence
  Description of Artificial Sequence: Synthetic polypeptide
  XENP020165 3G12_H1L1_scFv(GKPGS)4
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSSGKPGSGKPGSGKPGSGKPGSDIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIK

SEQ ID NO: 11439 - protein, 112 aa, Artificial Sequence
  Description of Artificial Sequence: Synthetic polypeptide
  VH of XENP020165
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSS

SEQ ID NO: 11440 - protein, 107 aa, Artificial Sequence
  Description of Artificial Sequence: Synthetic polypeptide
  VL of XENP020165
DIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIK

SEQ ID NO: 11441 - protein, 5 aa, Artificial Sequence
  Description of Artificial Sequence: Synthetic peptide
  XENP020165 vhCDR1
SYWMH

SEQ ID NO: 11442 - protein, 17 aa, Artificial Sequence
  Description of Artificial Sequence: Synthetic peptide
  XENP020165 vhCDR2
VIDPSDSYTSYNQKFQG

SEQ ID NO: 11443 - protein, 3 aa, Artificial Sequence
  Description of Artificial Sequence: Synthetic peptide
  XENP020165 vhCDR3
AYY

SEQ ID NO: 11444 - protein, 11 aa, Artificial Sequence
  Description of Artificial Sequence: Synthetic peptide
  XENP020165 vlCDR1
RASQGISSNIG

SEQ ID NO: 11445 - protein, 7 aa, Artificial Sequence
  Description of Artificial Sequence: Synthetic peptide
  XENP020165 vlCDR2
HGTNLED

SEQ ID NO: 11446 - protein, 9 aa, Artificial Sequence
  Description of Artificial Sequence: Synthetic peptide
  XENP020165 vlCDR3
VQYAQSPWT

SEQ ID NO: 11447 - protein, 239 aa, Artificial Sequence
  Description of Artificial Sequence: Synthetic polypeptide
  XENP020166 5C4_H1L1_scFv(GKPGS)4
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSSGKPGSGKPGSGKPGSGKPGSDIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 11448 - protein, 112 aa, Artificial Sequence
  Description of Artificial Sequence: Synthetic polypeptide
  VH of XENP020166
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSS

SEQ ID NO: 11449 - protein, 107 aa, Artificial Sequence
  Description of Artificial Sequence: Synthetic polypeptide
  VL of XENP020166
DIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 11450 - protein, 5 aa, Artificial Sequence
  Description of Artificial Sequence: Synthetic peptide
  XENP020166 vhCDR1
DYWMH

SEQ ID NO: 11451 - protein, 17 aa, Artificial Sequence
  Description of Artificial Sequence: Synthetic peptide
  XENP020166 vhCDR2
AIDTSDSYPTYNQKFQG

SEQ ID NO: 11452 - protein, 3 aa, Artificial Sequence
  Description of Artificial Sequence: Synthetic peptide
  XENP020166 vhCDR3
FDY

SEQ ID NO: 11453 - protein, 11 aa, Artificial Sequence
  Description of Artificial Sequence: Synthetic peptide
  XENP020166 vlCDR1
KASQSVSNDVA

SEQ ID NO: 11454 - protein, 7 aa, Artificial Sequence
  Description of Artificial Sequence: Synthetic peptide
  XENP020166 vlCDR2
YASNRYT

SEQ ID NO: 11455 - protein, 9 aa, Artificial Sequence
  Description of Artificial Sequence: Synthetic peptide
  XENP020166 vlCDR3
QQDYSSPYT

SEQ ID NO: 11456 - protein, 239 aa, Artificial Sequence
  Description of Artificial Sequence: Synthetic polypeptide
  XENP020167 5C4_H2L1_scFv(GKPGS)4
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSSGKPGSGKPGSGKPGSGKPGSDIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIK

SEQ ID NO: 11457 - protein, 112 aa, Artificial Sequence
  Description of Artificial Sequence: Synthetic polypeptide
  VH of XENP020167
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSS

SEQ ID NO: 11458 - protein, 107 aa, Artificial Sequence; identical to SEQ ID NO: 11449
  Description of Artificial Sequence: Synthetic polypeptide
  VL of XENP020167

SEQ ID NO: 11459 - protein, 5 aa, Artificial Sequence
  Description of Artificial Sequence: Synthetic peptide
  XENP020167 vhCDR1
DYWMH

SEQ ID NO: 11460 - protein, 17 aa, Artificial Sequence
  Description of Artificial Sequence: Synthetic peptide
  XENP020167 vhCDR2
AIDTSDSYPTYNQGFTG

SEQ ID NO: 11461 - protein, 3 aa, Artificial Sequence
  Description of Artificial Sequence: Synthetic peptide
  XENP020167 vhCDR3
FDY

SEQ ID NO: 11462 - protein, 11 aa, Artificial Sequence
  Description of Artificial Sequence: Synthetic peptide
  XENP020167 vlCDR1
KASQSVSNDVA

SEQ ID NO: 11463 - protein, 7 aa, Artificial Sequence
  Description of Artificial Sequence: Synthetic peptide
  XENP020167 vlCDR2
YASNRYT

SEQ ID NO: 11464 - protein, 9 aa, Artificial Sequence
  Description of Artificial Sequence: Synthetic peptide
  XENP020167 vlCDR3
QQDYSSPYT

SEQ ID NO: 11465 - protein, 443 aa, Artificial Sequence
  Description of Artificial Sequence: Synthetic polypeptide
  XENP013810 Nivolumab_H0L0_IgG1 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11466 - protein, 113 aa, Artificial Sequence [sequence omitted]

SEQ ID NO: 11467 - protein, 5 aa, Artificial Sequence
  Description of Artificial Sequence: Synthetic peptide
  XENP013810 vhCDR1
NSGMH

SEQ ID NO: 11468 - protein, 17 aa, Artificial Sequence
  Description of Artificial Sequence: Synthetic peptide
  XENP013810 vhCDR2
VIWYDGSKRYYADSVKG

SEQ ID NO: 11469 - protein, 4 aa, Artificial Sequence
  Description of Artificial Sequence: Synthetic peptide
  XENP013810 vhCDR3
NDDY

SEQ ID NO: 11470 - protein, 214 aa, Artificial Sequence
  Description of Artificial Sequence: Synthetic polypeptide
  XENP013810 Nivolumab_H0L0_IgG1 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11471 - protein, 107 aa, Artificial Sequence [sequence omitted]

SEQ ID NO: 11472 - protein, 11 aa, Artificial Sequence
  Description of Artificial Sequence: Synthetic peptide
  XENP013810 vlCDR1
RASQSVSSYLA

SEQ ID NO: 11473 - protein, 7 aa, Artificial Sequence
  Description of Artificial Sequence: Synthetic peptide
  XENP013810 vlCDR2
DASNRAT

SEQ ID NO: 11474 - protein, 9 aa, Artificial Sequence
  Description of Artificial Sequence: Synthetic peptide
  XENP013810 vlCDR3
QQSSNWPRT

SEQ ID NO: 11475 - protein, 443 aa, Artificial Sequence
  Description of Artificial Sequence: Synthetic polypeptide
  XENP013960 Nivolumab_H0L0_IgG1_G236R/L328R Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLRGPSVFLFPPKPKDTLMISRTPEVTCVVVDVSHEDPEVKFNWYVDGVEVHNAKTKPREEQYNSTYRVVSVLTVLHQDWLNGKEYKCKVSNKARPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11476 - protein, 113 aa, Artificial Sequence [sequence omitted]

SEQ ID NO: 11477 - protein, 5 aa, Artificial Sequence
  Description of Artificial Sequence: Synthetic peptide
  XENP013960 vhCDR1
NSGMH

SEQ ID NO: 11478 - protein, 17 aa, Artificial Sequence
  Description of Artificial Sequence: Synthetic peptide
  XENP013960 vhCDR2
VIWYDGSKRYYADSVKG

SEQ ID NO: 11479 - protein, 4 aa, Artificial Sequence
  Description of Artificial Sequence: Synthetic peptide
  XENP013960 vhCDR3
NDDY

SEQ ID NO: 11480 - protein, 214 aa, Artificial Sequence; identical to SEQ ID NO: 11470
  Description of Artificial Sequence: Synthetic polypeptide
  XENP013960 Nivolumab_H0L0_IgG1_G236R/L328R Light Chain

SEQ ID NO: 11481 - protein, 107 aa, Artificial Sequence [sequence omitted]

SEQ ID NO: 11482 - protein, 11 aa, Artificial Sequence
  Description of Artificial Sequence: Synthetic peptide
  XENP013960 vlCDR1
RASQSVSSYLA

SEQ ID NO: 11483 - protein, 7 aa, Artificial Sequence
  Description of Artificial Sequence: Synthetic peptide
  XENP013960 vlCDR2
DASNRAT

SEQ ID NO: 11484 - protein, 9 aa, Artificial Sequence
  Description of Artificial Sequence: Synthetic peptide
  XENP013960 vlCDR3
QQSSNWPRT

SEQ ID NO: 11485 - protein, 442 aa, Artificial Sequence
  Description of Artificial Sequence: Synthetic polypeptide
  XENP016432 Nivolumab_H0L0_IgG1_PVA_/S267K Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11486 - protein, 113 aa, Artificial Sequence [sequence omitted]

SEQ ID NO: 11487 - protein, 5 aa, Artificial Sequence
  Description of Artificial Sequence: Synthetic peptide
  XENP016432 vhCDR1
NSGMH

SEQ ID NO: 11488 - protein, 17 aa, Artificial Sequence
  Description of Artificial Sequence: Synthetic peptide
  XENP016432 vhCDR2
VIWYDGSKRYYADSVKG

SEQ ID NO: 11489 - protein, 4 aa, Artificial Sequence
  Description of Artificial Sequence: Synthetic peptide
  XENP016432 vhCDR3
NDDY

SEQ ID NO: 11490 - protein, 214 aa, Artificial Sequence; identical to SEQ ID NO: 11470
  Description of Artificial Sequence: Synthetic polypeptide
  XENP016432 Nivolumab_H0L0_IgG1_PVA_/S267K Light Chain

SEQ ID NO: 11491 - protein, 107 aa, Artificial Sequence [sequence omitted]

SEQ ID NO: 11492 - protein, 11 aa, Artificial Sequence
  Description of Artificial Sequence: Synthetic peptide
  XENP016432 vlCDR1
RASQSVSSYLA

SEQ ID NO: 11493 - protein, 7 aa, Artificial Sequence
  Description of Artificial Sequence: Synthetic peptide
  XENP016432 vlCDR2
DASNRAT

SEQ ID NO: 11494 - protein, 9 aa, Artificial Sequence
  Description of Artificial Sequence: Synthetic peptide
  XENP016432 vlCDR3
QQSSNWPRT

SEQ ID NO: 11495 - protein, 440 aa, Artificial Sequence
  Description of Artificial Sequence: Synthetic polypeptide
  XENP016602 Nivolumab_H0_IgG4_S228P Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 11496 - protein, 113 aa, Artificial Sequence [sequence omitted]

SEQ ID NO: 11497 - protein, 5 aa, Artificial Sequence
  Description of Artificial Sequence: Synthetic peptide
  XENP016602 vhCDR1
NSGMH

SEQ ID NO: 11498 - protein, 17 aa, Artificial Sequence
  Description of Artificial Sequence: Synthetic peptide
  XENP016602 vhCDR2
VIWYDGSKRYYADSVKG

SEQ ID NO: 11499 - protein, 4 aa, Artificial Sequence
  Description of Artificial Sequence: Synthetic peptide
  XENP016602 vhCDR3
NDDY

SEQ ID NO: 11500 - protein, 214 aa, Artificial Sequence; identical to SEQ ID NO: 11470
  Description of Artificial Sequence: Synthetic polypeptide
  XENP016602 Nivolumab_H0_IgG4_S228P Light Chain

SEQ ID NO: 11501 - protein, 107 aa, Artificial Sequence [sequence omitted]

SEQ ID NO: 11502 - protein, 11 aa, Artificial Sequence
  Description of Artificial Sequence: Synthetic peptide
  XENP016602 vlCDR1
RASQSVSSYLA

SEQ ID NO: 11503 - protein, 7 aa, Artificial Sequence
  Description of Artificial Sequence: Synthetic peptide
  XENP016602 vlCDR2
DASNRAT

SEQ ID NO: 11504 - protein, 9 aa, Artificial Sequence
  Description of Artificial Sequence: Synthetic peptide
  XENP016602 vlCDR3
QQSSNWPRT

SEQ ID NO: 11505 - protein, 447 aa, Artificial Sequence
  Description of Artificial Sequence: Synthetic polypeptide
  XENP016603 Pembrolizumab_H0_IgG4_S228P Heavy Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 11506 - protein, 120 aa, Artificial Sequence [sequence omitted]

SEQ ID NO: 11507 - protein, 5 aa, Artificial Sequence
  Description of Artificial Sequence: Synthetic peptide
  XENP016603 vhCDR1
NYYMY

SEQ ID NO: 11508 - protein, 17 aa, Artificial Sequence
  Description of Artificial Sequence: Synthetic peptide
  XENP016603 vhCDR2
GINPSNGGTNFNEKFKN

SEQ ID NO: 11509 - protein, 11 aa, Artificial Sequence
  Description of Artificial Sequence: Synthetic peptide
  XENP016603 vhCDR3
RDYRFDMGFDY

SEQ ID NO: 11510 - protein, 218 aa, Artificial Sequence
  Description of Artificial Sequence: Synthetic polypeptide
  XENP016603 Pembrolizumab_H0_IgG4_S228P Light Chain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11511 - protein, 111 aa, Artificial Sequence [sequence omitted]

SEQ ID NO: 11512 - protein, 15 aa, Artificial Sequence
  Description of Artificial Sequence: Synthetic peptide
  XENP016603 vlCDR1
RASKGVSTSGYSYLH

SEQ ID NO: 11513 - protein, 7 aa, Artificial Sequence
  Description of Artificial Sequence: Synthetic peptide
  XENP016603 vlCDR2
LASYLES

SEQ ID NO: 11514 - protein, 9 aa, Artificial Sequence
  Description of Artificial Sequence: Synthetic peptide
  XENP016603 vlCDR3
QHSRDLPLT

SEQ ID NO: 11515 - protein, 443 aa, Artificial Sequence
  Description of Artificial Sequence: Synthetic polypeptide
  XENP017903 1A2_H1L1_IgG1_PVA_/S267K Heavy Chain
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11516 - protein, 114 aa, Artificial Sequence; identical to SEQ ID NO: 6219
  Description of Artificial Sequence: Synthetic polypeptide
  VH of XENP017903

SEQ ID NO: 11517 - protein, 5 aa, Artificial Sequence
  Description of Artificial Sequence: Synthetic peptide
  XENP017903 vhCDR1
DYSMH

SEQ ID NO: 11518 - protein, 17 aa, Artificial Sequence
  Description of Artificial Sequence: Synthetic peptide
  XENP017903 vhCDR2
WINTETGEPTYADKFQG

SEQ ID NO: 11519 - protein, 5 aa, Artificial Sequence
  Description of Artificial Sequence: Synthetic peptide
  XENP017903 vhCDR3
SPLDY

SEQ ID NO: 11520 - protein, 219 aa, Artificial Sequence
  Description of Artificial Sequence: Synthetic polypeptide
  XENP017903 1A2_H1L1_IgG1_PVA_/S267K Light Chain
DLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11521 - protein, 112 aa, Artificial Sequence; identical to SEQ ID NO: 6220
  Description of Artificial Sequence: Synthetic polypeptide
  VL of XENP017903

SEQ ID NO: 11522 - protein, 16 aa, Artificial Sequence
  Description of Artificial Sequence: Synthetic peptide
  XENP017903 vlCDR1
RSSQSIVHSNGNTYLE

SEQ ID NO: 11523 - protein, 7 aa, Artificial Sequence
  Description of Artificial Sequence: Synthetic peptide
  XENP017903 vlCDR2
KVFNRFS

SEQ ID NO: 11524 - protein, 9 aa, Artificial Sequence
  Description of Artificial Sequence: Synthetic peptide
  XENP017903 vlCDR3
FQGSHVPFT

SEQ ID NO: 11525 - protein, 449 aa, Artificial Sequence
  Description of Artificial Sequence: Synthetic polypeptide
  XENP017904 1C7_H1L1_IgG1_PVA_/S267K Heavy Chain
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11526 - protein, 120 aa, Artificial Sequence; identical to SEQ ID NO: 6228
  Description of Artificial Sequence: Synthetic polypeptide
  VH of XENP017904

SEQ ID NO: 11527 - protein, 5 aa, Artificial Sequence
  Description of Artificial Sequence: Synthetic peptide
  XENP017904 vhCDR1
SYDMS

SEQ ID NO: 11528 - protein, 17 aa, Artificial Sequence
  Description of Artificial Sequence: Synthetic peptide
  XENP017904 vhCDR2
YISSGGGSTYYPDSVKG

SEQ ID NO: 11529 - protein, 11 aa, Artificial Sequence
  Description of Artificial Sequence: Synthetic peptide
  XENP017904 vhCDR3
PLDDYYAPFAY

SEQ ID NO: 11530 - protein, 218 aa, Artificial Sequence
  Description of Artificial Sequence: Synthetic polypeptide
  XENP017904 1C7_H1L1_IgG1_PVA_/S267K Light Chain
DIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11531 - protein, 111 aa, Artificial Sequence; identical to SEQ ID NO: 6229
  Description of Artificial Sequence: Synthetic polypeptide
  VL of XENP017904

SEQ ID NO: 11532 - protein, 15 aa, Artificial Sequence
  Description of Artificial Sequence: Synthetic peptide
  XENP017904 vlCDR1
RASESVDNDGISFMN

SEQ ID NO: 11533 - protein, 7 aa, Artificial Sequence
  Description of Artificial Sequence: Synthetic peptide
  XENP017904 vlCDR2
AASNQGS

SEQ ID NO: 11534 - protein, 9 aa, Artificial Sequence
  Description of Artificial Sequence: Synthetic peptide
  XENP017904 vlCDR3
QQSKEVPWT

SEQ ID NO: 11535 - protein, 443 aa, Artificial Sequence
  Description of Artificial Sequence: Synthetic polypeptide
  XENP017905 1G2_H1L1_IgG1_PVA_/S267K Heavy Chain
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11536 - protein, 114 aa, Artificial Sequence; identical to SEQ ID NO: 6237
  Description of Artificial Sequence: Synthetic polypeptide
  VH of XENP017905

SEQ ID NO: 11537 - protein, 5 aa, Artificial Sequence
  Description of Artificial Sequence: Synthetic peptide
  XENP017905 vhCDR1
DYGVN

SEQ ID NO: 11538 - protein, 16 aa, Artificial Sequence
  Description of Artificial Sequence: Synthetic peptide
  XENP017905 vhCDR2
MIWGDGSTDYNSKFQG

SEQ ID NO: 11539 - protein, 6 aa, Artificial Sequence
  Description of Artificial Sequence: Synthetic peptide
  XENP017905 vhCDR3
EYAMDY

SEQ ID NO: 11540 - protein, 219 aa, Artificial Sequence
  Description of Artificial Sequence: Synthetic polypeptide
  XENP017905 1G2_H1L1_IgG1_PVA_/S267K Light Chain
DIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11541 - protein, 112 aa, Artificial Sequence; identical to SEQ ID NO: 6238
  Description of Artificial Sequence: Synthetic polypeptide
  VL of XENP017905

SEQ ID NO: 11542 - protein, 17 aa, Artificial Sequence
  Description of Artificial Sequence: Synthetic peptide
  XENP017905 vlCDR1
KSSQSLLNSRTRKNYLA

SEQ ID NO: 11543 - protein, 7 aa, Artificial Sequence
  Description of Artificial Sequence: Synthetic peptide
  XENP017905 vlCDR2
WASTRES

SEQ ID NO: 11544 - protein, 8 aa, Artificial Sequence
  Description of Artificial Sequence: Synthetic peptide
  XENP017905 vlCDR3
KQSYNLRT

SEQ ID NO: 11545 - protein, 451 aa, Artificial Sequence
  Description of Artificial Sequence: Synthetic polypeptide
  XENP017906 1G6_H1L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11546 - protein, 122 aa, Artificial Sequence; identical to SEQ ID NO: 6246
  Description of Artificial Sequence: Synthetic polypeptide
  VH of XENP017906

SEQ ID NO: 11547 - protein, 5 aa, Artificial Sequence
  Description of Artificial Sequence: Synthetic peptide
  XENP017906 vhCDR1
NYWMN

SEQ ID NO: 11548 - protein, 19 aa, Artificial Sequence
  Description of Artificial Sequence: Synthetic peptide
  XENP017906 vhCDR2
EIRLKSNNYATHYAEPVKG

SEQ ID NO: 11549 - protein, 11 aa, Artificial Sequence
  Description of Artificial Sequence: Synthetic peptide
  XENP017906 vhCDR3
YYGNYGGYFDV

SEQ ID NO: 11550 - protein, 214 aa, Artificial Sequence
  Description of Artificial Sequence: Synthetic polypeptide
  XENP017906 1G6_H1L1_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11551 - protein, 107 aa, Artificial Sequence; identical to SEQ ID NO: 6247
  Description of Artificial Sequence: Synthetic polypeptide
  VL of XENP017906

SEQ ID NO: 11552 - protein, 11 aa, Artificial Sequence
  Description of Artificial Sequence: Synthetic peptide
  XENP017906 vlCDR1
RASQSVSNDVA

SEQ ID NO: 11553 - protein, 7 aa, Artificial Sequence
  Description of Artificial Sequence: Synthetic peptide
  XENP017906 vlCDR2
YASHRYT

SEQ ID NO: 11554 - protein, 9 aa, Artificial Sequence
  Description of Artificial Sequence: Synthetic peptide
  XENP017906 vlCDR3
QQDYSSPRT

SEQ ID NO: 11555 - protein, 451 aa, Artificial Sequence; identical to SEQ ID NO: 11545
  Description of Artificial Sequence: Synthetic polypeptide
  XENP017907 1G6_H1L2_IgG1_PVA_/S267K Heavy Chain

SEQ ID NO: 11556 - protein, 122 aa, Artificial Sequence; identical to SEQ ID NO: 6246
  Description of Artificial Sequence: Synthetic polypeptide
  VH of XENP017907

SEQ ID NO: 11557 - protein, 5 aa, Artificial Sequence
  Description of Artificial Sequence: Synthetic peptide
  XENP017907 vhCDR1
NYWMN

SEQ ID NO: 11558 - protein, 19 aa, Artificial Sequence
  Description of Artificial Sequence: Synthetic peptide
  XENP017907 vhCDR2
EIRLKSNNYATHYAEPVKG

SEQ ID NO: 11559 - protein, 11 aa, Artificial Sequence
  Description of Artificial Sequence: Synthetic peptide
  XENP017907 vhCDR3
YYGNYGGYFDV

SEQ ID NO: 11560 - protein, 214 aa, Artificial Sequence
  Description of Artificial Sequence: Synthetic polypeptide
  XENP017907 1G6_H1L2_IgG1_PVA_/S267K Light Chain
SIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11561 - protein, 107 aa, Artificial Sequence; identical to SEQ ID NO: 6256
  Description of Artificial Sequence: Synthetic polypeptide
  VL of XENP017907

SEQ ID NO: 11562 - protein, 11 aa, Artificial Sequence
  Description of Artificial Sequence: Synthetic peptide
  XENP017907 vlCDR1
RASQSVSNDVA

SEQ ID NO: 11563 - protein, 7 aa, Artificial Sequence
  Description of Artificial Sequence: Synthetic peptide
  XENP017907 vlCDR2
YASHRYT

SEQ ID NO: 11564 - protein, 9 aa, Artificial Sequence
  Description of Artificial Sequence: Synthetic peptide
  XENP017907 vlCDR3
QQDYSSPRT

SEQ ID NO: 11565 - protein, 444 aa, Artificial Sequence
  Description of Artificial Sequence: Synthetic polypeptide
  XENP017908 2A2_H1L1_IgG1_PVA_/S267K Heavy Chain
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11566 - protein, 115 aa, Artificial Sequence; identical to SEQ ID NO: 6264
  Description of Artificial Sequence: Synthetic polypeptide
  VH of XENP017908

SEQ ID NO: 11567 - protein, 5 aa, Artificial Sequence
  Description of Artificial Sequence: Synthetic peptide
  XENP017908 vhCDR1
NYWMH

SEQ ID NO: 11568 - protein, 17 aa, Artificial Sequence
  Description of Artificial Sequence: Synthetic peptide
  XENP017908 vhCDR2
YINPSTGYTEYNQKFQG

SEQ ID NO: 11569 - protein, 6 aa, Artificial Sequence
  Description of Artificial Sequence: Synthetic peptide
  XENP017908 vhCDR3
GNYFAY

SEQ ID NO: 11570 - protein, 214 aa, Artificial Sequence
  Description of Artificial Sequence: Synthetic polypeptide
  XENP017908 2A2_H1L1_IgG1_PVA_/S267K Light Chain
DIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11571 - protein, 107 aa, Artificial Sequence; identical to SEQ ID NO: 6265
  Description of Artificial Sequence: Synthetic polypeptide
  VL of XENP017908

SEQ ID NO: 11572 - protein, 11 aa, Artificial Sequence
  Description of Artificial Sequence: Synthetic peptide
  XENP017908 vlCDR1
RPSESLYSYLA

SEQ ID NO: 11573 - protein, 7 aa, Artificial Sequence
  Description of Artificial Sequence: Synthetic peptide
  XENP017908 vlCDR2
NAKTLVE

SEQ ID NO: 11574 - protein, 9 aa, Artificial Sequence
  Description of Artificial Sequence: Synthetic peptide
  XENP017908 vlCDR3
QHHYGTPFT

SEQ ID NO: 11575 - protein, 449 aa, Artificial Sequence
  Description of Artificial Sequence: Synthetic polypeptide
  XENP017909 2F11_H1L1_IgG1_PVA_/S267K Heavy Chain
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11576 - protein, 120 aa, Artificial Sequence; identical to SEQ ID NO: 6273
  Description of Artificial Sequence: Synthetic polypeptide
  VH of XENP017909

SEQ ID NO: 11577 - protein, 5 aa, Artificial Sequence
  Description of Artificial Sequence: Synthetic peptide
  XENP017909 vhCDR1
DYVMH

SEQ ID NO: 11578 - protein, 17 aa, Artificial Sequence
  Description of Artificial Sequence: Synthetic peptide
  XENP017909 vhCDR2
VISTYYGDASYNQKFQG

SEQ ID NO: 11579 - protein, 11 aa, Artificial Sequence
  Description of Artificial Sequence: Synthetic peptide
  XENP017909 vhCDR3
EGYDGYLYFDV

SEQ ID NO: 11580 - protein, 219 aa, Artificial Sequence
  Description of Artificial Sequence: Synthetic polypeptide
  XENP017909 2F11_H1L1_IgG1_PVA_/S267K Light Chain
DVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11581 - protein, 112 aa, Artificial Sequence; identical to SEQ ID NO: 6274
  Description of Artificial Sequence: Synthetic polypeptide
  VL of XENP017909

SEQ ID NO: 11582 - protein, 16 aa, Artificial Sequence
  Description of Artificial Sequence: Synthetic peptide
  XENP017909 vlCDR1
RSSQSIVHSNGNTYLE

SEQ ID NO: 11583 - protein, 7 aa, Artificial Sequence
  Description of Artificial Sequence: Synthetic peptide
  XENP017909 vlCDR2
KVSNRFS

SEQ ID NO: 11584 - protein, 9 aa, Artificial Sequence
  Description of Artificial Sequence: Synthetic peptide
  XENP017909 vlCDR3
FQGSHVPYT

SEQ ID NO: 11585 - protein, 449 aa, Artificial Sequence
  Description of Artificial Sequence: Synthetic polypeptide
  XENP017910 5H1_H1L1_IgG1_PVA_/S267K Heavy Chain
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11586 - protein, 120 aa, Artificial Sequence; identical to SEQ ID NO: 6282
  Description of Artificial Sequence: Synthetic polypeptide
  VH of XENP017910

SEQ ID NO: 11587 - protein, 5 aa, Artificial Sequence
  Description of Artificial Sequence: Synthetic peptide
  XENP017910 vhCDR1
DYVMH

SEQ ID NO: 11588 - protein, 17 aa, Artificial Sequence
  Description of Artificial Sequence: Synthetic peptide
  XENP017910 vhCDR2
VISIHYGDGRYNQKFQG

SEQ ID NO: 11589 - protein, 11 aa, Artificial Sequence
  Description of Artificial Sequence: Synthetic peptide
  XENP017910 vhCDR3
EVYDGYLYFDV

SEQ ID NO: 11590 - protein, 219 aa, Artificial Sequence
  Description of Artificial Sequence: Synthetic polypeptide
  XENP017910 5H1_H1L1_IgG1_PVA_/S267K Light Chain
DVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11591 - protein, 112 aa, Artificial Sequence; identical to SEQ ID NO: 6283
  Description of Artificial Sequence: Synthetic polypeptide
  VL of XENP017910

SEQ ID NO: 11592 - protein, 16 aa, Artificial Sequence
  Description of Artificial Sequence: Synthetic peptide
  XENP017910 vlCDR1
RSSQSIVHSNGNTYLE

SEQ ID NO: 11593 - protein, 7 aa, Artificial Sequence
  Description of Artificial Sequence: Synthetic peptide
  XENP017910 vlCDR2
KVSNRFS

SEQ ID NO: 11594 - protein, 9 aa, Artificial Sequence
  Description of Artificial Sequence: Synthetic peptide
  XENP017910 vlCDR3
FQGSHVPYT

SEQ ID NO: 11595 - protein, 449 aa, Artificial Sequence; identical to SEQ ID NO: 11585
  Description of Artificial Sequence: Synthetic polypeptide
  XENP017911 5H1_H1L2_IgG1_PVA_/S267K Heavy Chain

SEQ ID NO: 11596 - protein, 120 aa, Artificial Sequence; identical to SEQ ID NO: 6282
  Description of Artificial Sequence: Synthetic polypeptide
  VH of XENP017911

SEQ ID NO: 11597 - protein, 5 aa, Artificial Sequence
  Description of Artificial Sequence: Synthetic peptide
  XENP017911 vhCDR1
DYVMH

SEQ ID NO: 11598 - protein, 17 aa, Artificial Sequence
  Description of Artificial Sequence: Synthetic peptide
  XENP017911 vhCDR2
VISIHYGDGRYNQKFQG

SEQ ID NO: 11599 - protein, 11 aa, Artificial Sequence
  Description of Artificial Sequence: Synthetic peptide
  XENP017911 vhCDR3
EVYDGYLYFDV

SEQ ID NO: 11600 - protein, 219 aa, Artificial Sequence
  Description of Artificial Sequence: Synthetic polypeptide
  XENP017911 5H1_H1L2_IgG1_PVA_/S267K Light Chain
DVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11601 - protein, 112 aa, Artificial Sequence; identical to SEQ ID NO: 6292
  Description of Artificial Sequence: Synthetic polypeptide
  VL of XENP017911

SEQ ID NO: 11602 - protein, 16 aa, Artificial Sequence
  Description of Artificial Sequence: Synthetic peptide
  XENP017911 vlCDR1
RSSQSIVHSNGNTYLE

SEQ ID NO: 11603 - protein, 7 aa, Artificial Sequence
  Description of Artificial Sequence: Synthetic peptide
  XENP017911 vlCDR2
KVSNRFS

SEQ ID NO: 11604 - protein, 9 aa, Artificial Sequence
  Description of Artificial Sequence: Synthetic peptide
  XENP017911 vlCDR3
FQGSHVPYT

SEQ ID NO: 11605 - protein, 449 aa, Artificial Sequence
  Description of Artificial Sequence: Synthetic polypeptide
  XENP017912 10E4_H1L1_IgG1_PVA_/S267K Heavy Chain
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11606 - protein, 120 aa, Artificial Sequence; identical to SEQ ID NO: 6300
  Description of Artificial Sequence: Synthetic polypeptide
  VH of XENP017912

SEQ ID NO: 11607 - protein, 5 aa, Artificial Sequence
  Description of Artificial Sequence: Synthetic peptide
  XENP017912 vhCDR1
SYWMH

SEQ ID NO: 11608 - protein, 17 aa, Artificial Sequence
  Description of Artificial Sequence: Synthetic peptide
  XENP017912 vhCDR2
AIYPGNSDTSYNQKFQG

SEQ ID NO: 11609 - protein, 11 aa, Artificial Sequence
  Description of Artificial Sequence: Synthetic peptide
  XENP017912 vhCDR3
DGNYVRYYFDY

SEQ ID NO: 11610 - protein, 214 aa, Artificial Sequence
  Description of Artificial Sequence: Synthetic polypeptide
  XENP017912 10E4_H1L1_IgG1_PVA_/S267K Light Chain
DIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11611 - protein, 107 aa, Artificial Sequence; identical to SEQ ID NO: 6301
  Description of Artificial Sequence: Synthetic polypeptide
  VL of XENP017912

SEQ ID NO: 11612 - protein, 11 aa, Artificial Sequence
  Description of Artificial Sequence: Synthetic peptide
  XENP017912 vlCDR1
RASQDIGSNLN

SEQ ID NO: 11613 - protein, 7 aa, Artificial Sequence
  Description of Artificial Sequence: Synthetic peptide
  XENP017912 vlCDR2
ATSNLDS

SEQ ID NO: 11614 - protein, 9 aa, Artificial Sequence
  Description of Artificial Sequence: Synthetic peptide
  XENP017912 vlCDR3
LQYASSPLT

SEQ ID NO: 11615 - protein, 449 aa, Artificial Sequence
  Description of Artificial Sequence: Synthetic polypeptide
  XENP017913 4C11_H1L1_IgG1_PVA_/S267K Heavy Chain
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11616 - protein, 120 aa, Artificial Sequence; identical to SEQ ID NO: 6309
  Description of Artificial Sequence: Synthetic polypeptide
  VH of XENP017913

SEQ ID NO: 11617 - protein, 5 aa, Artificial Sequence
  Description of Artificial Sequence: Synthetic peptide
  XENP017913 vhCDR1
SYWMH

SEQ ID NO: 11618 - protein, 17 aa, Artificial Sequence
  Description of Artificial Sequence: Synthetic peptide
  XENP017913 vhCDR2
AIYPGNSDTSYNQKFQG

SEQ ID NO: 11619 - protein, 11 aa, Artificial Sequence
  Description of Artificial Sequence: Synthetic peptide
  XENP017913 vhCDR3
LYYGSSFAMDY

SEQ ID NO: 11620 - protein, 214 aa, Artificial Sequence
  Description of Artificial Sequence: Synthetic polypeptide
  XENP017913 4C11_H1L1_IgG1_PVA_/S267K Light Chain
DIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11621 - protein, 107 aa, Artificial Sequence; identical to SEQ ID NO: 6310
  Description of Artificial Sequence: Synthetic polypeptide
  VL of XENP017913

SEQ ID NO: 11622 - protein, 11 aa, Artificial Sequence
  Description of Artificial Sequence: Synthetic peptide
  XENP017913 vlCDR1
RASQDINTYLS

SEQ ID NO: 11623 - protein, 7 aa, Artificial Sequence
  Description of Artificial Sequence: Synthetic peptide
  XENP017913 vlCDR2
RANRLVD

SEQ ID NO: 11624 - protein, 9 aa, Artificial Sequence
  Description of Artificial Sequence: Synthetic peptide
  XENP017913 vlCDR3
LHYDDFPYT

SEQ ID NO: 11625 - protein, 446 aa, Artificial Sequence
  Description of Artificial Sequence: Synthetic polypeptide
  XENP017914 6A3_H1L1_IgG1_PVA_/S267K Heavy Chain
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11626 - protein, 117 aa, Artificial Sequence; identical to SEQ ID NO: 6318
  Description of Artificial Sequence: Synthetic polypeptide
  VH of XENP017914

SEQ ID NO: 11627 - protein, 5 aa, Artificial Sequence
  Description of Artificial Sequence: Synthetic peptide
  XENP017914 vhCDR1
SYGMS

SEQ ID NO: 11628 - protein, 17 aa, Artificial Sequence
  Description of Artificial Sequence: Synthetic peptide
  XENP017914 vhCDR2
TISGGGRYTYYPDSVKG

SEQ ID NO: 11629 - protein, 8 aa, Artificial Sequence
  Description of Artificial Sequence: Synthetic peptide
  XENP017914 vhCDR3
YYDSSFDY

SEQ ID NO: 11630 - protein, 214 aa, Artificial Sequence
  Description of Artificial Sequence: Synthetic polypeptide
  XENP017914 6A3_H1L1_IgG1_PVA_/S267K Light Chain
DIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11631 - protein, 107 aa, Artificial Sequence; identical to SEQ ID NO: 6319
  Description of Artificial Sequence: Synthetic polypeptide
  VL of XENP017914

SEQ ID NO: 11632 - protein, 11 aa, Artificial Sequence
  Description of Artificial Sequence: Synthetic peptide
  XENP017914 vlCDR1
KASQDVGTAVA

SEQ ID NO: 11633 - protein, 7 aa, Artificial Sequence
  Description of Artificial Sequence: Synthetic peptide
  XENP017914 vlCDR2
WASTRHT

SEQ ID NO: 11634 - protein, 9 aa, Artificial Sequence
  Description of Artificial Sequence: Synthetic peptide
  XENP017914 vlCDR3
QHYSIYPWT

SEQ ID NO: 11635 - protein, 446 aa, Artificial Sequence; identical to SEQ ID NO: 11625
  Description of Artificial Sequence: Synthetic polypeptide
  XENP017915 6A3_H1L2_IgG1_PVA_/S267K Heavy Chain

SEQ ID NO: 11636 - protein, 117 aa, Artificial Sequence; identical to SEQ ID NO: 6318
  Description of Artificial Sequence: Synthetic polypeptide
  VH of XENP017915

SEQ ID NO: 11637 - protein, 5 aa, Artificial Sequence
  Description of Artificial Sequence: Synthetic peptide
  XENP017915 vhCDR1
SYGMS

SEQ ID NO: 11638 - protein, 17 aa, Artificial Sequence
  Description of Artificial Sequence: Synthetic peptide
  XENP017915 vhCDR2
TISGGGRYTYYPDSVKG

SEQ ID NO: 11639 - protein, 8 aa, Artificial Sequence
  Description of Artificial Sequence: Synthetic peptide
  XENP017915 vhCDR3
YYDSSFDY

SEQ ID NO: 11640 - protein, 214 aa, Artificial Sequence
  Description of Artificial Sequence: Synthetic polypeptide
  XENP017915 6A3_H1L2_IgG1_PVA_/S267K Light Chain
DIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11641 - protein, 107 aa, Artificial Sequence; identical to SEQ ID NO: 6328
  Description of Artificial Sequence: Synthetic polypeptide
  VL of XENP017915

SEQ ID NO: 11642 - protein, 11 aa, Artificial Sequence
  Description of Artificial Sequence: Synthetic peptide
  XENP017915 vlCDR1
RASQDVGTAVA

SEQ ID NO: 11643 - protein, 7 aa, Artificial Sequence
  Description of Artificial Sequence: Synthetic peptide
  XENP017915 vlCDR2
WASTRHT

SEQ ID NO: 11644 - protein, 9 aa, Artificial Sequence
  Description of Artificial Sequence: Synthetic peptide
  XENP017915 vlCDR3
QHYSIYPWT

SEQ ID NO: 11645 - protein, 446 aa, Artificial Sequence; identical to SEQ ID NO: 11625
  Description of Artificial Sequence: Synthetic polypeptide
  XENP017916 6A3_H1L3_IgG1_PVA_/S267K Heavy Chain

SEQ ID NO: 11646 - protein, 117 aa, Artificial Sequence; identical to SEQ ID NO: 6318
  Description of Artificial Sequence: Synthetic polypeptide
  VH of XENP017916

SEQ ID NO: 11647 - protein, 5 aa, Artificial Sequence
  Description of Artificial Sequence: Synthetic peptide
  XENP017916 vhCDR1
SYGMS

SEQ ID NO: 11648 - protein, 17 aa, Artificial Sequence
  Description of Artificial Sequence: Synthetic peptide
  XENP017916 vhCDR2
TISGGGRYTYYPDSVKG

SEQ ID NO: 11649 - protein, 8 aa, Artificial Sequence
  Description of Artificial Sequence: Synthetic peptide
  XENP017916 vhCDR3
YYDSSFDY

SEQ ID NO: 11650 - protein, 214 aa, Artificial Sequence
  Description of Artificial Sequence: Synthetic polypeptide
  XENP017916 6A3_H1L3_IgG1_PVA_/S267K Light Chain
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11651 - protein, 107 aa, Artificial Sequence; identical to SEQ ID NO: 6337
  Description of Artificial Sequence: Synthetic polypeptide
  VL of XENP017916

SEQ ID NO: 11652 - protein, 11 aa, Artificial Sequence
  Description of Artificial Sequence: Synthetic peptide
  XENP017916 vlCDR1
RASQDVGTAVA

SEQ ID NO: 11653 - protein, 7 aa, Artificial Sequence
  Description of Artificial Sequence: Synthetic peptide
  XENP017916 vlCDR2
WASTRHT

SEQ ID NO: 11654 - protein, 9 aa, Artificial Sequence
  Description of Artificial Sequence: Synthetic peptide
  XENP017916 vlCDR3
QHYSIYPWT

SEQ ID NO: 11655 - protein, 446 aa, Artificial Sequence
  Description of Artificial Sequence: Synthetic polypeptide
  XENP017917 6A3_H2L3_IgG1_PVA_/S267K Heavy Chain
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11656 - protein, 117 aa, Artificial Sequence; identical to SEQ ID NO: 6354
  Description of Artificial Sequence: Synthetic polypeptide
  VH of XENP017917

SEQ ID NO: 11657 - protein, 5 aa, Artificial Sequence
  Description of Artificial Sequence: Synthetic peptide
  XENP017917 vhCDR1
SYGMS

SEQ ID NO: 11658 - protein, 17 aa, Artificial Sequence
  Description of Artificial Sequence: Synthetic peptide
  XENP017917 vhCDR2
TISGGGRYTYYPDSVKG

SEQ ID NO: 11659 - protein, 8 aa, Artificial Sequence
  Description of Artificial Sequence: Synthetic peptide
  XENP017917 vhCDR3
YYDSSFDY

SEQ ID NO: 11660 - protein, 214 aa, Artificial Sequence; identical to SEQ ID NO: 11650
  Description of Artificial Sequence: Synthetic polypeptide
  XENP017917 6A3_H2L3_IgG1_PVA_/S267K Light Chain

SEQ ID NO: 11661 - protein, 107 aa, Artificial Sequence; identical to SEQ ID NO: 6337
  Description of Artificial Sequence: Synthetic polypeptide
  VL of XENP017917

SEQ ID NO: 11662 - protein, 11 aa, Artificial Sequence
  Description of Artificial Sequence: Synthetic peptide
  XENP017917 vlCDR1
RASQDVGTAVA

SEQ ID NO: 11663 - protein, 7 aa, Artificial Sequence
  Description of Artificial Sequence: Synthetic peptide
  XENP017917 vlCDR2
WASTRHT

SEQ ID NO: 11664 - protein, 9 aa, Artificial Sequence
  Description of Artificial Sequence: Synthetic peptide
  XENP017917 vlCDR3
QHYSIYPWT

SEQ ID NO: 11665 - protein, 446 aa, Artificial Sequence
  Description of Artificial Sequence: Synthetic polypeptide
  XENP017918 6A3_H1.1_L3_IgG1_PVA_/S267K Heavy Chain
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11666 - protein, 117 aa, Artificial Sequence; identical to SEQ ID NO: 6345
  Description of Artificial Sequence: Synthetic polypeptide
  VH of XENP017918

SEQ ID NO: 11667 - protein, 5 aa, Artificial Sequence
  Description of Artificial Sequence: Synthetic peptide
  XENP017918 vhCDR1
SYGMS

SEQ ID NO: 11668 - protein, 17 aa, Artificial Sequence
  Description of Artificial Sequence: Synthetic peptide
  XENP017918 vhCDR2
TISGGGRYTYYPDSVKG

SEQ ID NO: 11669 - protein, 8 aa, Artificial Sequence
  Description of Artificial Sequence: Synthetic peptide
  XENP017918 vhCDR3
YYDSSFDY

SEQ ID NO: 11670 - protein, 214 aa, Artificial Sequence; identical to SEQ ID NO: 11650
  Description of Artificial Sequence: Synthetic polypeptide
  XENP017918 6A3_H1.1_L3_IgG1_PVA_/S267K Light Chain

SEQ ID NO: 11671 - protein, 107 aa, Artificial Sequence; identical to SEQ ID NO: 6337
  Description of Artificial Sequence: Synthetic polypeptide
  VL of XENP017918

SEQ ID NO: 11672 - protein, 11 aa, Artificial Sequence
  Description of Artificial Sequence: Synthetic peptide
  XENP017918 vlCDR1
RASQDVGTAVA

SEQ ID NO: 11673 - protein, 7 aa, Artificial Sequence
  Description of Artificial Sequence: Synthetic peptide
  XENP017918 vlCDR2
WASTRHT

SEQ ID NO: 11674 - protein, 9 aa, Artificial Sequence
  Description of Artificial Sequence: Synthetic peptide
  XENP017918 vlCDR3
QHYSIYPWT

SEQ ID NO: 11675 - protein, 451 aa, Artificial Sequence
  Description of Artificial Sequence: Synthetic polypeptide
  XENP018089 H1M7789N_H0L0_IgG1 Heavy Chain
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11676 - protein, 121 aa, Artificial Sequence
  Description of Artificial Sequence: Synthetic polypeptide
  VH of XENP018089
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSS

SEQ ID NO: 11677 - protein, 5 aa, Artificial Sequence
  Description of Artificial Sequence: Synthetic peptide
  XENP018089 vhCDR1
SYTMN

SEQ ID NO: 11678 - protein, 17 aa, Artificial Sequence
  Description of Artificial Sequence: Synthetic peptide
  XENP018089 vhCDR2
GISDTGGNTYYTDSVKG

SEQ ID NO: 11679 - protein, 12 aa, Artificial Sequence
  Description of Artificial Sequence: Synthetic peptide
  XENP018089 vhCDR3
DQGGSYPYYFHY

SEQ ID NO: 11680 - protein, 215 aa, Artificial Sequence
  Description of Artificial Sequence: Synthetic polypeptide
  XENP018089 H1M7789N_H0L0_IgG1 Light Chain
DIQMTQSPSSLSASVGDRVTITCRASQSISSYLIWYQQKPGTAPKFLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11681 - protein, 108 aa, Artificial Sequence
  Description of Artificial Sequence: Synthetic polypeptide
  VL of XENP018089
DIQMTQSPSSLSASVGDRVTITCRASQSISSYLIWYQQKPGTAPKFLIYAASSLQSGVPSRFSGSGSGTDFTLTISSLQPEDFATYYCQQSYSTPPITFGQGTRLEIK

SEQ ID NO: 11682 - protein, 11 aa, Artificial Sequence
  Description of Artificial Sequence: Synthetic peptide
  XENP018089 vlCDR1
RASQSISSYLI

SEQ ID NO: 11683 - protein, 7 aa, Artificial Sequence
  Description of Artificial Sequence: Synthetic peptide
  XENP018089 vlCDR2
AASSLQS

SEQ ID NO: 11684 - protein, 10 aa, Artificial Sequence
  Description of Artificial Sequence: Synthetic peptide
  XENP018089 vlCDR3
QQSYSTPPIT

SEQ ID NO: 11685 - protein, 446 aa, Artificial Sequence
  Description of Artificial Sequence: Synthetic polypeptide
  XENP018090 H2aM7791N_H0L0_IgG1 Heavy Chain
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11686 - protein, 116 aa, Artificial Sequence
  Description of Artificial Sequence: Synthetic polypeptide
  VH of XENP018090
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSS

SEQ ID NO: 11687 - protein, 5 aa, Artificial Sequence
  Description of Artificial Sequence: Synthetic peptide
  XENP018090 vhCDR1
GYYWS

SEQ ID NO: 11688 - protein, 16 aa, Artificial Sequence
  Description of Artificial Sequence: Synthetic peptide
  XENP018090 vhCDR2
EIDHSGSTNYNPSLKN

SEQ ID NO: 11689 - protein, 8 aa, Artificial Sequence
  Description of Artificial Sequence: Synthetic peptide
  XENP018090 vhCDR3
EGLLPFDY

SEQ ID NO: 11690 - protein, 215 aa, Artificial Sequence
  Description of Artificial Sequence: Synthetic polypeptide
  XENP018090 H2aM7791N_H0L0_IgG1 Light Chain
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11691 - protein, 108 aa, Artificial Sequence
  Description of Artificial Sequence: Synthetic polypeptide
  VL of XENP018090
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIK

SEQ ID NO: 11692 - protein, 12 aa, Artificial Sequence
  Description of Artificial Sequence: Synthetic peptide
  XENP018090 vlCDR1
RASQSVYSNYLA

SEQ ID NO: 11693 - protein, 7 aa, Artificial Sequence
  Description of Artificial Sequence: Synthetic peptide
  XENP018090 vlCDR2
AASNRAT

SEQ ID NO: 11694 - protein, 9 aa, Artificial Sequence
  Description of Artificial Sequence: Synthetic peptide
  XENP018090 vlCDR3
HQYATSPWT

SEQ ID NO: 11695 - protein, 446 aa, Artificial Sequence
  Description of Artificial Sequence: Synthetic polypeptide
  XENP018091 H2aM7796N_H0L0_IgG1 Heavy Chain
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11696 - protein, 116 aa, Artificial Sequence
  Description of Artificial Sequence: Synthetic polypeptide
  VH of XENP018091
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTVSS

SEQ ID NO: 11697 - protein, 5 aa, Artificial Sequence
  Description of Artificial Sequence: Synthetic peptide
  XENP018091 vhCDR1
SYGMH

SEQ ID NO: 11698 - protein, 17 aa, Artificial Sequence
  Description of Artificial Sequence: Synthetic peptide
  XENP018091 vhCDR2
IIWSDGDSEYNLDSVKG

SEQ ID NO: 11699 - protein, 7 aa, Artificial Sequence
  Description of Artificial Sequence: Synthetic peptide
  XENP018091 vhCDR3
DRDLEDI

SEQ ID NO: 11700 - protein, 214 aa, Artificial Sequence
  Description of Artificial Sequence: Synthetic polypeptide
  XENP018091 H2aM7796N_H0L0_IgG1 Light Chain
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11701 - protein, 107 aa, Artificial Sequence
  Description of Artificial Sequence: Synthetic polypeptide
  VL of XENP018091
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIK

SEQ ID NO: 11702 - protein, 11 aa, Artificial Sequence
  Description of Artificial Sequence: Synthetic peptide
  XENP018091 vlCDR1
RASQGIRNDLG

SEQ ID NO: 11703 - protein, 7 aa, Artificial Sequence
  Description of Artificial Sequence: Synthetic peptide
  XENP018091 vlCDR2
AASNLQS

SEQ ID NO: 11704 - protein, 9 aa, Artificial Sequence
  Description of Artificial Sequence: Synthetic peptide
  XENP018091 vlCDR3
LQHNSYPLT

SEQ ID NO: 11705 - protein, 451 aa, Artificial Sequence
  Description of Artificial Sequence: Synthetic polypeptide
  XENP018092 H4H9057P2_H0L0_IgG1 Heavy Chain
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11706 - protein, 121 aa, Artificial Sequence
  Description of Artificial Sequence: Synthetic polypeptide
  VH of XENP018092
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSS

SEQ ID NO: 11707 - protein, 5 aa, Artificial Sequence
  Description of Artificial Sequence: Synthetic peptide
  XENP018092 vhCDR1
DYAMH

SEQ ID NO: 11708 - protein, 17 aa, Artificial Sequence
  Description of Artificial Sequence: Synthetic peptide
  XENP018092 vhCDR2
GINWNRGRTGYADSVKG

SEQ ID NO: 11709 - protein, 12 aa, Artificial Sequence
  Description of Artificial Sequence: Synthetic peptide
  XENP018092 vhCDR3
AEQWLDEGYFDY

SEQ ID NO: 11710 - protein, 215 aa, Artificial Sequence
  Description of Artificial Sequence: Synthetic polypeptide
  XENP018092 H4H9057P2_H0L0_IgG1 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11711 - protein, 108 aa, Artificial Sequence
  Description of Artificial Sequence: Synthetic polypeptide
  VL of XENP018092
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 11712 - protein, 11 aa, Artificial Sequence
  Description of Artificial Sequence: Synthetic peptide
  XENP018092 vlCDR1
RASQSISSYLN

SEQ ID NO: 11713 - protein, 7 aa, Artificial Sequence
  Description of Artificial Sequence: Synthetic peptide
  XENP018092 vlCDR2
AASSLQS

SEQ ID NO: 11714 - protein, 10 aa, Artificial Sequence
  Description of Artificial Sequence: Synthetic peptide
  XENP018092 vlCDR3
QQSYSTPPIT

SEQ ID NO: 11715 - protein, 451 aa, Artificial Sequence
  Description of Artificial Sequence: Synthetic polypeptide
  XENP018093 H4H9068P2_H0L0_IgG1 Heavy Chain
EVQLVESGGGLVQPGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11716 - protein, 121 aa, Artificial Sequence
  Description of Artificial Sequence: Synthetic polypeptide
  VH of XENP018093
EVQLVESGGGLVQPGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSS

SEQ ID NO: 11717 - protein, 5 aa, Artificial Sequence
  Description of Artificial Sequence: Synthetic peptide
  XENP018093 vhCDR1
SYAMN

SEQ ID NO: 11718 - protein, 17 aa, Artificial Sequence
  Description of Artificial Sequence: Synthetic peptide
  XENP018093 vhCDR2
TISDSGGSTYYADSVKG

SEQ ID NO: 11719 - protein, 12 aa, Artificial Sequence
  Description of Artificial Sequence: Synthetic peptide
  XENP018093 vhCDR3
DQGGSYPYYFHY

SEQ ID NO: 11720 - protein, 215 aa, Artificial Sequence; identical to SEQ ID NO: 11710
  Description of Artificial Sequence: Synthetic polypeptide
  XENP018093 H4H9068P2_H0L0_IgG1 Light Chain

SEQ ID NO: 11721 - protein, 108 aa, Artificial Sequence; identical to SEQ ID NO: 11711
  Description of Artificial Sequence: Synthetic polypeptide
  VL of XENP018093

SEQ ID NO: 11722 - protein, 11 aa, Artificial Sequence
  Description of Artificial Sequence: Synthetic peptide
  XENP018093 vlCDR1
RASQSISSYLN

SEQ ID NO: 11723 - protein, 7 aa, Artificial Sequence
  Description of Artificial Sequence: Synthetic peptide
  XENP018093 vlCDR2
AASSLQS

SEQ ID NO: 11724 - protein, 10 aa, Artificial Sequence
  Description of Artificial Sequence: Synthetic peptide
  XENP018093 vlCDR3
QQSYSTPPIT

SEQ ID NO: 11725 - protein, 451 aa, Artificial Sequence
  Description of Artificial Sequence: Synthetic polypeptide
  XENP018094 1G6_H1.1_L1_IgG1_PVA_/S267K Heavy Chain
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11726 - protein, 122 aa, Artificial Sequence; identical to SEQ ID NO: 6363
  Description of Artificial Sequence: Synthetic polypeptide
  VH of XENP018094

SEQ ID NO: 11727 - protein, 5 aa, Artificial Sequence
  Description of Artificial Sequence: Synthetic peptide
  XENP018094 vhCDR1
NYWMN

SEQ ID NO: 11728 - protein, 19 aa, Artificial Sequence
  Description of Artificial Sequence: Synthetic peptide
  XENP018094 vhCDR2
EIRLKSNNYATHYAEPVKG

SEQ ID NO: 11729 - protein, 11 aa, Artificial Sequence
  Description of Artificial Sequence: Synthetic peptide
  XENP018094 vhCDR3
YYGNYGGYFDV

SEQ ID NO: 11730 - protein, 214 aa, Artificial Sequence; identical to SEQ ID NO: 11550
  Description of Artificial Sequence: Synthetic polypeptide
  XENP018094 1G6_H1.1_L1_IgG1_PVA_/S267K Light Chain

SEQ ID NO: 11731 - protein, 107 aa, Artificial Sequence; identical to SEQ ID NO: 6247
  Description of Artificial Sequence: Synthetic polypeptide
  VL of XENP018094

SEQ ID NO: 11732 - protein, 11 aa, Artificial Sequence
  Description of Artificial Sequence: Synthetic peptide
  XENP018094 vlCDR1
RASQSVSNDVA

SEQ ID NO: 11733 - protein, 7 aa, Artificial Sequence
  Description of Artificial Sequence: Synthetic peptide
  XENP018094 vlCDR2
YASHRYT

SEQ ID NO: 11734 - protein, 9 aa, Artificial Sequence
  Description of Artificial Sequence: Synthetic peptide
  XENP018094 vlCDR3
QQDYSSPRT

SEQ ID NO: 11735 - protein, 451 aa, Artificial Sequence
  Description of Artificial Sequence: Synthetic polypeptide
  XENP018095 1G6_H1.2_L1_IgG1_PVA_/S267K Heavy Chain
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11736 - protein, 122 aa, Artificial Sequence; identical to SEQ ID NO: 6372
  Description of Artificial Sequence: Synthetic polypeptide
  VH of XENP018095

SEQ ID NO: 11737 - protein, 5 aa, Artificial Sequence
  Description of Artificial Sequence: Synthetic peptide
  XENP018095 vhCDR1
NYWMN

SEQ ID NO: 11738 - protein, 19 aa, Artificial Sequence
  Description of Artificial Sequence: Synthetic peptide
  XENP018095 vhCDR2
EIRLKSNNYATHYAEPVKG

SEQ ID NO: 11739 - protein, 11 aa, Artificial Sequence
  Description of Artificial Sequence: Synthetic peptide
  XENP018095 vhCDR3
YYGNYGGYFDV

SEQ ID NO: 11740 - protein, 214 aa, Artificial Sequence; identical to SEQ ID NO: 11550
  Description of Artificial Sequence: Synthetic polypeptide
  XENP018095 1G6_H1.2_L1_IgG1_PVA_/S267K Light Chain

SEQ ID NO: 11741 - protein, 107 aa, Artificial Sequence; identical to SEQ ID NO: 6247
  Description of Artificial Sequence: Synthetic polypeptide
  VL of XENP018095

SEQ ID NO: 11742 - protein, 11 aa, Artificial Sequence
  Description of Artificial Sequence: Synthetic peptide
  XENP018095 vlCDR1
RASQSVSNDVA

SEQ ID NO: 11743 - protein, 7 aa, Artificial Sequence
  Description of Artificial Sequence: Synthetic peptide
  XENP018095 vlCDR2
YASHRYT

SEQ ID NO: 11744 - protein, 9 aa, Artificial Sequence
  Description of Artificial Sequence: Synthetic peptide
  XENP018095 vlCDR3
QQDYSSPRT

SEQ ID NO: 11745 - protein, 451 aa, Artificial Sequence
  Description of Artificial Sequence: Synthetic polypeptide
  XENP018096 1G6_H1.3_L1_IgG1_PVA_/S267K Heavy Chain
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11746 - protein, 122 aa, Artificial Sequence; identical to SEQ ID NO: 6381
  Description of Artificial Sequence: Synthetic polypeptide
  VH of XENP018096

SEQ ID NO: 11747 - protein, 5 aa, Artificial Sequence
  Description of Artificial Sequence: Synthetic peptide
  XENP018096 vhCDR1
NYWMN

SEQ ID NO: 11748 - protein, 19 aa, Artificial Sequence
  Description of Artificial Sequence: Synthetic peptide
  XENP018096 vhCDR2
EIRLKSNNYATHYAEPVKG

SEQ ID NO: 11749 - protein, 11 aa, Artificial Sequence
  Description of Artificial Sequence: Synthetic peptide
  XENP018096 vhCDR3
YYGNYGGYFDV

SEQ ID NO: 11750 - protein, 214 aa, Artificial Sequence; identical to SEQ ID NO: 11550
  Description of Artificial Sequence: Synthetic polypeptide
  XENP018096 1G6_H1.3_L1_IgG1_PVA_/S267K Light Chain

SEQ ID NO: 11751 - protein, 107 aa, Artificial Sequence; identical to SEQ ID NO: 6247
  Description of Artificial Sequence: Synthetic polypeptide
  VL of XENP018096

SEQ ID NO: 11752 - protein, 11 aa, Artificial Sequence
  Description of Artificial Sequence: Synthetic peptide
  XENP018096 vlCDR1
RASQSVSNDVA

SEQ ID NO: 11753 - protein, 7 aa, Artificial Sequence
  Description of Artificial Sequence: Synthetic peptide
  XENP018096 vlCDR2
YASHRYT

SEQ ID NO: 11754 - protein, 9 aa, Artificial Sequence
  Description of Artificial Sequence: Synthetic peptide
  XENP018096 vlCDR3
QQDYSSPRT

SEQ ID NO: 11755 - protein, 451 aa, Artificial Sequence
  Description of Artificial Sequence: Synthetic polypeptide
  XENP018101 1G6_H1.4_L1_IgG1_PVA_/S267K Heavy Chain
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11756 - protein, 122 aa, Artificial Sequence; identical to SEQ ID NO: 6390
  Description of Artificial Sequence: Synthetic polypeptide
  VH of XENP018101

SEQ ID NO: 11757 - protein, 5 aa, Artificial Sequence
  Description of Artificial Sequence: Synthetic peptide
  XENP018101 vhCDR1
NYWMN

SEQ ID NO: 11758 - protein, 19 aa, Artificial Sequence
  Description of Artificial Sequence: Synthetic peptide
  XENP018101 vhCDR2
EIRLKSNNYATHYAEPVKG

SEQ ID NO: 11759 - protein, 11 aa, Artificial Sequence
  Description of Artificial Sequence: Synthetic peptide
  XENP018101 vhCDR3
YYGNYGGYFDV

SEQ ID NO: 11760 - protein, 214 aa, Artificial Sequence; identical to SEQ ID NO: 11550
  Description of Artificial Sequence: Synthetic polypeptide
  XENP018101 1G6_H1.4_L1_IgG1_PVA_/S267K Light Chain

SEQ ID NO: 11761 - protein, 107 aa, Artificial Sequence; identical to SEQ ID NO: 6247
  Description of Artificial Sequence: Synthetic polypeptide
  VL of XENP018101

SEQ ID NO: 11762 - protein, 11 aa, Artificial Sequence
  Description of Artificial Sequence: Synthetic peptide
  XENP018101 vlCDR1
RASQSVSNDVA

SEQ ID NO: 11763 - protein, 7 aa, Artificial Sequence
  Description of Artificial Sequence: Synthetic peptide
  XENP018101 vlCDR2
YASHRYT

SEQ ID NO: 11764 - protein, 9 aa, Artificial Sequence
  Description of Artificial Sequence: Synthetic peptide
  XENP018101 vlCDR3
QQDYSSPRT

SEQ ID NO: 11765 - protein, 451 aa, Artificial Sequence
  Description of Artificial Sequence: Synthetic polypeptide
  XENP018102 1G6_H1.5_L1_IgG1_PVA_/S267K Heavy Chain
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11766 - protein, 122 aa, Artificial Sequence; identical to SEQ ID NO: 6399
  Description of Artificial Sequence: Synthetic polypeptide
  VH of XENP018102

SEQ ID NO: 11767 - protein, 5 aa, Artificial Sequence
  Description of Artificial Sequence: Synthetic peptide
  XENP018102 vhCDR1
NYWMN

SEQ ID NO: 11768 - protein, 19 aa, Artificial Sequence
  Description of Artificial Sequence: Synthetic peptide
  XENP018102 vhCDR2
EIRLKSNNYATHYAEPVKG

SEQ ID NO: 11769 - protein, 11 aa, Artificial Sequence
  Description of Artificial Sequence: Synthetic peptide
  XENP018102 vhCDR3
YYGNYGGYFDV

SEQ ID NO: 11770 - protein, 214 aa, Artificial Sequence; identical to SEQ ID NO: 11550
  Description of Artificial Sequence: Synthetic polypeptide
  XENP018102 1G6_H1.5_L1_IgG1_PVA_/S267K Light Chain

SEQ ID NO: 11771 - protein, 107 aa, Artificial Sequence; identical to SEQ ID NO: 6247
  Description of Artificial Sequence: Synthetic polypeptide
  VL of XENP018102

SEQ ID NO: 11772 - protein, 11 aa, Artificial Sequence
  Description of Artificial Sequence: Synthetic peptide
  XENP018102 vlCDR1
RASQSVSNDVA

SEQ ID NO: 11773 - protein, 7 aa, Artificial Sequence
  Description of Artificial Sequence: Synthetic peptide
  XENP018102 vlCDR2
YASHRYT

SEQ ID NO: 11774 - protein, 9 aa, Artificial Sequence
  Description of Artificial Sequence: Synthetic peptide
  XENP018102 vlCDR3
QQDYSSPRT

SEQ ID NO: 11775 - protein, 451 aa, Artificial Sequence
  Description of Artificial Sequence: Synthetic polypeptide
  XENP018103 1G6_H1.6_L1_IgG1_PVA_/S267K Heavy Chain
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11776 - protein, 122 aa, Artificial Sequence; identical to SEQ ID NO: 6408
  Description of Artificial Sequence: Synthetic polypeptide
  VH of XENP018103

SEQ ID NO: 11777 - protein, 5 aa, Artificial Sequence
  Description of Artificial Sequence: Synthetic peptide
  XENP018103 vhCDR1
NYWMN

SEQ ID NO: 11778 - protein, 19 aa, Artificial Sequence
  Description of Artificial Sequence: Synthetic peptide
  XENP018103 vhCDR2
EIRLKSNNYATHYAEPVKG

SEQ ID NO: 11779 - protein, 11 aa, Artificial Sequence
  Description of Artificial Sequence: Synthetic peptide
  XENP018103 vhCDR3
YYGNYGGYFDV

SEQ ID NO: 11780 - protein, 214 aa, Artificial Sequence; identical to SEQ ID NO: 11550
  Description of Artificial Sequence: Synthetic polypeptide
  XENP018103 1G6_H1.6_L1_IgG1_PVA_/S267K Light Chain

SEQ ID NO: 11781 - protein, 107 aa, Artificial Sequence; identical to SEQ ID NO: 6247
  Description of Artificial Sequence: Synthetic polypeptide
  VL of XENP018103

SEQ ID NO: 11782 - protein, 11 aa, Artificial Sequence
  Description of Artificial Sequence: Synthetic peptide
  XENP018103 vlCDR1
RASQSVSNDVA

SEQ ID NO: 11783 - protein, 7 aa, Artificial Sequence
  Description of Artificial Sequence: Synthetic peptide
  XENP018103 vlCDR2
YASHRYT

SEQ ID NO: 11784 - protein, 9 aa, Artificial Sequence
  Description of Artificial Sequence: Synthetic peptide
  XENP018103 vlCDR3
QQDYSSPRT

SEQ ID NO: 11785 - protein, 451 aa, Artificial Sequence
  Description of Artificial Sequence: Synthetic polypeptide
  XENP018104 1G6_H1.7_L1_IgG1_PVA_/S267K Heavy Chain
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11786 - protein, 122 aa, Artificial Sequence; identical to SEQ ID NO: 6417
  Description of Artificial Sequence: Synthetic polypeptide
  VH of XENP018104

SEQ ID NO: 11787 - protein, 5 aa, Artificial Sequence
  Description of Artificial Sequence: Synthetic peptide
  XENP018104 vhCDR1
NYWMN

SEQ ID NO: 11788 - protein, 19 aa, Artificial Sequence
  Description of Artificial Sequence: Synthetic peptide
  XENP018104 vhCDR2
EIRLKSNNYATHYAEPVKG

SEQ ID NO: 11789 - protein, 11 aa, Artificial Sequence
  Description of Artificial Sequence: Synthetic peptide
  XENP018104 vhCDR3
YYGNYGGYFDV

SEQ ID NO: 11790 - protein, 214 aa, Artificial Sequence; identical to SEQ ID NO: 11550
  Description of Artificial Sequence: Synthetic polypeptide
  XENP018104 1G6_H1.7_L1_IgG1_PVA_/S267K Light Chain

SEQ ID NO: 11791 - protein, 107 aa, Artificial Sequence; identical to SEQ ID NO: 6247
  Description of Artificial Sequence: Synthetic polypeptide
  VL of XENP018104

SEQ ID NO: 11792 - protein, 11 aa, Artificial Sequence
  Description of Artificial Sequence: Synthetic peptide
  XENP018104 vlCDR1
RASQSVSNDVA

SEQ ID NO: 11793 - protein, 7 aa, Artificial Sequence
  Description of Artificial Sequence: Synthetic peptide
  XENP018104 vlCDR2
YASHRYT

SEQ ID NO: 11794 - protein, 9 aa, Artificial Sequence
  Description of Artificial Sequence: Synthetic peptide
  XENP018104 vlCDR3
QQDYSSPRT

SEQ ID NO: 11795 - protein, 451 aa, Artificial Sequence
  Description of Artificial Sequence: Synthetic polypeptide
  XENP018105 1G6_H1.8_L1_IgG1_PVA_/S267K Heavy Chain
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11796 - protein, 122 aa, Artificial Sequence; identical to SEQ ID NO: 6426
  Description of Artificial Sequence: Synthetic polypeptide
  VH of XENP018105

SEQ ID NO: 11797 - protein, 5 aa, Artificial Sequence
  Description of Artificial Sequence: Synthetic peptide
  XENP018105 vhCDR1
NYWMN

SEQ ID NO: 11798 - protein, 19 aa, Artificial Sequence
  Description of Artificial Sequence: Synthetic peptide
  XENP018105 vhCDR2
EIRLKSNNYATHYAEPVKG

SEQ ID NO: 11799 - protein, 11 aa, Artificial Sequence
  Description of Artificial Sequence: Synthetic peptide
  XENP018105 vhCDR3
YYGNYGGYFDV

SEQ ID NO: 11800 - protein, 214 aa, Artificial Sequence; identical to SEQ ID NO: 11550
  Description of Artificial Sequence: Synthetic polypeptide
  XENP018105 1G6_H1.8_L1_IgG1_PVA_/S267K Light Chain

SEQ ID NO: 11801 - protein, 107 aa, Artificial Sequence; identical to SEQ ID NO: 6247
  Description of Artificial Sequence: Synthetic polypeptide
  VL of XENP018105

SEQ ID NO: 11802 - protein, 11 aa, Artificial Sequence
  Description of Artificial Sequence: Synthetic peptide
  XENP018105 vlCDR1
RASQSVSNDVA

SEQ ID NO: 11803 - protein, 7 aa, Artificial Sequence
  Description of Artificial Sequence: Synthetic peptide
  XENP018105 vlCDR2
YASHRYT

SEQ ID NO: 11804 - protein, 9 aa, Artificial Sequence
  Description of Artificial Sequence: Synthetic peptide
  XENP018105 vlCDR3
QQDYSSPRT

SEQ ID NO: 11805 - protein, 451 aa, Artificial Sequence
  Description of Artificial Sequence: Synthetic polypeptide
  XENP018106 1G6_H1.9_L1_IgG1_PVA_/S267K Heavy Chain
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11806 - protein, 122 aa, Artificial Sequence; identical to SEQ ID NO: 6435
  Description of Artificial Sequence: Synthetic polypeptide
  VH of XENP018106

SEQ ID NO: 11807 - protein, 5 aa, Artificial Sequence
  Description of Artificial Sequence: Synthetic peptide
  XENP018106 vhCDR1
NYWMN

SEQ ID NO: 11808 - protein, 19 aa, Artificial Sequence
  Description of Artificial Sequence: Synthetic peptide
  XENP018106 vhCDR2
EIRLKSNNYATHYAEPVKG

SEQ ID NO: 11809 - protein, 11 aa, Artificial Sequence
  Description of Artificial Sequence: Synthetic peptide
  XENP018106 vhCDR3
YYGNYGGYFDV

SEQ ID NO: 11810 - protein, 214 aa, Artificial Sequence; identical to SEQ ID NO: 11550
  Description of Artificial Sequence: Synthetic polypeptide
  XENP018106 1G6_H1.9_L1_IgG1_PVA_/S267K Light Chain

SEQ ID NO: 11811 - protein, 107 aa, Artificial Sequence; identical to SEQ ID NO: 6247
  Description of Artificial Sequence: Synthetic polypeptide
  VL of XENP018106

SEQ ID NO: 11812 - protein, 11 aa, Artificial Sequence
  Description of Artificial Sequence: Synthetic peptide
  XENP018106 vlCDR1
RASQSVSNDVA

SEQ ID NO: 11813 - protein, 7 aa, Artificial Sequence
  Description of Artificial Sequence: Synthetic peptide
  XENP018106 vlCDR2
YASHRYT

SEQ ID NO: 11814 - protein, 9 aa, Artificial Sequence
  Description of Artificial Sequence: Synthetic peptide
  XENP018106 vlCDR3
QQDYSSPRT

SEQ ID NO: 11815 - protein, 451 aa, Artificial Sequence
  Description of Artificial Sequence: Synthetic polypeptide
  XENP018107 1G6_H1.10_L1_IgG1_PVA_/S267K Heavy Chain
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11816 - protein, 122 aa, Artificial Sequence; identical to SEQ ID NO: 6444
  Description of Artificial Sequence: Synthetic polypeptide
  VH of XENP018107

SEQ ID NO: 11817 - protein, 5 aa, Artificial Sequence
  Description of Artificial Sequence: Synthetic peptide
  XENP018107 vhCDR1
NYWMN

SEQ ID NO: 11818 - protein, 19 aa, Artificial Sequence
  Description of Artificial Sequence: Synthetic peptide
  XENP018107 vhCDR2
EIRLKSNNYATHYAEPVKG

SEQ ID NO: 11819 - protein, 11 aa, Artificial Sequence
  Description of Artificial Sequence: Synthetic peptide
  XENP018107 vhCDR3
YYGNYGGYFDV

SEQ ID NO: 11820 - protein, 214 aa, Artificial Sequence; identical to SEQ ID NO: 11550
  Description of Artificial Sequence: Synthetic polypeptide
  XENP018107 1G6_H1.10_L1_IgG1_PVA_/S267K Light Chain

SEQ ID NO: 11821 - protein, 107 aa, Artificial Sequence; identical to SEQ ID NO: 6247
  Description of Artificial Sequence: Synthetic polypeptide
  VL of XENP018107

SEQ ID NO: 11822 - protein, 11 aa, Artificial Sequence
  Description of Artificial Sequence: Synthetic peptide
  XENP018107 vlCDR1
RASQSVSNDVA

SEQ ID NO: 11823 - protein, 7 aa, Artificial Sequence
  Description of Artificial Sequence: Synthetic peptide
  XENP018107 vlCDR2
YASHRYT

SEQ ID NO: 11824 - protein, 9 aa, Artificial Sequence
  Description of Artificial Sequence: Synthetic peptide
  XENP018107 vlCDR3
QQDYSSPRT

SEQ ID NO: 11825 - protein, 451 aa, Artificial Sequence
  Description of Artificial Sequence: Synthetic polypeptide
  XENP018108 1G6_H1.11_L1_IgG1_PVA_/S267K Heavy Chain
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11826 - protein, 122 aa, Artificial Sequence; identical to SEQ ID NO: 6453
  Description of Artificial Sequence: Synthetic polypeptide
  VH of XENP018108

SEQ ID NO: 11827 - protein, 5 aa, Artificial Sequence
  Description of Artificial Sequence: Synthetic peptide
  XENP018108 vhCDR1
NYWMN

SEQ ID NO: 11828 - protein, 19 aa, Artificial Sequence
  Description of Artificial Sequence: Synthetic peptide
  XENP018108 vhCDR2
EIRLKSNNYATHYAEPVKG

SEQ ID NO: 11829 - protein, 11 aa, Artificial Sequence
  Description of Artificial Sequence: Synthetic peptide
  XENP018108 vhCDR3
YYGNYGGYFDV

SEQ ID NO: 11830 - protein, 214 aa, Artificial Sequence; identical to SEQ ID NO: 11550
  Description of Artificial Sequence: Synthetic polypeptide
  XENP018108 1G6_H1.11_L1_IgG1_PVA_/S267K Light Chain

SEQ ID NO: 11831 - protein, 107 aa, Artificial Sequence; identical to SEQ ID NO: 6247
  Description of Artificial Sequence: Synthetic polypeptide
  VL of XENP018108

SEQ ID NO: 11832 - protein, 11 aa, Artificial Sequence
  Description of Artificial Sequence: Synthetic peptide
  XENP018108 vlCDR1
RASQSVSNDVA

SEQ ID NO: 11833 - protein, 7 aa, Artificial Sequence
  Description of Artificial Sequence: Synthetic peptide
  XENP018108 vlCDR2
YASHRYT

SEQ ID NO: 11834 - protein, 9 aa, Artificial Sequence
  Description of Artificial Sequence: Synthetic peptide
  XENP018108 vlCDR3
QQDYSSPRT

SEQ ID NO: 11835 - protein, 451 aa, Artificial Sequence
  Description of Artificial Sequence: Synthetic polypeptide
  XENP018109 1G6_H1.12_L1_IgG1_PVA_/S267K Heavy Chain
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11836 - protein, 122 aa, Artificial Sequence; identical to SEQ ID NO: 6462
  Description of Artificial Sequence: Synthetic polypeptide
  VH of XENP018109

SEQ ID NO: 11837 - protein, 5 aa, Artificial Sequence
  Description of Artificial Sequence: Synthetic peptide
  XENP018109 vhCDR1
NYWMN

SEQ ID NO: 11838 - protein, 19 aa, Artificial Sequence
  Description of Artificial Sequence: Synthetic peptide
  XENP018109 vhCDR2
EIRLKSNNYATHYAEPVKG

SEQ ID NO: 11839 - protein, 11 aa, Artificial Sequence
  Description of Artificial Sequence: Synthetic peptide
  XENP018109 vhCDR3
YYGNYGGYFDV

SEQ ID NO: 11840 - protein, 214 aa, Artificial Sequence; identical to SEQ ID NO: 11550
  Description of Artificial Sequence: Synthetic polypeptide
  XENP018109 1G6_H1.12_L1_IgG1_PVA_/S267K Light Chain

SEQ ID NO: 11841 - protein, 107 aa, Artificial Sequence; identical to SEQ ID NO: 6247
  Description of Artificial Sequence: Synthetic polypeptide
  VL of XENP018109

SEQ ID NO: 11842 - protein, 11 aa, Artificial Sequence
  Description of Artificial Sequence: Synthetic peptide
  XENP018109 vlCDR1
RASQSVSNDVA

SEQ ID NO: 11843 - protein, 7 aa, Artificial Sequence
  Description of Artificial Sequence: Synthetic peptide
  XENP018109 vlCDR2
YASHRYT

SEQ ID NO: 11844 - protein, 9 aa, Artificial Sequence
  Description of Artificial Sequence: Synthetic peptide
  XENP018109 vlCDR3
QQDYSSPRT

SEQ ID NO: 11845 - protein, 451 aa, Artificial Sequence
  Description of Artificial Sequence: Synthetic polypeptide
  XENP018110 1G6_H1.13_L1_IgG1_PVA_/S267K Heavy Chain
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11846 - protein, 122 aa, Artificial Sequence; identical to SEQ ID NO: 6471
  Description of Artificial Sequence: Synthetic polypeptide
  VH of XENP018110

SEQ ID NO: 11847 - protein, 5 aa, Artificial Sequence
  Description of Artificial Sequence: Synthetic peptide
  XENP018110 vhCDR1
NYWMN

SEQ ID NO: 11848 - protein, 19 aa, Artificial Sequence
  Description of Artificial Sequence: Synthetic peptide
  XENP018110 vhCDR2
EIRLKSNNYATHYAEPVKG

SEQ ID NO: 11849 - protein, 11 aa, Artificial Sequence
  Description of Artificial Sequence: Synthetic peptide
  XENP018110 vhCDR3
YYGNYGGYFDV

SEQ ID NO: 11850 - protein, 214 aa, Artificial Sequence; identical to SEQ ID NO: 11550
  Description of Artificial Sequence: Synthetic polypeptide
  XENP018110 1G6_H1.13_L1_IgG1_PVA_/S267K Light Chain

SEQ ID NO: 11851 - protein, 107 aa, Artificial Sequence; identical to SEQ ID NO: 6247
  Description of Artificial Sequence: Synthetic polypeptide
  VL of XENP018110

SEQ ID NO: 11852 - protein, 11 aa, Artificial Sequence
  Description of Artificial Sequence: Synthetic peptide
  XENP018110 vlCDR1
RASQSVSNDVA

SEQ ID NO: 11853 - protein, 7 aa, Artificial Sequence
  Description of Artificial Sequence: Synthetic peptide
  XENP018110 vlCDR2
YASHRYT

SEQ ID NO: 11854 - protein, 9 aa, Artificial Sequence
  Description of Artificial Sequence: Synthetic peptide
  XENP018110 vlCDR3
QQDYSSPRT

SEQ ID NO: 11855 - protein, 451 aa, Artificial Sequence
  Description of Artificial Sequence: Synthetic polypeptide
  XENP018111 1G6_H1.14_L1_IgG1_PVA_/S267K Heavy Chain
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11856 - protein, 122 aa, Artificial Sequence; identical to SEQ ID NO: 6480
  Description of Artificial Sequence: Synthetic polypeptide
  VH of XENP018111

SEQ ID NO: 11857 - protein, 5 aa, Artificial Sequence
  Description of Artificial Sequence: Synthetic peptide
  XENP018111 vhCDR1
NYWMN

SEQ ID NO: 11858 - protein, 19 aa, Artificial Sequence
  Description of Artificial Sequence: Synthetic peptide
  XENP018111 vhCDR2
EIRLKSNNYATHYAEPVKG

SEQ ID NO: 11859 - protein, 11 aa, Artificial Sequence
  Description of Artificial Sequence: Synthetic peptide
  XENP018111 vhCDR3
YYGNYGGYFDV

SEQ ID NO: 11860 - protein, 214 aa, Artificial Sequence; identical to SEQ ID NO: 11550
  Description of Artificial Sequence: Synthetic polypeptide
  XENP018111 1G6_H1.14_L1_IgG1_PVA_/S267K Light Chain

SEQ ID NO: 11861 - protein, 107 aa, Artificial Sequence; identical to SEQ ID NO: 6247
  Description of Artificial Sequence: Synthetic polypeptide
  VL of XENP018111

SEQ ID NO: 11862 - protein, 11 aa, Artificial Sequence
  Description of Artificial Sequence: Synthetic peptide
  XENP018111 vlCDR1
RASQSVSNDVA

SEQ ID NO: 11863 - protein, 7 aa, Artificial Sequence
  Description of Artificial Sequence: Synthetic peptide
  XENP018111 vlCDR2
YASHRYT

SEQ ID NO: 11864 - protein, 9 aa, Artificial Sequence
  Description of Artificial Sequence: Synthetic peptide
  XENP018111 vlCDR3
QQDYSSPRT

SEQ ID NO: 11865 - protein, 451 aa, Artificial Sequence
  Description of Artificial Sequence: Synthetic polypeptide
  XENP018112 1G6_H1.15_L1_IgG1_PVA_/S267K Heavy Chain
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11866 - protein, 122 aa, Artificial Sequence; identical to SEQ ID NO: 6489
  Description of Artificial Sequence: Synthetic polypeptide
  VH of XENP018112

SEQ ID NO: 11867 - protein, 5 aa, Artificial Sequence
  Description of Artificial Sequence: Synthetic peptide
  XENP018112 vhCDR1
NYWMN

SEQ ID NO: 11868 - protein, 19 aa, Artificial Sequence
  Description of Artificial Sequence: Synthetic peptide
  XENP018112 vhCDR2
EIRLKSNNYATHYAEPVKG

SEQ ID NO: 11869 - protein, 11 aa, Artificial Sequence
  Description of Artificial Sequence: Synthetic peptide
  XENP018112 vhCDR3
YYGNYGGYFDV

SEQ ID NO: 11870 - protein, 214 aa, Artificial Sequence; identical to SEQ ID NO: 11550
  Description of Artificial Sequence: Synthetic polypeptide
  XENP018112 1G6_H1.15_L1_IgG1_PVA_/S267K Light Chain

SEQ ID NO: 11871 - protein, 107 aa, Artificial Sequence; identical to SEQ ID NO: 6247
  Description of Artificial Sequence: Synthetic polypeptide
  VL of XENP018112

SEQ ID NO: 11872 - protein, 11 aa, Artificial Sequence
  Description of Artificial Sequence: Synthetic peptide
  XENP018112 vlCDR1
RASQSVSNDVA

SEQ ID NO: 11873 - protein, 7 aa, Artificial Sequence
  Description of Artificial Sequence: Synthetic peptide
  XENP018112 vlCDR2
YASHRYT

SEQ ID NO: 11874 - protein, 9 aa, Artificial Sequence
  Description of Artificial Sequence: Synthetic peptide
  XENP018112 vlCDR3
QQDYSSPRT

SEQ ID NO: 11875 - protein, 451 aa, Artificial Sequence
  Description of Artificial Sequence: Synthetic polypeptide
  XENP018113 1G6_H1.16_L1_IgG1_PVA_/S267K Heavy Chain
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11876 - protein, 122 aa, Artificial Sequence; identical to SEQ ID NO: 6498
  Description of Artificial Sequence: Synthetic polypeptide
  VH of XENP018113

SEQ ID NO: 11877 - protein, 5 aa, Artificial Sequence
  Description of Artificial Sequence: Synthetic peptide
  XENP018113 vhCDR1
NYWMN

SEQ ID NO: 11878 - protein, 19 aa, Artificial Sequence
  Description of Artificial Sequence: Synthetic peptide
  XENP018113 vhCDR2
EIRLKSNNYATHYAEPVKG

SEQ ID NO: 11879 - protein, 11 aa, Artificial Sequence
  Description of Artificial Sequence: Synthetic peptide
  XENP018113 vhCDR3
YYGNYGGYFDV

SEQ ID NO: 11880 - protein, 214 aa, Artificial Sequence; identical to SEQ ID NO: 11550
  Description of Artificial Sequence: Synthetic polypeptide
  XENP018113 1G6_H1.16_L1_IgG1_PVA_/S267K Light Chain

SEQ ID NO: 11881 - protein, 107 aa, Artificial Sequence; identical to SEQ ID NO: 6247
  Description of Artificial Sequence: Synthetic polypeptide
  VL of XENP018113

SEQ ID NO: 11882 - protein, 11 aa, Artificial Sequence
  Description of Artificial Sequence: Synthetic peptide
  XENP018113 vlCDR1
RASQSVSNDVA

SEQ ID NO: 11883 - protein, 7 aa, Artificial Sequence
  Description of Artificial Sequence: Synthetic peptide
  XENP018113 vlCDR2
YASHRYT

SEQ ID NO: 11884 - protein, 9 aa, Artificial Sequence
  Description of Artificial Sequence: Synthetic peptide
  XENP018113 vlCDR3
QQDYSSPRT

SEQ ID NO: 11885 - protein, 451 aa, Artificial Sequence
  Description of Artificial Sequence: Synthetic polypeptide
  XENP018114 1G6_H1.17_L1_IgG1_PVA_/S267K Heavy Chain
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11886 - protein, 122 aa, Artificial Sequence; identical to SEQ ID NO: 6507
  Description of Artificial Sequence: Synthetic polypeptide
  VH of XENP018114

SEQ ID NO: 11887 - protein, 5 aa, Artificial Sequence
  Description of Artificial Sequence: Synthetic peptide
  XENP018114 vhCDR1
NYWMN

SEQ ID NO: 11888 - protein, 19 aa, Artificial Sequence
  Description of Artificial Sequence: Synthetic peptide
  XENP018114 vhCDR2
EIRLKSNNYATHYAEPVKG

SEQ ID NO: 11889 - protein, 11 aa, Artificial Sequence
  Description of Artificial Sequence: Synthetic peptide
  XENP018114 vhCDR3
YYGNYGGYFDV

SEQ ID NO: 11890 - protein, 214 aa, Artificial Sequence; identical to SEQ ID NO: 11550
  Description of Artificial Sequence: Synthetic polypeptide
  XENP018114 1G6_H1.17_L1_IgG1_PVA_/S267K Light Chain

SEQ ID NO: 11891 - protein, 107 aa, Artificial Sequence; identical to SEQ ID NO: 6247
  Description of Artificial Sequence: Synthetic polypeptide
  VL of XENP018114

SEQ ID NO: 11892 - protein, 11 aa, Artificial Sequence
  Description of Artificial Sequence: Synthetic peptide
  XENP018114 vlCDR1
RASQSVSNDVA

SEQ ID NO: 11893 - protein, 7 aa, Artificial Sequence
  Description of Artificial Sequence: Synthetic peptide
  XENP018114 vlCDR2
YASHRYT

SEQ ID NO: 11894 - protein, 9 aa, Artificial Sequence
  Description of Artificial Sequence: Synthetic peptide
  XENP018114 vlCDR3
QQDYSSPRT

SEQ ID NO: 11895 - protein, 451 aa, Artificial Sequence
  Description of Artificial Sequence: Synthetic polypeptide
  XENP018115 1G6_H1.18_L1_IgG1_PVA_/S267K Heavy Chain
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11896 - protein, 122 aa, Artificial Sequence; identical to SEQ ID NO: 6516
  Description of Artificial Sequence: Synthetic polypeptide
  VH of XENP018115

SEQ ID NO: 11897 - protein, 5 aa, Artificial Sequence
  Description of Artificial Sequence: Synthetic peptide
  XENP018115 vhCDR1
NYWMN

SEQ ID NO: 11898 - protein, 19 aa, Artificial Sequence
  Description of Artificial Sequence: Synthetic peptide
  XENP018115 vhCDR2
EIRLKSNNYATHYAEPVKG

SEQ ID NO: 11899 - protein, 11 aa, Artificial Sequence
  Description of Artificial Sequence: Synthetic peptide
  XENP018115 vhCDR3
YYGNYGGYFDV

SEQ ID NO: 11900 - protein, 214 aa, Artificial Sequence; identical to SEQ ID NO: 11550
  Description of Artificial Sequence: Synthetic polypeptide
  XENP018115 1G6_H1.18_L1_IgG1_PVA_/S267K Light Chain

SEQ ID NO: 11901 - protein, 107 aa, Artificial Sequence; identical to SEQ ID NO: 6247
  Description of Artificial Sequence: Synthetic polypeptide
  VL of XENP018115

SEQ ID NO: 11902 - protein, 11 aa, Artificial Sequence
  Description of Artificial Sequence: Synthetic peptide
  XENP018115 vlCDR1
RASQSVSNDVA

SEQ ID NO: 11903 - protein, 7 aa, Artificial Sequence
  Description of Artificial Sequence: Synthetic peptide
  XENP018115 vlCDR2
YASHRYT

SEQ ID NO: 11904 - protein, 9 aa, Artificial Sequence
  Description of Artificial Sequence: Synthetic peptide
  XENP018115 vlCDR3
QQDYSSPRT

SEQ ID NO: 11905 - protein, 451 aa, Artificial Sequence
  Description of Artificial Sequence: Synthetic polypeptide
  XENP018116 1G6_H1.19_L1_IgG1_PVA_/S267K Heavy Chain
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11906 - protein, 122 aa, Artificial Sequence; identical to SEQ ID NO: 6525
  Description of Artificial Sequence: Synthetic polypeptide
  VH of XENP018116

SEQ ID NO: 11907 - protein, 5 aa, Artificial Sequence
  Description of Artificial Sequence: Synthetic peptide
  XENP018116 vhCDR1
DYWMN

SEQ ID NO: 11908 - protein, 19 aa, Artificial Sequence
  Description of Artificial Sequence: Synthetic peptide
  XENP018116 vhCDR2
EIRLKSNNYATHYAEPVKG

SEQ ID NO: 11909 - protein, 11 aa, Artificial Sequence
  Description of Artificial Sequence: Synthetic peptide
  XENP018116 vhCDR3
YYGNYGGYFDV

SEQ ID NO: 11910 - protein, 214 aa, Artificial Sequence; identical to SEQ ID NO: 11550
  Description of Artificial Sequence: Synthetic polypeptide
  XENP018116 1G6_H1.19_L1_IgG1_PVA_/S267K Light Chain

SEQ ID NO: 11911 - protein, 107 aa, Artificial Sequence; identical to SEQ ID NO: 6247
  Description of Artificial Sequence: Synthetic polypeptide
  VL of XENP018116

SEQ ID NO: 11912 - protein, 11 aa, Artificial Sequence
  Description of Artificial Sequence: Synthetic peptide
  XENP018116 vlCDR1
RASQSVSNDVA

SEQ ID NO: 11913 - protein, 7 aa, Artificial Sequence
  Description of Artificial Sequence: Synthetic peptide
  XENP018116 vlCDR2
YASHRYT

SEQ ID NO: 11914 - protein, 9 aa, Artificial Sequence
  Description of Artificial Sequence: Synthetic peptide
  XENP018116 vlCDR3
QQDYSSPRT

SEQ ID NO: 11915 - protein, 451 aa, Artificial Sequence
  Description of Artificial Sequence: Synthetic polypeptide
  XENP018117 1G6_H1.20_L1_IgG1_PVA_/S267K Heavy Chain
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11916 - protein, 122 aa, Artificial Sequence; identical to SEQ ID NO: 6534
  Description of Artificial Sequence: Synthetic polypeptide
  VH of XENP018117

SEQ ID NO: 11917 - protein, 5 aa, Artificial Sequence
  Description of Artificial Sequence: Synthetic peptide
  XENP018117 vhCDR1
HYWMN

SEQ ID NO: 11918 - protein, 19 aa, Artificial Sequence
  Description of Artificial Sequence: Synthetic peptide
  XENP018117 vhCDR2
EIRLKSNNYATHYAEPVKG

SEQ ID NO: 11919 - protein, 11 aa, Artificial Sequence
  Description of Artificial Sequence: Synthetic peptide
  XENP018117 vhCDR3
YYGNYGGYFDV

SEQ ID NO: 11920 - protein, 214 aa, Artificial Sequence; identical to SEQ ID NO: 11550
  Description of Artificial Sequence: Synthetic polypeptide
  XENP018117 1G6_H1.20_L1_IgG1_PVA_/S267K Light Chain

SEQ ID NO: 11921 - protein, 107 aa, Artificial Sequence; identical to SEQ ID NO: 6247
  Description of Artificial Sequence: Synthetic polypeptide
  VL of XENP018117

SEQ ID NO: 11922 - protein, 11 aa, Artificial Sequence
  Description of Artificial Sequence: Synthetic peptide
  XENP018117 vlCDR1
RASQSVSNDVA

SEQ ID NO: 11923 - protein, 7 aa, Artificial Sequence
  Description of Artificial Sequence: Synthetic peptide
  XENP018117 vlCDR2
YASHRYT

SEQ ID NO: 11924 - protein, 9 aa, Artificial Sequence
  Description of Artificial Sequence: Synthetic peptide
  XENP018117 vlCDR3
QQDYSSPRT

SEQ ID NO: 11925 - protein, 451 aa, Artificial Sequence
  Description of Artificial Sequence: Synthetic polypeptide
  XENP018118 1G6_H1.21_L1_IgG1_PVA_/S267K Heavy Chain
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11926 - protein, 122 aa, Artificial Sequence; identical to SEQ ID NO: 6543
  Description of Artificial Sequence: Synthetic polypeptide
  VH of XENP018118

SEQ ID NO: 11927 - protein, 5 aa, Artificial Sequence
  Description of Artificial Sequence: Synthetic peptide
  XENP018118 vhCDR1
EYWMN

SEQ ID NO: 11928 - protein, 19 aa, Artificial Sequence
  Description of Artificial Sequence: Synthetic peptide
  XENP018118 vhCDR2
EIRLKSNNYATHYAEPVKG

SEQ ID NO: 11929 - protein, 11 aa, Artificial Sequence
  Description of Artificial Sequence: Synthetic peptide
  XENP018118 vhCDR3
YYGNYGGYFDV

SEQ ID NO: 11930 - protein, 214 aa, Artificial Sequence; identical to SEQ ID NO: 11550
  Description of Artificial Sequence: Synthetic polypeptide
  XENP018118 1G6_H1.21_L1_IgG1_PVA_/S267K Light Chain

SEQ ID NO: 11931 - protein, 107 aa, Artificial Sequence; identical to SEQ ID NO: 6247
  Description of Artificial Sequence: Synthetic polypeptide
  VL of XENP018118

SEQ ID NO: 11932 - protein, 11 aa, Artificial Sequence
  Description of Artificial Sequence: Synthetic peptide
  XENP018118 vlCDR1
RASQSVSNDVA

SEQ ID NO: 11933 - protein, 7 aa, Artificial Sequence
  Description of Artificial Sequence: Synthetic peptide
  XENP018118 vlCDR2
YASHRYT

SEQ ID NO: 11934 - protein, 9 aa, Artificial Sequence
  Description of Artificial Sequence: Synthetic peptide
  XENP018118 vlCDR3
QQDYSSPRT

SEQ ID NO: 11935 - protein, 451 aa, Artificial Sequence
  Description of Artificial Sequence: Synthetic polypeptide
  XENP018119 1G6_H1.22_L1_IgG1_PVA_/S267K Heavy Chain
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11936 - protein, 122 aa, Artificial Sequence; identical to SEQ ID NO: 6552
  Description of Artificial Sequence: Synthetic polypeptide
  VH of XENP018119

SEQ ID NO: 11937 - protein, 5 aa, Artificial Sequence
  Description of Artificial Sequence: Synthetic peptide
  XENP018119 vhCDR1
SYWMN

SEQ ID NO: 11938 - protein, 19 aa, Artificial Sequence
  Description of Artificial Sequence: Synthetic peptide
  XENP018119 vhCDR2
EIRLKSNNYATHYAEPVKG

SEQ ID NO: 11939 - protein, 11 aa, Artificial Sequence
  Description of Artificial Sequence: Synthetic peptide
  XENP018119 vhCDR3
YYGNYGGYFDV

SEQ ID NO: 11940 - protein, 214 aa, Artificial Sequence; identical to SEQ ID NO: 11550
  Description of Artificial Sequence: Synthetic polypeptide
  XENP018119 1G6_H1.22_L1_IgG1_PVA_/S267K Light Chain

SEQ ID NO: 11941 - protein, 107 aa, Artificial Sequence; identical to SEQ ID NO: 6247
  Description of Artificial Sequence: Synthetic polypeptide
  VL of XENP018119

SEQ ID NO: 11942 - protein, 11 aa, Artificial Sequence
  Description of Artificial Sequence: Synthetic peptide
  XENP018119 vlCDR1
RASQSVSNDVA

SEQ ID NO: 11943 - protein, 7 aa, Artificial Sequence
  Description of Artificial Sequence: Synthetic peptide
  XENP018119 vlCDR2
YASHRYT

SEQ ID NO: 11944 - protein, 9 aa, Artificial Sequence
  Description of Artificial Sequence: Synthetic peptide
  XENP018119 vlCDR3
QQDYSSPRT

SEQ ID NO: 11945 - protein, 451 aa, Artificial Sequence
  Description of Artificial Sequence: Synthetic polypeptide
  XENP018120 1G6_H1.23_L1_IgG1_PVA_/S267K Heavy Chain
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11946 - protein, 122 aa, Artificial Sequence; identical to SEQ ID NO: 6561
  Description of Artificial Sequence: Synthetic polypeptide
  VH of XENP018120

SEQ ID NO: 11947 - protein, 5 aa, Artificial Sequence
  Description of Artificial Sequence: Synthetic peptide
  XENP018120 vhCDR1
RYWMN

SEQ ID NO: 11948 - protein, 19 aa, Artificial Sequence
  Description of Artificial Sequence: Synthetic peptide
  XENP018120 vhCDR2
EIRLKSNNYATHYAEPVKG

SEQ ID NO: 11949 - protein, 11 aa, Artificial Sequence
  Description of Artificial Sequence: Synthetic peptide
  XENP018120 vhCDR3
YYGNYGGYFDV

SEQ ID NO: 11950 - protein, 214 aa, Artificial Sequence; identical to SEQ ID NO: 11550
  Description of Artificial Sequence: Synthetic polypeptide
  XENP018120 1G6_H1.23_L1_IgG1_PVA_/S267K Light Chain

SEQ ID NO: 11951 - protein, 107 aa, Artificial Sequence; identical to SEQ ID NO: 6247
  Description of Artificial Sequence: Synthetic polypeptide
  VL of XENP018120

SEQ ID NO: 11952 - protein, 11 aa, Artificial Sequence
  Description of Artificial Sequence: Synthetic peptide
  XENP018120 vlCDR1
RASQSVSNDVA

SEQ ID NO: 11953 - protein, 7 aa, Artificial Sequence
  Description of Artificial Sequence: Synthetic peptide
  XENP018120 vlCDR2
YASHRYT

SEQ ID NO: 11954 - protein, 9 aa, Artificial Sequence
  Description of Artificial Sequence: Synthetic peptide
  XENP018120 vlCDR3
QQDYSSPRT

SEQ ID NO: 11955 - protein, 451 aa, Artificial Sequence
  Description of Artificial Sequence: Synthetic polypeptide
  XENP018121 1G6_H1.24_L1_IgG1_PVA_/S267K Heavy Chain
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11956 - protein, 122 aa, Artificial Sequence; identical to SEQ ID NO: 6570
  Description of Artificial Sequence: Synthetic polypeptide
  VH of XENP018121

SEQ ID NO: 11957 - protein, 5 aa, Artificial Sequence
  Description of Artificial Sequence: Synthetic peptide
  XENP018121 vhCDR1
LYWMN

SEQ ID NO: 11958 - protein, 19 aa, Artificial Sequence
  Description of Artificial Sequence: Synthetic peptide
  XENP018121 vhCDR2
EIRLKSNNYATHYAEPVKG

SEQ ID NO: 11959 - protein, 11 aa, Artificial Sequence
  Description of Artificial Sequence: Synthetic peptide
  XENP018121 vhCDR3
YYGNYGGYFDV

SEQ ID NO: 11960 - protein, 214 aa, Artificial Sequence; identical to SEQ ID NO: 11550
  Description of Artificial Sequence: Synthetic polypeptide
  XENP018121 1G6_H1.24_L1_IgG1_PVA_/S267K Light Chain

SEQ ID NO: 11961 - protein, 107 aa, Artificial Sequence; identical to SEQ ID NO: 6247
  Description of Artificial Sequence: Synthetic polypeptide
  VL of XENP018121

SEQ ID NO: 11962 - protein, 11 aa, Artificial Sequence
  Description of Artificial Sequence: Synthetic peptide
  XENP018121 vlCDR1
RASQSVSNDVA

SEQ ID NO: 11963 - protein, 7 aa, Artificial Sequence
  Description of Artificial Sequence: Synthetic peptide
  XENP018121 vlCDR2
YASHRYT

SEQ ID NO: 11964 - protein, 9 aa, Artificial Sequence
  Description of Artificial Sequence: Synthetic peptide
  XENP018121 vlCDR3
QQDYSSPRT

SEQ ID NO: 11965 - protein, 451 aa, Artificial Sequence
  Description of Artificial Sequence: Synthetic polypeptide
  XENP018122 1G6_H1.25_L1_IgG1_PVA_/S267K Heavy Chain
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11966 - protein, 122 aa, Artificial Sequence; identical to SEQ ID NO: 6579
  Description of Artificial Sequence: Synthetic polypeptide
  VH of XENP018122

SEQ ID NO: 11967 - protein, 5 aa, Artificial Sequence
  Description of Artificial Sequence: Synthetic peptide
  XENP018122 vhCDR1
TYWMN

SEQ ID NO: 11968 - protein, 19 aa, Artificial Sequence
  Description of Artificial Sequence: Synthetic peptide
  XENP018122 vhCDR2
EIRLKSNNYATHYAEPVKG

SEQ ID NO: 11969 - protein, 11 aa, Artificial Sequence
  Description of Artificial Sequence: Synthetic peptide
  XENP018122 vhCDR3
YYGNYGGYFDV

SEQ ID NO: 11970 - protein, 214 aa, Artificial Sequence; identical to SEQ ID NO: 11550
  Description of Artificial Sequence: Synthetic polypeptide
  XENP018122 1G6_H1.25_L1_IgG1_PVA_/S267K Light Chain

SEQ ID NO: 11971 - protein, 107 aa, Artificial Sequence; identical to SEQ ID NO: 6247
  Description of Artificial Sequence: Synthetic polypeptide
  VL of XENP018122

SEQ ID NO: 11972 - protein, 11 aa, Artificial Sequence
  Description of Artificial Sequence: Synthetic peptide
  XENP018122 vlCDR1
RASQSVSNDVA

SEQ ID NO: 11973 - protein, 7 aa, Artificial Sequence
  Description of Artificial Sequence: Synthetic peptide
  XENP018122 vlCDR2
YASHRYT

SEQ ID NO: 11974 - protein, 9 aa, Artificial Sequence
  Description of Artificial Sequence: Synthetic peptide
  XENP018122 vlCDR3
QQDYSSPRT

SEQ ID NO: 11975 - protein, 451 aa, Artificial Sequence
  Description of Artificial Sequence: Synthetic polypeptide
  XENP018123 1G6_H1.26_L1_IgG1_PVA_/S267K Heavy Chain
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11976 - protein, 122 aa, Artificial Sequence; identical to SEQ ID NO: 6588
  Description of Artificial Sequence: Synthetic polypeptide
  VH of XENP018123

SEQ ID NO: 11977 - protein, 5 aa, Artificial Sequence
  Description of Artificial Sequence: Synthetic peptide
  XENP018123 vhCDR1
GYWMN

SEQ ID NO: 11978 - protein, 19 aa, Artificial Sequence
  Description of Artificial Sequence: Synthetic peptide
  XENP018123 vhCDR2
EIRLKSNNYATHYAEPVKG

SEQ ID NO: 11979 - protein, 11 aa, Artificial Sequence
  Description of Artificial Sequence: Synthetic peptide
  XENP018123 vhCDR3
YYGNYGGYFDV

SEQ ID NO: 11980 - protein, 214 aa, Artificial Sequence; identical to SEQ ID NO: 11550
  Description of Artificial Sequence: Synthetic polypeptide
  XENP018123 1G6_H1.26_L1_IgG1_PVA_/S267K Light Chain

SEQ ID NO: 11981 - protein, 107 aa, Artificial Sequence; identical to SEQ ID NO: 6247
  Description of Artificial Sequence: Synthetic polypeptide
  VL of XENP018123

SEQ ID NO: 11982 - protein, 11 aa, Artificial Sequence
  Description of Artificial Sequence: Synthetic peptide
  XENP018123 vlCDR1
RASQSVSNDVA

SEQ ID NO: 11983 - protein, 7 aa, Artificial Sequence
  Description of Artificial Sequence: Synthetic peptide
  XENP018123 vlCDR2
YASHRYT

SEQ ID NO: 11984 - protein, 9 aa, Artificial Sequence
  Description of Artificial Sequence: Synthetic peptide
  XENP018123 vlCDR3
QQDYSSPRT

SEQ ID NO: 11985 - protein, 451 aa, Artificial Sequence
  Description of Artificial Sequence: Synthetic polypeptide
  XENP018124 1G6_H1.27_L1_IgG1_PVA_/S267K Heavy Chain
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11986 - protein, 122 aa, Artificial Sequence; identical to SEQ ID NO: 6597
  Description of Artificial Sequence: Synthetic polypeptide
  VH of XENP018124

SEQ ID NO: 11987 - protein, 5 aa, Artificial Sequence
  Description of Artificial Sequence: Synthetic peptide
  XENP018124 vhCDR1
YYWMN

SEQ ID NO: 11988 - protein, 19 aa, Artificial Sequence
  Description of Artificial Sequence: Synthetic peptide
  XENP018124 vhCDR2
EIRLKSNNYATHYAEPVKG

SEQ ID NO: 11989 - protein, 11 aa, Artificial Sequence
  Description of Artificial Sequence: Synthetic peptide
  XENP018124 vhCDR3
YYGNYGGYFDV

SEQ ID NO: 11990 - protein, 214 aa, Artificial Sequence; identical to SEQ ID NO: 11550
  Description of Artificial Sequence: Synthetic polypeptide
  XENP018124 1G6_H1.27_L1_IgG1_PVA_/S267K Light Chain

SEQ ID NO: 11991 - protein, 107 aa, Artificial Sequence; identical to SEQ ID NO: 6247
  Description of Artificial Sequence: Synthetic polypeptide
  VL of XENP018124

SEQ ID NO: 11992 - protein, 11 aa, Artificial Sequence
  Description of Artificial Sequence: Synthetic peptide
  XENP018124 vlCDR1
RASQSVSNDVA

SEQ ID NO: 11993 - protein, 7 aa, Artificial Sequence
  Description of Artificial Sequence: Synthetic peptide
  XENP018124 vlCDR2
YASHRYT

SEQ ID NO: 11994 - protein, 9 aa, Artificial Sequence
  Description of Artificial Sequence: Synthetic peptide
  XENP018124 vlCDR3
QQDYSSPRT

SEQ ID NO: 11995 - protein, 451 aa, Artificial Sequence
  Description of Artificial Sequence: Synthetic polypeptide
  XENP018125 1G6_H1.28_L1_IgG1_PVA_/S267K Heavy Chain
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11996 - protein, 122 aa, Artificial Sequence; identical to SEQ ID NO: 6606
  Description of Artificial Sequence: Synthetic polypeptide
  VH of XENP018125

SEQ ID NO: 11997 - protein, 5 aa, Artificial Sequence
  Description of Artificial Sequence: Synthetic peptide
  XENP018125 vhCDR1
NFWMN

SEQ ID NO: 11998 - protein, 19 aa, Artificial Sequence
  Description of Artificial Sequence: Synthetic peptide
  XENP018125 vhCDR2
EIRLKSNNYATHYAEPVKG

SEQ ID NO: 11999 - protein, 11 aa, Artificial Sequence
  Description of Artificial Sequence: Synthetic peptide
  XENP018125 vhCDR3
YYGNYGGYFDV

SEQ ID NO: 12000 - protein, 214 aa, Artificial Sequence; identical to SEQ ID NO: 11550
  Description of Artificial Sequence: Synthetic polypeptide
  XENP018125 1G6_H1.28_L1_IgG1_PVA_/S267K Light Chain

SEQ ID NO: 12001 - protein, 107 aa, Artificial Sequence; identical to SEQ ID NO: 6247
  Description of Artificial Sequence: Synthetic polypeptide
  VL of XENP018125

SEQ ID NO: 12002 - protein, 11 aa, Artificial Sequence
  Description of Artificial Sequence: Synthetic peptide
  XENP018125 vlCDR1
RASQSVSNDVA

SEQ ID NO: 12003 - protein, 7 aa, Artificial Sequence
  Description of Artificial Sequence: Synthetic peptide
  XENP018125 vlCDR2
YASHRYT

SEQ ID NO: 12004 - protein, 9 aa, Artificial Sequence
  Description of Artificial Sequence: Synthetic peptide
  XENP018125 vlCDR3
QQDYSSPRT

SEQ ID NO: 12005 - protein, 451 aa, Artificial Sequence
  Description of Artificial Sequence: Synthetic polypeptide
  XENP018126 1G6_H1.29_L1_IgG1_PVA_/S267K Heavy Chain
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12006 - protein, 122 aa, Artificial Sequence; identical to SEQ ID NO: 6615
  Description of Artificial Sequence: Synthetic polypeptide
  VH of XENP018126

SEQ ID NO: 12007 - protein, 5 aa, Artificial Sequence
  Description of Artificial Sequence: Synthetic peptide
  XENP018126 vhCDR1
NHWMN

SEQ ID NO: 12008 - protein, 19 aa, Artificial Sequence
  Description of Artificial Sequence: Synthetic peptide
  XENP018126 vhCDR2
EIRLKSNNYATHYAEPVKG

SEQ ID NO: 12009 - protein, 11 aa, Artificial Sequence
  Description of Artificial Sequence: Synthetic peptide
  XENP018126 vhCDR3
YYGNYGGYFDV

SEQ ID NO: 12010 - protein, 214 aa, Artificial Sequence; identical to SEQ ID NO: 11550
  Description of Artificial Sequence: Synthetic polypeptide
  XENP018126 1G6_H1.29_L1_IgG1_PVA_/S267K Light Chain

SEQ ID NO: 12011 - protein, 107 aa, Artificial Sequence; identical to SEQ ID NO: 6247
  Description of Artificial Sequence: Synthetic polypeptide
  VL of XENP018126

SEQ ID NO: 12012 - protein, 11 aa, Artificial Sequence
  Description of Artificial Sequence: Synthetic peptide
  XENP018126 vlCDR1
RASQSVSNDVA

SEQ ID NO: 12013 - protein, 7 aa, Artificial Sequence
  Description of Artificial Sequence: Synthetic peptide
  XENP018126 vlCDR2
YASHRYT

SEQ ID NO: 12014 - protein, 9 aa, Artificial Sequence
  Description of Artificial Sequence: Synthetic peptide
  XENP018126 vlCDR3
QQDYSSPRT

SEQ ID NO: 12015 - protein, 451 aa, Artificial Sequence
  Description of Artificial Sequence: Synthetic polypeptide
  XENP018127 1G6_H1.30_L1_IgG1_PVA_/S267K Heavy Chain
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12016 - protein, 122 aa, Artificial Sequence; identical to SEQ ID NO: 6624
  Description of Artificial Sequence: Synthetic polypeptide
  VH of XENP018127

SEQ ID NO: 12017 - protein, 5 aa, Artificial Sequence
  Description of Artificial Sequence: Synthetic peptide
  XENP018127 vhCDR1
NLWMN

SEQ ID NO: 12018 - protein, 19 aa, Artificial Sequence
  Description of Artificial Sequence: Synthetic peptide
  XENP018127 vhCDR2
EIRLKSNNYATHYAEPVKG

SEQ ID NO: 12019 - protein, 11 aa, Artificial Sequence
  Description of Artificial Sequence: Synthetic peptide
  XENP018127 vhCDR3
YYGNYGGYFDV

SEQ ID NO: 12020 - protein, 214 aa, Artificial Sequence; identical to SEQ ID NO: 11550
  Description of Artificial Sequence: Synthetic polypeptide
  XENP018127 1G6_H1.30_L1_IgG1_PVA_/S267K Light Chain

SEQ ID NO: 12021 - protein, 107 aa, Artificial Sequence; identical to SEQ ID NO: 6247
  Description of Artificial Sequence: Synthetic polypeptide
  VL of XENP018127

SEQ ID NO: 12022 - protein, 11 aa, Artificial Sequence
  Description of Artificial Sequence: Synthetic peptide
  XENP018127 vlCDR1
RASQSVSNDVA

SEQ ID NO: 12023 - protein, 7 aa, Artificial Sequence
  Description of Artificial Sequence: Synthetic peptide
  XENP018127 vlCDR2
YASHRYT

SEQ ID NO: 12024 - protein, 9 aa, Artificial Sequence
  Description of Artificial Sequence: Synthetic peptide
  XENP018127 vlCDR3
QQDYSSPRT

SEQ ID NO: 12025 - protein, 451 aa, Artificial Sequence
  Description of Artificial Sequence: Synthetic polypeptide
  XENP018128 1G6_H1.31_L1_IgG1_PVA_/S267K Heavy Chain
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12026 - protein, 122 aa, Artificial Sequence; identical to SEQ ID NO: 6633
  Description of Artificial Sequence: Synthetic polypeptide
  VH of XENP018128

SEQ ID NO: 12027 - protein, 5 aa, Artificial Sequence
  Description of Artificial Sequence: Synthetic peptide
  XENP018128 vhCDR1
NWWMN

SEQ ID NO: 12028 - protein, 19 aa, Artificial Sequence
  Description of Artificial Sequence: Synthetic peptide
  XENP018128 vhCDR2
EIRLKSNNYATHYAEPVKG

SEQ ID NO: 12029 - protein, 11 aa, Artificial Sequence
  Description of Artificial Sequence: Synthetic peptide
  XENP018128 vhCDR3
YYGNYGGYFDV

SEQ ID NO: 12030 - protein, 214 aa, Artificial Sequence; identical to SEQ ID NO: 11550
  Description of Artificial Sequence: Synthetic polypeptide
  XENP018128 1G6_H1.31_L1_IgG1_PVA_/S267K Light Chain

SEQ ID NO: 12031 - protein, 107 aa, Artificial Sequence; identical to SEQ ID NO: 6247
  Description of Artificial Sequence: Synthetic polypeptide
  VL of XENP018128

SEQ ID NO: 12032 - protein, 11 aa, Artificial Sequence
  Description of Artificial Sequence: Synthetic peptide
  XENP018128 vlCDR1
RASQSVSNDVA

SEQ ID NO: 12033 - protein, 7 aa, Artificial Sequence
  Description of Artificial Sequence: Synthetic peptide
  XENP018128 vlCDR2
YASHRYT

SEQ ID NO: 12034 - protein, 9 aa, Artificial Sequence
  Description of Artificial Sequence: Synthetic peptide
  XENP018128 vlCDR3
QQDYSSPRT

SEQ ID NO: 12035 - protein, 451 aa, Artificial Sequence
  Description of Artificial Sequence: Synthetic polypeptide
  XENP018129 1G6_H1.32_L1_IgG1_PVA_/S267K Heavy Chain
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12036 - protein, 122 aa, Artificial Sequence; identical to SEQ ID NO: 6642
  Description of Artificial Sequence: Synthetic polypeptide
  VH of XENP018129

SEQ ID NO: 12037 - protein, 5 aa, Artificial Sequence
  Description of Artificial Sequence: Synthetic peptide
  XENP018129 vhCDR1
NVWMN

SEQ ID NO: 12038 - protein, 19 aa, Artificial Sequence
  Description of Artificial Sequence: Synthetic peptide
  XENP018129 vhCDR2
EIRLKSNNYATHYAEPVKG

SEQ ID NO: 12039 - protein, 11 aa, Artificial Sequence
  Description of Artificial Sequence: Synthetic peptide
  XENP018129 vhCDR3
YYGNYGGYFDV

SEQ ID NO: 12040 - protein, 214 aa, Artificial Sequence; identical to SEQ ID NO: 11550
  Description of Artificial Sequence: Synthetic polypeptide
  XENP018129 1G6_H1.32_L1_IgG1_PVA_/S267K Light Chain

SEQ ID NO: 12041 - protein, 107 aa, Artificial Sequence; identical to SEQ ID NO: 6247
  Description of Artificial Sequence: Synthetic polypeptide
  VL of XENP018129

SEQ ID NO: 12042 - protein, 11 aa, Artificial Sequence
  Description of Artificial Sequence: Synthetic peptide
  XENP018129 vlCDR1
RASQSVSNDVA

SEQ ID NO: 12043 - protein, 7 aa, Artificial Sequence
  Description of Artificial Sequence: Synthetic peptide
  XENP018129 vlCDR2
YASHRYT

SEQ ID NO: 12044 - protein, 9 aa, Artificial Sequence
  Description of Artificial Sequence: Synthetic peptide
  XENP018129 vlCDR3
QQDYSSPRT

SEQ ID NO: 12045 - protein, 451 aa, Artificial Sequence
  Description of Artificial Sequence: Synthetic polypeptide
  XENP018130 1G6_H1.33_L1_IgG1_PVA_/S267K Heavy Chain
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12046 - protein, 122 aa, Artificial Sequence; identical to SEQ ID NO: 6651
  Description of Artificial Sequence: Synthetic polypeptide
  VH of XENP018130

SEQ ID NO: 12047 - protein, 5 aa, Artificial Sequence
  Description of Artificial Sequence: Synthetic peptide
  XENP018130 vhCDR1
NAWMN

SEQ ID NO: 12048 - protein, 19 aa, Artificial Sequence
  Description of Artificial Sequence: Synthetic peptide
  XENP018130 vhCDR2
EIRLKSNNYATHYAEPVKG

SEQ ID NO: 12049 - protein, 11 aa, Artificial Sequence
  Description of Artificial Sequence: Synthetic peptide
  XENP018130 vhCDR3
YYGNYGGYFDV

SEQ ID NO: 12050 - protein, 214 aa, Artificial Sequence; identical to SEQ ID NO: 11550
  Description of Artificial Sequence: Synthetic polypeptide
  XENP018130 1G6_H1.33_L1_IgG1_PVA_/S267K Light Chain

SEQ ID NO: 12051 - protein, 107 aa, Artificial Sequence; identical to SEQ ID NO: 6247
  Description of Artificial Sequence: Synthetic polypeptide
  VL of XENP018130

SEQ ID NO: 12052 - protein, 11 aa, Artificial Sequence
  Description of Artificial Sequence: Synthetic peptide
  XENP018130 vlCDR1
RASQSVSNDVA

SEQ ID NO: 12053 - protein, 7 aa, Artificial Sequence
  Description of Artificial Sequence: Synthetic peptide
  XENP018130 vlCDR2
YASHRYT

SEQ ID NO: 12054 - protein, 9 aa, Artificial Sequence
  Description of Artificial Sequence: Synthetic peptide
  XENP018130 vlCDR3
QQDYSSPRT

SEQ ID NO: 12055 - protein, 451 aa, Artificial Sequence
  Description of Artificial Sequence: Synthetic polypeptide
  XENP018131 1G6_H1.34_L1_IgG1_PVA_/S267K Heavy Chain
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12056 - protein, 122 aa, Artificial Sequence; identical to SEQ ID NO: 6660
  Description of Artificial Sequence: Synthetic polypeptide
  VH of XENP018131

SEQ ID NO: 12057 - protein, 5 aa, Artificial Sequence
  Description of Artificial Sequence: Synthetic peptide
  XENP018131 vhCDR1
NQWMN

SEQ ID NO: 12058 - protein, 19 aa, Artificial Sequence
  Description of Artificial Sequence: Synthetic peptide
  XENP018131 vhCDR2
EIRLKSNNYATHYAEPVKG

SEQ ID NO: 12059 - protein, 11 aa, Artificial Sequence
  Description of Artificial Sequence: Synthetic peptide
  XENP018131 vhCDR3
YYGNYGGYFDV

SEQ ID NO: 12060 - protein, 214 aa, Artificial Sequence; identical to SEQ ID NO: 11550
  Description of Artificial Sequence: Synthetic polypeptide
  XENP018131 1G6_H1.34_L1_IgG1_PVA_/S267K Light Chain

SEQ ID NO: 12061 - protein, 107 aa, Artificial Sequence; identical to SEQ ID NO: 6247
  Description of Artificial Sequence: Synthetic polypeptide
  VL of XENP018131

SEQ ID NO: 12062 - protein, 11 aa, Artificial Sequence
  Description of Artificial Sequence: Synthetic peptide
  XENP018131 vlCDR1
RASQSVSNDVA

SEQ ID NO: 12063 - protein, 7 aa, Artificial Sequence
  Description of Artificial Sequence: Synthetic peptide
  XENP018131 vlCDR2
YASHRYT

SEQ ID NO: 12064 - protein, 9 aa, Artificial Sequence
  Description of Artificial Sequence: Synthetic peptide
  XENP018131 vlCDR3
QQDYSSPRT

SEQ ID NO: 12065 - protein, 451 aa, Artificial Sequence
  Description of Artificial Sequence: Synthetic polypeptide
  XENP018132 1G6_H1.35_L1_IgG1_PVA_/S267K Heavy Chain
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12066 - protein, 122 aa, Artificial Sequence; identical to SEQ ID NO: 6669
  Description of Artificial Sequence: Synthetic polypeptide
  VH of XENP018132

SEQ ID NO: 12067 - protein, 5 aa, Artificial Sequence
  Description of Artificial Sequence: Synthetic peptide
  XENP018132 vhCDR1
NDWMN

SEQ ID NO: 12068 - protein, 19 aa, Artificial Sequence
  Description of Artificial Sequence: Synthetic peptide
  XENP018132 vhCDR2
EIRLKSNNYATHYAEPVKG

SEQ ID NO: 12069 - protein, 11 aa, Artificial Sequence
  Description of Artificial Sequence: Synthetic peptide
  XENP018132 vhCDR3
YYGNYGGYFDV

SEQ ID NO: 12070 - protein, 214 aa, Artificial Sequence; identical to SEQ ID NO: 11550
  Description of Artificial Sequence: Synthetic polypeptide
  XENP018132 1G6_H1.35_L1_IgG1_PVA_/S267K Light Chain

SEQ ID NO: 12071 - protein, 107 aa, Artificial Sequence; identical to SEQ ID NO: 6247
  Description of Artificial Sequence: Synthetic polypeptide
  VL of XENP018132

SEQ ID NO: 12072 - protein, 11 aa, Artificial Sequence
  Description of Artificial Sequence: Synthetic peptide
  XENP018132 vlCDR1
RASQSVSNDVA

SEQ ID NO: 12073 - protein, 7 aa, Artificial Sequence
  Description of Artificial Sequence: Synthetic peptide
  XENP018132 vlCDR2
YASHRYT

SEQ ID NO: 12074 - protein, 9 aa, Artificial Sequence
  Description of Artificial Sequence: Synthetic peptide
  XENP018132 vlCDR3
QQDYSSPRT

SEQ ID NO: 12075 - protein, 451 aa, Artificial Sequence
  Description of Artificial Sequence: Synthetic polypeptide
  XENP018133 1G6_H1.36_L1_IgG1_PVA_/S267K Heavy Chain
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12076 - protein, 122 aa, Artificial Sequence; identical to SEQ ID NO: 6678
  Description of Artificial Sequence: Synthetic polypeptide
  VH of XENP018133

SEQ ID NO: 12077 - protein, 5 aa, Artificial Sequence
  Description of Artificial Sequence: Synthetic peptide
  XENP018133 vhCDR1
NKWMN

SEQ ID NO: 12078 - protein, 19 aa, Artificial Sequence
  Description of Artificial Sequence: Synthetic peptide
  XENP018133 vhCDR2
EIRLKSNNYATHYAEPVKG

SEQ ID NO: 12079 - protein, 11 aa, Artificial Sequence
  Description of Artificial Sequence: Synthetic peptide
  XENP018133 vhCDR3
YYGNYGGYFDV

SEQ ID NO: 12080 - protein, 214 aa, Artificial Sequence; identical to SEQ ID NO: 11550
  Description of Artificial Sequence: Synthetic polypeptide
  XENP018133 1G6_H1.36_L1_IgG1_PVA_/S267K Light Chain

SEQ ID NO: 12081 - protein, 107 aa, Artificial Sequence; identical to SEQ ID NO: 6247
  Description of Artificial Sequence: Synthetic polypeptide
  VL of XENP018133

SEQ ID NO: 12082 - protein, 11 aa, Artificial Sequence
  Description of Artificial Sequence: Synthetic peptide
  XENP018133 vlCDR1
RASQSVSNDVA

SEQ ID NO: 12083 - protein, 7 aa, Artificial Sequence
  Description of Artificial Sequence: Synthetic peptide
  XENP018133 vlCDR2
YASHRYT

SEQ ID NO: 12084 - protein, 9 aa, Artificial Sequence
  Description of Artificial Sequence: Synthetic peptide
  XENP018133 vlCDR3
QQDYSSPRT

SEQ ID NO: 12085 - protein, 451 aa, Artificial Sequence
  Description of Artificial Sequence: Synthetic polypeptide
  XENP018134 1G6_H1.37_L1_IgG1_PVA_/S267K Heavy Chain
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12086 - protein, 122 aa, Artificial Sequence; identical to SEQ ID NO: 6687
  Description of Artificial Sequence: Synthetic polypeptide
  VH of XENP018134

SEQ ID NO: 12087 - protein, 5 aa, Artificial Sequence
  Description of Artificial Sequence: Synthetic peptide
  XENP018134 vhCDR1
NYGMN

SEQ ID NO: 12088 - protein, 19 aa, Artificial Sequence
  Description of Artificial Sequence: Synthetic peptide
  XENP018134 vhCDR2
EIRLKSNNYATHYAEPVKG

SEQ ID NO: 12089 - protein, 11 aa, Artificial Sequence
  Description of Artificial Sequence: Synthetic peptide
  XENP018134 vhCDR3
YYGNYGGYFDV

SEQ ID NO: 12090 - protein, 214 aa, Artificial Sequence; identical to SEQ ID NO: 11550
  Description of Artificial Sequence: Synthetic polypeptide
  XENP018134 1G6_H1.37_L1_IgG1_PVA_/S267K Light Chain

SEQ ID NO: 12091 - protein, 107 aa, Artificial Sequence; identical to SEQ ID NO: 6247
  Description of Artificial Sequence: Synthetic polypeptide
  VL of XENP018134

SEQ ID NO: 12092 - protein, 11 aa, Artificial Sequence
  Description of Artificial Sequence: Synthetic peptide
  XENP018134 vlCDR1
RASQSVSNDVA

SEQ ID NO: 12093 - protein, 7 aa, Artificial Sequence
  Description of Artificial Sequence: Synthetic peptide
  XENP018134 vlCDR2
YASHRYT

SEQ ID NO: 12094 - protein, 9 aa, Artificial Sequence
  Description of Artificial Sequence: Synthetic peptide
  XENP018134 vlCDR3
QQDYSSPRT

SEQ ID NO: 12095 - protein, 451 aa, Artificial Sequence
  Description of Artificial Sequence: Synthetic polypeptide
  XENP018135 1G6_H1.38_L1_IgG1_PVA_/S267K Heavy Chain
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12096 - protein, 122 aa, Artificial Sequence; identical to SEQ ID NO: 6696
  Description of Artificial Sequence: Synthetic polypeptide
  VH of XENP018135

SEQ ID NO: 12097 - protein, 5 aa, Artificial Sequence
  Description of Artificial Sequence: Synthetic peptide
  XENP018135 vhCDR1
NYAMN

SEQ ID NO: 12098 - protein, 19 aa, Artificial Sequence
  Description of Artificial Sequence: Synthetic peptide
  XENP018135 vhCDR2
EIRLKSNNYATHYAEPVKG

SEQ ID NO: 12099 - protein, 11 aa, Artificial Sequence
  Description of Artificial Sequence: Synthetic peptide
  XENP018135 vhCDR3
YYGNYGGYFDV

SEQ ID NO: 12100 - protein, 214 aa, Artificial Sequence; identical to SEQ ID NO: 11550
  Description of Artificial Sequence: Synthetic polypeptide
  XENP018135 1G6_H1.38_L1_IgG1_PVA_/S267K Light Chain

SEQ ID NO: 12101 - protein, 107 aa, Artificial Sequence; identical to SEQ ID NO: 6247
  Description of Artificial Sequence: Synthetic polypeptide
  VL of XENP018135

SEQ ID NO: 12102 - protein, 11 aa, Artificial Sequence
  Description of Artificial Sequence: Synthetic peptide
  XENP018135 vlCDR1
RASQSVSNDVA

SEQ ID NO: 12103 - protein, 7 aa, Artificial Sequence
  Description of Artificial Sequence: Synthetic peptide
  XENP018135 vlCDR2
YASHRYT

SEQ ID NO: 12104 - protein, 9 aa, Artificial Sequence
  Description of Artificial Sequence: Synthetic peptide
  XENP018135 vlCDR3
QQDYSSPRT

SEQ ID NO: 12105 - protein, 451 aa, Artificial Sequence
  Description of Artificial Sequence: Synthetic polypeptide
  XENP018136 1G6_H1.39_L1_IgG1_PVA_/S267K Heavy Chain
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12106 - protein, 122 aa, Artificial Sequence; identical to SEQ ID NO: 6705
  Description of Artificial Sequence: Synthetic polypeptide
  VH of XENP018136

SEQ ID NO: 12107 - protein, 5 aa, Artificial Sequence
  Description of Artificial Sequence: Synthetic peptide
  XENP018136 vhCDR1
NYYMN

SEQ ID NO: 12108 - protein, 19 aa, Artificial Sequence
  Description of Artificial Sequence: Synthetic peptide
  XENP018136 vhCDR2
EIRLKSNNYATHYAEPVKG

SEQ ID NO: 12109 - protein, 11 aa, Artificial Sequence
  Description of Artificial Sequence: Synthetic peptide
  XENP018136 vhCDR3
YYGNYGGYFDV

SEQ ID NO: 12110 - protein, 214 aa, Artificial Sequence; identical to SEQ ID NO: 11550
  Description of Artificial Sequence: Synthetic polypeptide
  XENP018136 1G6_H1.39_L1_IgG1_PVA_/S267K Light Chain

SEQ ID NO: 12111 - protein, 107 aa, Artificial Sequence; identical to SEQ ID NO: 6247
  Description of Artificial Sequence: Synthetic polypeptide
  VL of XENP018136

SEQ ID NO: 12112 - protein, 11 aa, Artificial Sequence
  Description of Artificial Sequence: Synthetic peptide
  XENP018136 vlCDR1
RASQSVSNDVA

SEQ ID NO: 12113 - protein, 7 aa, Artificial Sequence
  Description of Artificial Sequence: Synthetic peptide
  XENP018136 vlCDR2
YASHRYT

SEQ ID NO: 12114 - protein, 9 aa, Artificial Sequence
  Description of Artificial Sequence: Synthetic peptide
  XENP018136 vlCDR3
QQDYSSPRT

SEQ ID NO: 12115 - protein, 451 aa, Artificial Sequence
  Description of Artificial Sequence: Synthetic polypeptide
  XENP018137 1G6_H1.40_L1_IgG1_PVA_/S267K Heavy Chain
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12116 - protein, 122 aa, Artificial Sequence; identical to SEQ ID NO: 6714
  Description of Artificial Sequence: Synthetic polypeptide
  VH of XENP018137

SEQ ID NO: 12117 - protein, 5 aa, Artificial Sequence
  Description of Artificial Sequence: Synthetic peptide
  XENP018137 vhCDR1
NYDMN

SEQ ID NO: 12118 - protein, 19 aa, Artificial Sequence
  Description of Artificial Sequence: Synthetic peptide
  XENP018137 vhCDR2
EIRLKSNNYATHYAEPVKG

SEQ ID NO: 12119 - protein, 11 aa, Artificial Sequence
  Description of Artificial Sequence: Synthetic peptide
  XENP018137 vhCDR3
YYGNYGGYFDV

SEQ ID NO: 12120 - protein, 214 aa, Artificial Sequence; identical to SEQ ID NO: 11550
  Description of Artificial Sequence: Synthetic polypeptide
  XENP018137 1G6_H1.40_L1_IgG1_PVA_/S267K Light Chain

SEQ ID NO: 12121 - protein, 107 aa, Artificial Sequence; identical to SEQ ID NO: 6247
  Description of Artificial Sequence: Synthetic polypeptide
  VL of XENP018137

SEQ ID NO: 12122 - protein, 11 aa, Artificial Sequence
  Description of Artificial Sequence: Synthetic peptide
  XENP018137 vlCDR1
RASQSVSNDVA

SEQ ID NO: 12123 - protein, 7 aa, Artificial Sequence
  Description of Artificial Sequence: Synthetic peptide
  XENP018137 vlCDR2
YASHRYT

SEQ ID NO: 12124 - protein, 9 aa, Artificial Sequence
  Description of Artificial Sequence: Synthetic peptide
  XENP018137 vlCDR3
QQDYSSPRT

SEQ ID NO: 12125 - protein, 451 aa, Artificial Sequence
  Description of Artificial Sequence: Synthetic polypeptide
  XENP018138 1G6_H1.41_L1_IgG1_PVA_/S267K Heavy Chain
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12126 - protein, 122 aa, Artificial Sequence; identical to SEQ ID NO: 6723
  Description of Artificial Sequence: Synthetic polypeptide
  VH of XENP018138

SEQ ID NO: 12127 - protein, 5 aa, Artificial Sequence
  Description of Artificial Sequence: Synthetic peptide
  XENP018138 vhCDR1
NYWMS

SEQ ID NO: 12128 - protein, 19 aa, Artificial Sequence
  Description of Artificial Sequence: Synthetic peptide
  XENP018138 vhCDR2
EIRLKSNNYATHYAEPVKG

SEQ ID NO: 12129 - protein, 11 aa, Artificial Sequence
  Description of Artificial Sequence: Synthetic peptide
  XENP018138 vhCDR3
YYGNYGGYFDV

SEQ ID NO: 12130 - protein, 214 aa, Artificial Sequence; identical to SEQ ID NO: 11550
  Description of Artificial Sequence: Synthetic polypeptide
  XENP018138 1G6_H1.41_L1_IgG1_PVA_/S267K Light Chain

SEQ ID NO: 12131 - protein, 107 aa, Artificial Sequence; identical to SEQ ID NO: 6247
  Description of Artificial Sequence: Synthetic polypeptide
  VL of XENP018138

SEQ ID NO: 12132 - protein, 11 aa, Artificial Sequence
  Description of Artificial Sequence: Synthetic peptide
  XENP018138 vlCDR1
RASQSVSNDVA

SEQ ID NO: 12133 - protein, 7 aa, Artificial Sequence
  Description of Artificial Sequence: Synthetic peptide
  XENP018138 vlCDR2
YASHRYT

SEQ ID NO: 12134 - protein, 9 aa, Artificial Sequence
  Description of Artificial Sequence: Synthetic peptide
  XENP018138 vlCDR3
QQDYSSPRT

SEQ ID NO: 12135 - protein, 451 aa, Artificial Sequence
  Description of Artificial Sequence: Synthetic polypeptide
  XENP018139 1G6_H1.42_L1_IgG1_PVA_/S267K Heavy Chain
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12136 - protein, 122 aa, Artificial Sequence; identical to SEQ ID NO: 6732
  Description of Artificial Sequence: Synthetic polypeptide
  VH of XENP018139

SEQ ID NO: 12137 - protein, 5 aa, Artificial Sequence
  Description of Artificial Sequence: Synthetic peptide
  XENP018139 vhCDR1
NYWMH

SEQ ID NO: 12138 - protein, 19 aa, Artificial Sequence
  Description of Artificial Sequence: Synthetic peptide
  XENP018139 vhCDR2
EIRLKSNNYATHYAEPVKG

SEQ ID NO: 12139 - protein, 11 aa, Artificial Sequence
  Description of Artificial Sequence: Synthetic peptide
  XENP018139 vhCDR3
YYGNYGGYFDV

SEQ ID NO: 12140 - protein, 214 aa, Artificial Sequence; identical to SEQ ID NO: 11550
  Description of Artificial Sequence: Synthetic polypeptide
  XENP018139 1G6_H1.42_L1_IgG1_PVA_/S267K Light Chain

SEQ ID NO: 12141 - protein, 107 aa, Artificial Sequence; identical to SEQ ID NO: 6247
  Description of Artificial Sequence: Synthetic polypeptide
  VL of XENP018139

SEQ ID NO: 12142 - protein, 11 aa, Artificial Sequence
  Description of Artificial Sequence: Synthetic peptide
  XENP018139 vlCDR1
RASQSVSNDVA

SEQ ID NO: 12143 - protein, 7 aa, Artificial Sequence
  Description of Artificial Sequence: Synthetic peptide
  XENP018139 vlCDR2
YASHRYT

SEQ ID NO: 12144 - protein, 9 aa, Artificial Sequence
  Description of Artificial Sequence: Synthetic peptide
  XENP018139 vlCDR3
QQDYSSPRT

SEQ ID NO: 12145 - protein, 451 aa, Artificial Sequence
  Description of Artificial Sequence: Synthetic polypeptide
  XENP018140 1G6_H1.43_L1_IgG1_PVA_/S267K Heavy Chain
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12146 - protein, 122 aa, Artificial Sequence; identical to SEQ ID NO: 6741
  Description of Artificial Sequence: Synthetic polypeptide
  VH of XENP018140

SEQ ID NO: 12147 - protein, 5 aa, Artificial Sequence
  Description of Artificial Sequence: Synthetic peptide
  XENP018140 vhCDR1
NYWMD

SEQ ID NO: 12148 - protein, 19 aa, Artificial Sequence
  Description of Artificial Sequence: Synthetic peptide
  XENP018140 vhCDR2
EIRLKSNNYATHYAEPVKG

SEQ ID NO: 12149 - protein, 11 aa, Artificial Sequence
  Description of Artificial Sequence: Synthetic peptide
  XENP018140 vhCDR3
YYGNYGGYFDV

SEQ ID NO: 12150 - protein, 214 aa, Artificial Sequence; identical to SEQ ID NO: 11550
  Description of Artificial Sequence: Synthetic polypeptide
  XENP018140 1G6_H1.43_L1_IgG1_PVA_/S267K Light Chain

SEQ ID NO: 12151 - protein, 107 aa, Artificial Sequence; identical to SEQ ID NO: 6247
  Description of Artificial Sequence: Synthetic polypeptide
  VL of XENP018140

SEQ ID NO: 12152 - protein, 11 aa, Artificial Sequence
  Description of Artificial Sequence: Synthetic peptide
  XENP018140 vlCDR1
RASQSVSNDVA

SEQ ID NO: 12153 - protein, 7 aa, Artificial Sequence
  Description of Artificial Sequence: Synthetic peptide
  XENP018140 vlCDR2
YASHRYT

SEQ ID NO: 12154 - protein, 9 aa, Artificial Sequence
  Description of Artificial Sequence: Synthetic peptide
  XENP018140 vlCDR3
QQDYSSPRT

SEQ ID NO: 12155 - protein, 451 aa, Artificial Sequence
  Description of Artificial Sequence: Synthetic polypeptide
  XENP018141 1G6_H1.44_L1_IgG1_PVA_/S267K Heavy Chain
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12156 - protein, 122 aa, Artificial Sequence; identical to SEQ ID NO: 6750
  Description of Artificial Sequence: Synthetic polypeptide
  VH of XENP018141

SEQ ID NO: 12157 - protein, 5 aa, Artificial Sequence
  Description of Artificial Sequence: Synthetic peptide
  XENP018141 vhCDR1
NYWMG

SEQ ID NO: 12158 - protein, 18 aa, Artificial Sequence
  Description of Artificial Sequence: Synthetic peptide
  XENP018141 vhCDR2
EIRLKSNNYATHYAEPVK

SEQ ID NO: 12159 - protein, 11 aa, Artificial Sequence
  Description of Artificial Sequence: Synthetic peptide
  XENP018141 vhCDR3
YYGNYGGYFDV

SEQ ID NO: 12160 - protein, 214 aa, Artificial Sequence; identical to SEQ ID NO: 11550
  Description of Artificial Sequence: Synthetic polypeptide
  XENP018141 1G6_H1.44_L1_IgG1_PVA_/S267K Light Chain

SEQ ID NO: 12161 - protein, 107 aa, Artificial Sequence; identical to SEQ ID NO: 6247
  Description of Artificial Sequence: Synthetic polypeptide
  VL of XENP018141

SEQ ID NO: 12162 - protein, 11 aa, Artificial Sequence
  Description of Artificial Sequence: Synthetic peptide
  XENP018141 vlCDR1
RASQSVSNDVA

SEQ ID NO: 12163 - protein, 7 aa, Artificial Sequence
  Description of Artificial Sequence: Synthetic peptide
  XENP018141 vlCDR2
YASHRYT

SEQ ID NO: 12164 - protein, 9 aa, Artificial Sequence
  Description of Artificial Sequence: Synthetic peptide
  XENP018141 vlCDR3
QQDYSSPRT

SEQ ID NO: 12165 - protein, 451 aa, Artificial Sequence
  Description of Artificial Sequence: Synthetic polypeptide
  XENP018142 1G6_H1.45_L1_IgG1_PVA_/S267K Heavy Chain
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12166 - protein, 122 aa, Artificial Sequence; identical to SEQ ID NO: 6759
  Description of Artificial Sequence: Synthetic polypeptide
  VH of XENP018142

SEQ ID NO: 12167 - protein, 5 aa, Artificial Sequence
  Description of Artificial Sequence: Synthetic peptide
  XENP018142 vhCDR1
NYWMN

SEQ ID NO: 12168 - protein, 19 aa, Artificial Sequence
  Description of Artificial Sequence: Synthetic peptide
  XENP018142 vhCDR2
EIRLKSNNYATHYAEPVKG

SEQ ID NO: 12169 - protein, 11 aa, Artificial Sequence
  Description of Artificial Sequence: Synthetic peptide
  XENP018142 vhCDR3
YYGNYGGYFDV

SEQ ID NO: 12170 - protein, 214 aa, Artificial Sequence; identical to SEQ ID NO: 11550
  Description of Artificial Sequence: Synthetic polypeptide
  XENP018142 1G6_H1.45_L1_IgG1_PVA_/S267K Light Chain

SEQ ID NO: 12171 - protein, 107 aa, Artificial Sequence; identical to SEQ ID NO: 6247
  Description of Artificial Sequence: Synthetic polypeptide
  VL of XENP018142

SEQ ID NO: 12172 - protein, 11 aa, Artificial Sequence
  Description of Artificial Sequence: Synthetic peptide
  XENP018142 vlCDR1
RASQSVSNDVA

SEQ ID NO: 12173 - protein, 7 aa, Artificial Sequence
  Description of Artificial Sequence: Synthetic peptide
  XENP018142 vlCDR2
YASHRYT

SEQ ID NO: 12174 - protein, 9 aa, Artificial Sequence
  Description of Artificial Sequence: Synthetic peptide
  XENP018142 vlCDR3
QQDYSSPRT

SEQ ID NO: 12175 - protein, 451 aa, Artificial Sequence
  Description of Artificial Sequence: Synthetic polypeptide
  XENP018143 1G6_H1.46_L1_IgG1_PVA_/S267K Heavy Chain
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12176 - protein, 122 aa, Artificial Sequence; identical to SEQ ID NO: 6768
  Description of Artificial Sequence: Synthetic polypeptide
  VH of XENP018143

SEQ ID NO: 12177 - protein, 5 aa, Artificial Sequence
  Description of Artificial Sequence: Synthetic peptide
  XENP018143 vhCDR1
NYWMN

SEQ ID NO: 12178 - protein, 19 aa, Artificial Sequence
  Description of Artificial Sequence: Synthetic peptide
  XENP018143 vhCDR2
EIRLKSNNYATHYAEPVKG

SEQ ID NO: 12179 - protein, 11 aa, Artificial Sequence
  Description of Artificial Sequence: Synthetic peptide
  XENP018143 vhCDR3
YYGNYGGYFDV

SEQ ID NO: 12180 - protein, 214 aa, Artificial Sequence; identical to SEQ ID NO: 11550
  Description of Artificial Sequence: Synthetic polypeptide
  XENP018143 1G6_H1.46_L1_IgG1_PVA_/S267K Light Chain

SEQ ID NO: 12181 - protein, 107 aa, Artificial Sequence; identical to SEQ ID NO: 6247
  Description of Artificial Sequence: Synthetic polypeptide
  VL of XENP018143

SEQ ID NO: 12182 - protein, 11 aa, Artificial Sequence
  Description of Artificial Sequence: Synthetic peptide
  XENP018143 vlCDR1
RASQSVSNDVA

SEQ ID NO: 12183 - protein, 7 aa, Artificial Sequence
  Description of Artificial Sequence: Synthetic peptide
  XENP018143 vlCDR2
YASHRYT

SEQ ID NO: 12184 - protein, 9 aa, Artificial Sequence
  Description of Artificial Sequence: Synthetic peptide
  XENP018143 vlCDR3
QQDYSSPRT

SEQ ID NO: 12185 - protein, 451 aa, Artificial Sequence
  Description of Artificial Sequence: Synthetic polypeptide
  XENP018144 1G6_H1.47_L1_IgG1_PVA_/S267K Heavy Chain
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12186 - protein, 122 aa, Artificial Sequence; identical to SEQ ID NO: 6777
  Description of Artificial Sequence: Synthetic polypeptide
  VH of XENP018144

SEQ ID NO: 12187 - protein, 5 aa, Artificial Sequence
  Description of Artificial Sequence: Synthetic peptide
  XENP018144 vhCDR1
NYWMN

SEQ ID NO: 12188 - protein, 19 aa, Artificial Sequence
  Description of Artificial Sequence: Synthetic peptide
  XENP018144 vhCDR2
EIRLKSNNYATHYAEPVKG

SEQ ID NO: 12189 - protein, 11 aa, Artificial Sequence
  Description of Artificial Sequence: Synthetic peptide
  XENP018144 vhCDR3
YYGNYGGYFDV

SEQ ID NO: 12190 - protein, 214 aa, Artificial Sequence; identical to SEQ ID NO: 11550
  Description of Artificial Sequence: Synthetic polypeptide
  XENP018144 1G6_H1.47_L1_IgG1_PVA_/S267K Light Chain

SEQ ID NO: 12191 - protein, 107 aa, Artificial Sequence; identical to SEQ ID NO: 6247
  Description of Artificial Sequence: Synthetic polypeptide
  VL of XENP018144

SEQ ID NO: 12192 - protein, 11 aa, Artificial Sequence
  Description of Artificial Sequence: Synthetic peptide
  XENP018144 vlCDR1
RASQSVSNDVA

SEQ ID NO: 12193 - protein, 7 aa, Artificial Sequence
  Description of Artificial Sequence: Synthetic peptide
  XENP018144 vlCDR2
YASHRYT

SEQ ID NO: 12194 - protein, 9 aa, Artificial Sequence
  Description of Artificial Sequence: Synthetic peptide
  XENP018144 vlCDR3
QQDYSSPRT

SEQ ID NO: 12195 - protein, 451 aa, Artificial Sequence
  Description of Artificial Sequence: Synthetic polypeptide
  XENP018145 1G6_H1.48_L1_IgG1_PVA_/S267K Heavy Chain
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12196 - protein, 122 aa, Artificial Sequence; identical to SEQ ID NO: 6786
  Description of Artificial Sequence: Synthetic polypeptide
  VH of XENP018145

SEQ ID NO: 12197 - protein, 5 aa, Artificial Sequence
  Description of Artificial Sequence: Synthetic peptide
  XENP018145 vhCDR1
NYWMN

SEQ ID NO: 12198 - protein, 19 aa, Artificial Sequence
  Description of Artificial Sequence: Synthetic peptide
  XENP018145 vhCDR2
EIRLKSNNYATHYAEPVKG

SEQ ID NO: 12199 - protein, 11 aa, Artificial Sequence
  Description of Artificial Sequence: Synthetic peptide
  XENP018145 vhCDR3
YYGNYGGYFDV

SEQ ID NO: 12200 - protein, 214 aa, Artificial Sequence; identical to SEQ ID NO: 11550
  Description of Artificial Sequence: Synthetic polypeptide
  XENP018145 1G6_H1.48_L1_IgG1_PVA_/S267K Light Chain

SEQ ID NO: 12201 - protein, 107 aa, Artificial Sequence; identical to SEQ ID NO: 6247
  Description of Artificial Sequence: Synthetic polypeptide
  VL of XENP018145

SEQ ID NO: 12202 - protein, 11 aa, Artificial Sequence
  Description of Artificial Sequence: Synthetic peptide
  XENP018145 vlCDR1
RASQSVSNDVA

SEQ ID NO: 12203 - protein, 7 aa, Artificial Sequence
  Description of Artificial Sequence: Synthetic peptide
  XENP018145 vlCDR2
YASHRYT

SEQ ID NO: 12204 - protein, 9 aa, Artificial Sequence
  Description of Artificial Sequence: Synthetic peptide
  XENP018145 vlCDR3
QQDYSSPRT

SEQ ID NO: 12205 - protein, 451 aa, Artificial Sequence
  Description of Artificial Sequence: Synthetic polypeptide
  XENP018146 1G6_H1.49_L1_IgG1_PVA_/S267K Heavy Chain
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12206 - protein, 122 aa, Artificial Sequence; identical to SEQ ID NO: 6792
  Description of Artificial Sequence: Synthetic polypeptide
  VH of XENP018146

SEQ ID NO: 12207 - protein, 5 aa, Artificial Sequence
  Description of Artificial Sequence: Synthetic peptide
  XENP018146 vhCDR1
NYWMN

SEQ ID NO: 12208 - protein, 19 aa, Artificial Sequence
  Description of Artificial Sequence: Synthetic peptide
  XENP018146 vhCDR2
EIRLKSNNYATHYAEPVKG

SEQ ID NO: 12209 - protein, 11 aa, Artificial Sequence
  Description of Artificial Sequence: Synthetic peptide
  XENP018146 vhCDR3
YYGNYGGYFDV

SEQ ID NO: 12210 - protein, 214 aa, Artificial Sequence; identical to SEQ ID NO: 11550
  Description of Artificial Sequence: Synthetic polypeptide
  XENP018146 1G6_H1.49_L1_IgG1_PVA_/S267K Light Chain

SEQ ID NO: 12211 - protein, 107 aa, Artificial Sequence; identical to SEQ ID NO: 6247
  Description of Artificial Sequence: Synthetic polypeptide
  VL of XENP018146

SEQ ID NO: 12212 - protein, 11 aa, Artificial Sequence
  Description of Artificial Sequence: Synthetic peptide
  XENP018146 vlCDR1
RASQSVSNDVA

SEQ ID NO: 12213 - protein, 7 aa, Artificial Sequence
  Description of Artificial Sequence: Synthetic peptide
  XENP018146 vlCDR2
YASHRYT

SEQ ID NO: 12214 - protein, 9 aa, Artificial Sequence
  Description of Artificial Sequence: Synthetic peptide
  XENP018146 vlCDR3
QQDYSSPRT

SEQ ID NO: 12215 - protein, 451 aa, Artificial Sequence
  Description of Artificial Sequence: Synthetic polypeptide
  XENP018147 1G6_H1.50_L1_IgG1_PVA_/S267K Heavy Chain
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12216 - protein, 122 aa, Artificial Sequence; identical to SEQ ID NO: 6801
  Description of Artificial Sequence: Synthetic polypeptide
  VH of XENP018147

SEQ ID NO: 12217 - protein, 5 aa, Artificial Sequence
  Description of Artificial Sequence: Synthetic peptide
  XENP018147 vhCDR1
NYWMN

SEQ ID NO: 12218 - protein, 19 aa, Artificial Sequence
  Description of Artificial Sequence: Synthetic peptide
  XENP018147 vhCDR2
EIRLKSNNYATHYAEPVKG

SEQ ID NO: 12219 - protein, 11 aa, Artificial Sequence
  Description of Artificial Sequence: Synthetic peptide
  XENP018147 vhCDR3
YYGNYGGYFDV

SEQ ID NO: 12220 - protein, 214 aa, Artificial Sequence; identical to SEQ ID NO: 11550
  Description of Artificial Sequence: Synthetic polypeptide
  XENP018147 1G6_H1.50_L1_IgG1_PVA_/S267K Light Chain

SEQ ID NO: 12221 - protein, 107 aa, Artificial Sequence; identical to SEQ ID NO: 6247
  Description of Artificial Sequence: Synthetic polypeptide
  VL of XENP018147

SEQ ID NO: 12222 - protein, 11 aa, Artificial Sequence
  Description of Artificial Sequence: Synthetic peptide
  XENP018147 vlCDR1
RASQSVSNDVA

SEQ ID NO: 12223 - protein, 7 aa, Artificial Sequence
  Description of Artificial Sequence: Synthetic peptide
  XENP018147 vlCDR2
YASHRYT

SEQ ID NO: 12224 - protein, 9 aa, Artificial Sequence
  Description of Artificial Sequence: Synthetic peptide
  XENP018147 vlCDR3
QQDYSSPRT

SEQ ID NO: 12225 - protein, 451 aa, Artificial Sequence
  Description of Artificial Sequence: Synthetic polypeptide
  XENP018148 1G6_H1.51_L1_IgG1_PVA_/S267K Heavy Chain
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12226 - protein, 122 aa, Artificial Sequence; identical to SEQ ID NO: 6810
  Description of Artificial Sequence: Synthetic polypeptide
  VH of XENP018148

SEQ ID NO: 12227 - protein, 5 aa, Artificial Sequence
  Description of Artificial Sequence: Synthetic peptide
  XENP018148 vhCDR1
NYWMN

SEQ ID NO: 12228 - protein, 19 aa, Artificial Sequence
  Description of Artificial Sequence: Synthetic peptide
  XENP018148 vhCDR2
EIRLKSNNYATHYAEPVKG

SEQ ID NO: 12229 - protein, 11 aa, Artificial Sequence
  Description of Artificial Sequence: Synthetic peptide
  XENP018148 vhCDR3
YYGNYGGYFDV

SEQ ID NO: 12230 - protein, 214 aa, Artificial Sequence; identical to SEQ ID NO: 11550
  Description of Artificial Sequence: Synthetic polypeptide
  XENP018148 1G6_H1.51_L1_IgG1_PVA_/S267K Light Chain

SEQ ID NO: 12231 - protein, 107 aa, Artificial Sequence; identical to SEQ ID NO: 6247
  Description of Artificial Sequence: Synthetic polypeptide
  VL of XENP018148

SEQ ID NO: 12232 - protein, 11 aa, Artificial Sequence
  Description of Artificial Sequence: Synthetic peptide
  XENP018148 vlCDR1
RASQSVSNDVA

SEQ ID NO: 12233 - protein, 7 aa, Artificial Sequence
  Description of Artificial Sequence: Synthetic peptide
  XENP018148 vlCDR2
YASHRYT

SEQ ID NO: 12234 - protein, 9 aa, Artificial Sequence
  Description of Artificial Sequence: Synthetic peptide
  XENP018148 vlCDR3
QQDYSSPRT

SEQ ID NO: 12235 - protein, 451 aa, Artificial Sequence
  Description of Artificial Sequence: Synthetic polypeptide
  XENP018149 1G6_H1.52_L1_IgG1_PVA_/S267K Heavy Chain
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12236 - protein, 122 aa, Artificial Sequence; identical to SEQ ID NO: 6819
  Description of Artificial Sequence: Synthetic polypeptide
  VH of XENP018149

SEQ ID NO: 12237 - protein, 5 aa, Artificial Sequence
  Description of Artificial Sequence: Synthetic peptide
  XENP018149 vhCDR1
NYWMN

SEQ ID NO: 12238 - protein, 19 aa, Artificial Sequence
  Description of Artificial Sequence: Synthetic peptide
  XENP018149 vhCDR2
EIRLKSNNYATHYAEPVKG

SEQ ID NO: 12239 - protein, 11 aa, Artificial Sequence
  Description of Artificial Sequence: Synthetic peptide
  XENP018149 vhCDR3
YYGNYGGYFDV

SEQ ID NO: 12240 - protein, 214 aa, Artificial Sequence; identical to SEQ ID NO: 11550
  Description of Artificial Sequence: Synthetic polypeptide
  XENP018149 1G6_H1.52_L1_IgG1_PVA_/S267K Light Chain

SEQ ID NO: 12241 - protein, 107 aa, Artificial Sequence; identical to SEQ ID NO: 6247
  Description of Artificial Sequence: Synthetic polypeptide
  VL of XENP018149

SEQ ID NO: 12242 - protein, 11 aa, Artificial Sequence
  Description of Artificial Sequence: Synthetic peptide
  XENP018149 vlCDR1
RASQSVSNDVA

SEQ ID NO: 12243 - protein, 7 aa, Artificial Sequence
  Description of Artificial Sequence: Synthetic peptide
  XENP018149 vlCDR2
YASHRYT

SEQ ID NO: 12244 - protein, 9 aa, Artificial Sequence
  Description of Artificial Sequence: Synthetic peptide
  XENP018149 vlCDR3
QQDYSSPRT

SEQ ID NO: 12245 - protein, 451 aa, Artificial Sequence
  Description of Artificial Sequence: Synthetic polypeptide
  XENP018150 1G6_H1.53_L1_IgG1_PVA_/S267K Heavy Chain
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12246 - protein, 122 aa, Artificial Sequence; identical to SEQ ID NO: 6828
  Description of Artificial Sequence: Synthetic polypeptide
  VH of XENP018150

SEQ ID NO: 12247 - protein, 5 aa, Artificial Sequence
  Description of Artificial Sequence: Synthetic peptide
  XENP018150 vhCDR1
NYWMN

SEQ ID NO: 12248 - protein, 19 aa, Artificial Sequence
  Description of Artificial Sequence: Synthetic peptide
  XENP018150 vhCDR2
EIRLKSNNYATHYAEPVKG

SEQ ID NO: 12249 - protein, 11 aa, Artificial Sequence
  Description of Artificial Sequence: Synthetic peptide
  XENP018150 vhCDR3
YYGNYGGYFDV

SEQ ID NO: 12250 - protein, 214 aa, Artificial Sequence; identical to SEQ ID NO: 11550
  Description of Artificial Sequence: Synthetic polypeptide
  XENP018150 1G6_H1.53_L1_IgG1_PVA_/S267K Light Chain

SEQ ID NO: 12251 - protein, 107 aa, Artificial Sequence; identical to SEQ ID NO: 6247
  Description of Artificial Sequence: Synthetic polypeptide
  VL of XENP018150

SEQ ID NO: 12252 - protein, 11 aa, Artificial Sequence
  Description of Artificial Sequence: Synthetic peptide
  XENP018150 vlCDR1
RASQSVSNDVA

SEQ ID NO: 12253 - protein, 7 aa, Artificial Sequence
  Description of Artificial Sequence: Synthetic peptide
  XENP018150 vlCDR2
YASHRYT

SEQ ID NO: 12254 - protein, 9 aa, Artificial Sequence
  Description of Artificial Sequence: Synthetic peptide
  XENP018150 vlCDR3
QQDYSSPRT

SEQ ID NO: 12255 - protein, 451 aa, Artificial Sequence
  Description of Artificial Sequence: Synthetic polypeptide
  XENP018151 1G6_H1.54_L1_IgG1_PVA_/S267K Heavy Chain
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12256 - protein, 122 aa, Artificial Sequence; identical to SEQ ID NO: 6837
  Description of Artificial Sequence: Synthetic polypeptide
  VH of XENP018151

SEQ ID NO: 12257 - protein, 5 aa, Artificial Sequence
  Description of Artificial Sequence: Synthetic peptide
  XENP018151 vhCDR1
NYWMN

SEQ ID NO: 12258 - protein, 19 aa, Artificial Sequence
  Description of Artificial Sequence: Synthetic peptide
  XENP018151 vhCDR2
QIRLKSNNYATHYAEPVKG

SEQ ID NO: 12259 - protein, 11 aa, Artificial Sequence
  Description of Artificial Sequence: Synthetic peptide
  XENP018151 vhCDR3
YYGNYGGYFDV

SEQ ID NO: 12260 - protein, 214 aa, Artificial Sequence; identical to SEQ ID NO: 11550
  Description of Artificial Sequence: Synthetic polypeptide
  XENP018151 1G6_H1.54_L1_IgG1_PVA_/S267K Light Chain

SEQ ID NO: 12261 - protein, 107 aa, Artificial Sequence; identical to SEQ ID NO: 6247
  Description of Artificial Sequence: Synthetic polypeptide
  VL of XENP018151

SEQ ID NO: 12262 - protein, 11 aa, Artificial Sequence
  Description of Artificial Sequence: Synthetic peptide
  XENP018151 vlCDR1
RASQSVSNDVA

SEQ ID NO: 12263 - protein, 7 aa, Artificial Sequence
  Description of Artificial Sequence: Synthetic peptide
  XENP018151 vlCDR2
YASHRYT

SEQ ID NO: 12264 - protein, 9 aa, Artificial Sequence
  Description of Artificial Sequence: Synthetic peptide
  XENP018151 vlCDR3
QQDYSSPRT

SEQ ID NO: 12265 - protein, 451 aa, Artificial Sequence
  Description of Artificial Sequence: Synthetic polypeptide
  XENP018152 1G6_H1.55_L1_IgG1_PVA_/S267K Heavy Chain
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12266 - protein, 122 aa, Artificial Sequence; identical to SEQ ID NO: 6846
  Description of Artificial Sequence: Synthetic polypeptide
  VH of XENP018152

SEQ ID NO: 12267 - protein, 5 aa, Artificial Sequence
  Description of Artificial Sequence: Synthetic peptide
  XENP018152 vhCDR1
NYWMN

SEQ ID NO: 12268 - protein, 19 aa, Artificial Sequence
  Description of Artificial Sequence: Synthetic peptide
  XENP018152 vhCDR2
DIRLKSNNYATHYAEPVKG

SEQ ID NO: 12269 - protein, 11 aa, Artificial Sequence
  Description of Artificial Sequence: Synthetic peptide
  XENP018152 vhCDR3
YYGNYGGYFDV

SEQ ID NO: 12270 - protein, 214 aa, Artificial Sequence; identical to SEQ ID NO: 11550
  Description of Artificial Sequence: Synthetic polypeptide
  XENP018152 1G6_H1.55_L1_IgG1_PVA_/S267K Light Chain

SEQ ID NO: 12271 - protein, 107 aa, Artificial Sequence; identical to SEQ ID NO: 6247
  Description of Artificial Sequence: Synthetic polypeptide
  VL of XENP018152

SEQ ID NO: 12272 - protein, 11 aa, Artificial Sequence
  Description of Artificial Sequence: Synthetic peptide
  XENP018152 vlCDR1
RASQSVSNDVA

SEQ ID NO: 12273 - protein, 7 aa, Artificial Sequence
  Description of Artificial Sequence: Synthetic peptide
  XENP018152 vlCDR2
YASHRYT

SEQ ID NO: 12274 - protein, 9 aa, Artificial Sequence
  Description of Artificial Sequence: Synthetic peptide
  XENP018152 vlCDR3
QQDYSSPRT

SEQ ID NO: 12275 - protein, 451 aa, Artificial Sequence
  Description of Artificial Sequence: Synthetic polypeptide
  XENP018153 1G6_H1.56_L1_IgG1_PVA_/S267K Heavy Chain
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12276 - protein, 122 aa, Artificial Sequence; identical to SEQ ID NO: 6855
  Description of Artificial Sequence: Synthetic polypeptide
  VH of XENP018153

SEQ ID NO: 12277 - protein, 5 aa, Artificial Sequence
  Description of Artificial Sequence: Synthetic peptide
  XENP018153 vhCDR1
NYWMN

SEQ ID NO: 12278 - protein, 19 aa, Artificial Sequence
  Description of Artificial Sequence: Synthetic peptide
  XENP018153 vhCDR2
KIRLKSNNYATHYAEPVKG

SEQ ID NO: 12279 - protein, 11 aa, Artificial Sequence
  Description of Artificial Sequence: Synthetic peptide
  XENP018153 vhCDR3
YYGNYGGYFDV

SEQ ID NO: 12280 - protein, 214 aa, Artificial Sequence; identical to SEQ ID NO: 11550
  Description of Artificial Sequence: Synthetic polypeptide
  XENP018153 1G6_H1.56_L1_IgG1_PVA_/S267K Light Chain

SEQ ID NO: 12281 - protein, 107 aa, Artificial Sequence; identical to SEQ ID NO: 6247
  Description of Artificial Sequence: Synthetic polypeptide
  VL of XENP018153

SEQ ID NO: 12282 - protein, 11 aa, Artificial Sequence
  Description of Artificial Sequence: Synthetic peptide
  XENP018153 vlCDR1
RASQSVSNDVA

SEQ ID NO: 12283 - protein, 7 aa, Artificial Sequence
  Description of Artificial Sequence: Synthetic peptide
  XENP018153 vlCDR2
YASHRYT

SEQ ID NO: 12284 - protein, 9 aa, Artificial Sequence
  Description of Artificial Sequence: Synthetic peptide
  XENP018153 vlCDR3
QQDYSSPRT

SEQ ID NO: 12285 - protein, 451 aa, Artificial Sequence
  Description of Artificial Sequence: Synthetic polypeptide
  XENP018154 1G6_H1.57_L1_IgG1_PVA_/S267K Heavy Chain
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12286 - protein, 122 aa, Artificial Sequence; identical to SEQ ID NO: 6864
  Description of Artificial Sequence: Synthetic polypeptide
  VH of XENP018154

SEQ ID NO: 12287 - protein, 5 aa, Artificial Sequence
  Description of Artificial Sequence: Synthetic peptide
  XENP018154 vhCDR1
NYWMN

SEQ ID NO: 12288 - protein, 19 aa, Artificial Sequence
  Description of Artificial Sequence: Synthetic peptide
  XENP018154 vhCDR2
SIRLKSNNYATHYAEPVKG

SEQ ID NO: 12289 - protein, 11 aa, Artificial Sequence
  Description of Artificial Sequence: Synthetic peptide
  XENP018154 vhCDR3
YYGNYGGYFDV

SEQ ID NO: 12290 - protein, 214 aa, Artificial Sequence; identical to SEQ ID NO: 11550
  Description of Artificial Sequence: Synthetic polypeptide
  XENP018154 1G6_H1.57_L1_IgG1_PVA_/S267K Light Chain

SEQ ID NO: 12291 - protein, 107 aa, Artificial Sequence; identical to SEQ ID NO: 6247
  Description of Artificial Sequence: Synthetic polypeptide
  VL of XENP018154

SEQ ID NO: 12292 - protein, 11 aa, Artificial Sequence
  Description of Artificial Sequence: Synthetic peptide
  XENP018154 vlCDR1
RASQSVSNDVA

SEQ ID NO: 12293 - protein, 7 aa, Artificial Sequence
  Description of Artificial Sequence: Synthetic peptide
  XENP018154 vlCDR2
YASHRYT

SEQ ID NO: 12294 - protein, 9 aa, Artificial Sequence
  Description of Artificial Sequence: Synthetic peptide
  XENP018154 vlCDR3
QQDYSSPRT

SEQ ID NO: 12295 - protein, 451 aa, Artificial Sequence
  Description of Artificial Sequence: Synthetic polypeptide
  XENP018155 1G6_H1.58_L1_IgG1_PVA_/S267K Heavy Chain
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12296 - protein, 122 aa, Artificial Sequence; identical to SEQ ID NO: 6873
  Description of Artificial Sequence: Synthetic polypeptide
  VH of XENP018155

SEQ ID NO: 12297 - protein, 5 aa, Artificial Sequence
  Description of Artificial Sequence: Synthetic peptide
  XENP018155 vhCDR1
NYWMN

SEQ ID NO: 12298 - protein, 19 aa, Artificial Sequence
  Description of Artificial Sequence: Synthetic peptide
  XENP018155 vhCDR2
HIRLKSNNYATHYAEPVKG

SEQ ID NO: 12299 - protein, 11 aa, Artificial Sequence
  Description of Artificial Sequence: Synthetic peptide
  XENP018155 vhCDR3
YYGNYGGYFDV

SEQ ID NO: 12300 - protein, 214 aa, Artificial Sequence; identical to SEQ ID NO: 11550
  Description of Artificial Sequence: Synthetic polypeptide
  XENP018155 1G6_H1.58_L1_IgG1_PVA_/S267K Light Chain

SEQ ID NO: 12301 - protein, 107 aa, Artificial Sequence; identical to SEQ ID NO: 6247
  Description of Artificial Sequence: Synthetic polypeptide
  VL of XENP018155

SEQ ID NO: 12302 - protein, 11 aa, Artificial Sequence
  Description of Artificial Sequence: Synthetic peptide
  XENP018155 vlCDR1
RASQSVSNDVA

SEQ ID NO: 12303 - protein, 7 aa, Artificial Sequence
  Description of Artificial Sequence: Synthetic peptide
  XENP018155 vlCDR2
YASHRYT

SEQ ID NO: 12304 - protein, 9 aa, Artificial Sequence
  Description of Artificial Sequence: Synthetic peptide
  XENP018155 vlCDR3
QQDYSSPRT

SEQ ID NO: 12305 - protein, 451 aa, Artificial Sequence
  Description of Artificial Sequence: Synthetic polypeptide
  XENP018156 1G6_H1.59_L1_IgG1_PVA_/S267K Heavy Chain
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12306 - protein, 122 aa, Artificial Sequence; identical to SEQ ID NO: 6882
  Description of Artificial Sequence: Synthetic polypeptide
  VH of XENP018156

SEQ ID NO: 12307 - protein, 5 aa, Artificial Sequence
  Description of Artificial Sequence: Synthetic peptide
  XENP018156 vhCDR1
NYWMN

SEQ ID NO: 12308 - protein, 19 aa, Artificial Sequence
  Description of Artificial Sequence: Synthetic peptide
  XENP018156 vhCDR2
AIRLKSNNYATHYAEPVKG

SEQ ID NO: 12309 - protein, 11 aa, Artificial Sequence
  Description of Artificial Sequence: Synthetic peptide
  XENP018156 vhCDR3
YYGNYGGYFDV

SEQ ID NO: 12310 - protein, 214 aa, Artificial Sequence; identical to SEQ ID NO: 11550
  Description of Artificial Sequence: Synthetic polypeptide
  XENP018156 1G6_H1.59_L1_IgG1_PVA_/S267K Light Chain

SEQ ID NO: 12311 - protein, 107 aa, Artificial Sequence; identical to SEQ ID NO: 6247
  Description of Artificial Sequence: Synthetic polypeptide
  VL of XENP018156

SEQ ID NO: 12312 - protein, 11 aa, Artificial Sequence
  Description of Artificial Sequence: Synthetic peptide
  XENP018156 vlCDR1
RASQSVSNDVA

SEQ ID NO: 12313 - protein, 7 aa, Artificial Sequence
  Description of Artificial Sequence: Synthetic peptide
  XENP018156 vlCDR2
YASHRYT

SEQ ID NO: 12314 - protein, 9 aa, Artificial Sequence
  Description of Artificial Sequence: Synthetic peptide
  XENP018156 vlCDR3
QQDYSSPRT

SEQ ID NO: 12315 - protein, 451 aa, Artificial Sequence
  Description of Artificial Sequence: Synthetic polypeptide
  XENP018157 1G6_H1.60_L1_IgG1_PVA_/S267K Heavy Chain
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12316 - protein, 122 aa, Artificial Sequence; identical to SEQ ID NO: 6891
  Description of Artificial Sequence: Synthetic polypeptide
  VH of XENP018157

SEQ ID NO: 12317 - protein, 5 aa, Artificial Sequence
  Description of Artificial Sequence: Synthetic peptide
  XENP018157 vhCDR1
NYWMN

SEQ ID NO: 12318 - protein, 19 aa, Artificial Sequence
  Description of Artificial Sequence: Synthetic peptide
  XENP018157 vhCDR2
GIRLKSNNYATHYAEPVKG

SEQ ID NO: 12319 - protein, 11 aa, Artificial Sequence
  Description of Artificial Sequence: Synthetic peptide
  XENP018157 vhCDR3
YYGNYGGYFDV

SEQ ID NO: 12320 - protein, 214 aa, Artificial Sequence; identical to SEQ ID NO: 11550
  Description of Artificial Sequence: Synthetic polypeptide
  XENP018157 1G6_H1.60_L1_IgG1_PVA_/S267K Light Chain

SEQ ID NO: 12321 - protein, 107 aa, Artificial Sequence; identical to SEQ ID NO: 6247
  Description of Artificial Sequence: Synthetic polypeptide
  VL of XENP018157

SEQ ID NO: 12322 - protein, 11 aa, Artificial Sequence
  Description of Artificial Sequence: Synthetic peptide
  XENP018157 vlCDR1
RASQSVSNDVA

SEQ ID NO: 12323 - protein, 7 aa, Artificial Sequence
  Description of Artificial Sequence: Synthetic peptide
  XENP018157 vlCDR2
YASHRYT

SEQ ID NO: 12324 - protein, 9 aa, Artificial Sequence
  Description of Artificial Sequence: Synthetic peptide
  XENP018157 vlCDR3
QQDYSSPRT

SEQ ID NO: 12325 - protein, 451 aa, Artificial Sequence
  Description of Artificial Sequence: Synthetic polypeptide
  XENP018158 1G6_H1.61_L1_IgG1_PVA_/S267K Heavy Chain
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12326 - protein, 122 aa, Artificial Sequence; identical to SEQ ID NO: 6900
  Description of Artificial Sequence: Synthetic polypeptide
  VH of XENP018158

SEQ ID NO: 12327 - protein, 5 aa, Artificial Sequence
  Description of Artificial Sequence: Synthetic peptide
  XENP018158 vhCDR1
NYWMN

SEQ ID NO: 12328 - protein, 19 aa, Artificial Sequence
  Description of Artificial Sequence: Synthetic peptide
  XENP018158 vhCDR2
YIRLKSNNYATHYAEPVKG

SEQ ID NO: 12329 - protein, 11 aa, Artificial Sequence
  Description of Artificial Sequence: Synthetic peptide
  XENP018158 vhCDR3
YYGNYGGYFDV

SEQ ID NO: 12330 - protein, 214 aa, Artificial Sequence; identical to SEQ ID NO: 11550
  Description of Artificial Sequence: Synthetic polypeptide
  XENP018158 1G6_H1.61_L1_IgG1_PVA_/S267K Light Chain

SEQ ID NO: 12331 - protein, 107 aa, Artificial Sequence; identical to SEQ ID NO: 6247
  Description of Artificial Sequence: Synthetic polypeptide
  VL of XENP018158

SEQ ID NO: 12332 - protein, 11 aa, Artificial Sequence
  Description of Artificial Sequence: Synthetic peptide
  XENP018158 vlCDR1
RASQSVSNDVA

SEQ ID NO: 12333 - protein, 7 aa, Artificial Sequence
  Description of Artificial Sequence: Synthetic peptide
  XENP018158 vlCDR2
YASHRYT

SEQ ID NO: 12334 - protein, 9 aa, Artificial Sequence
  Description of Artificial Sequence: Synthetic peptide
  XENP018158 vlCDR3
QQDYSSPRT

SEQ ID NO: 12335 - protein, 451 aa, Artificial Sequence
  Description of Artificial Sequence: Synthetic polypeptide
  XENP018159 1G6_H1.62_L1_IgG1_PVA_/S267K Heavy Chain
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12336 - protein, 122 aa, Artificial Sequence; identical to SEQ ID NO: 6909
  Description of Artificial Sequence: Synthetic polypeptide
  VH of XENP018159

SEQ ID NO: 12337 - protein, 5 aa, Artificial Sequence
  Description of Artificial Sequence: Synthetic peptide
  XENP018159 vhCDR1
NYWMN

SEQ ID NO: 12338 - protein, 19 aa, Artificial Sequence
  Description of Artificial Sequence: Synthetic peptide
  XENP018159 vhCDR2
IIRLKSNNYATHYAEPVKG

SEQ ID NO: 12339 - protein, 11 aa, Artificial Sequence
  Description of Artificial Sequence: Synthetic peptide
  XENP018159 vhCDR3
YYGNYGGYFDV

SEQ ID NO: 12340 - protein, 214 aa, Artificial Sequence; identical to SEQ ID NO: 11550
  Description of Artificial Sequence: Synthetic polypeptide
  XENP018159 1G6_H1.62_L1_IgG1_PVA_/S267K Light Chain

SEQ ID NO: 12341 - protein, 107 aa, Artificial Sequence; identical to SEQ ID NO: 6247
  Description of Artificial Sequence: Synthetic polypeptide
  VL of XENP018159

SEQ ID NO: 12342 - protein, 11 aa, Artificial Sequence
  Description of Artificial Sequence: Synthetic peptide
  XENP018159 vlCDR1
RASQSVSNDVA

SEQ ID NO: 12343 - protein, 7 aa, Artificial Sequence
  Description of Artificial Sequence: Synthetic peptide
  XENP018159 vlCDR2
YASHRYT

SEQ ID NO: 12344 - protein, 9 aa, Artificial Sequence
  Description of Artificial Sequence: Synthetic peptide
  XENP018159 vlCDR3
QQDYSSPRT

SEQ ID NO: 12345 - protein, 451 aa, Artificial Sequence
  Description of Artificial Sequence: Synthetic polypeptide
  XENP018160 1G6_H1.63_L1_IgG1_PVA_/S267K Heavy Chain
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12346 - protein, 122 aa, Artificial Sequence; identical to SEQ ID NO: 6918
  Description of Artificial Sequence: Synthetic polypeptide
  VH of XENP018160

SEQ ID NO: 12347 - protein, 5 aa, Artificial Sequence
  Description of Artificial Sequence: Synthetic peptide
  XENP018160 vhCDR1
NYWMN

SEQ ID NO: 12348 - protein, 19 aa, Artificial Sequence
  Description of Artificial Sequence: Synthetic peptide
  XENP018160 vhCDR2
EVRLKSNNYATHYAEPVKG

SEQ ID NO: 12349 - protein, 11 aa, Artificial Sequence
  Description of Artificial Sequence: Synthetic peptide
  XENP018160 vhCDR3
YYGNYGGYFDV

SEQ ID NO: 12350 - protein, 214 aa, Artificial Sequence; identical to SEQ ID NO: 11550
  Description of Artificial Sequence: Synthetic polypeptide
  XENP018160 1G6_H1.63_L1_IgG1_PVA_/S267K Light Chain

SEQ ID NO: 12351 - protein, 107 aa, Artificial Sequence; identical to SEQ ID NO: 6247
  Description of Artificial Sequence: Synthetic polypeptide
  VL of XENP018160

SEQ ID NO: 12352 - protein, 11 aa, Artificial Sequence
  Description of Artificial Sequence: Synthetic peptide
  XENP018160 vlCDR1
RASQSVSNDVA

SEQ ID NO: 12353 - protein, 7 aa, Artificial Sequence
  Description of Artificial Sequence: Synthetic peptide
  XENP018160 vlCDR2
YASHRYT

SEQ ID NO: 12354 - protein, 9 aa, Artificial Sequence
  Description of Artificial Sequence: Synthetic peptide
  XENP018160 vlCDR3
QQDYSSPRT

SEQ ID NO: 12355 - protein, 451 aa, Artificial Sequence
  Description of Artificial Sequence: Synthetic polypeptide
  XENP018161 1G6_H1.64_L1_IgG1_PVA_/S267K Heavy Chain
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12356 - protein, 122 aa, Artificial Sequence; identical to SEQ ID NO: 6927
  Description of Artificial Sequence: Synthetic polypeptide
  VH of XENP018161

SEQ ID NO: 12357 - protein, 5 aa, Artificial Sequence
  Description of Artificial Sequence: Synthetic peptide
  XENP018161 vhCDR1
NYWMN

SEQ ID NO: 12358 - protein, 19 aa, Artificial Sequence
  Description of Artificial Sequence: Synthetic peptide
  XENP018161 vhCDR2
EITLKSNNYATHYAEPVKG

SEQ ID NO: 12359 - protein, 11 aa, Artificial Sequence
  Description of Artificial Sequence: Synthetic peptide
  XENP018161 vhCDR3
YYGNYGGYFDV

SEQ ID NO: 12360 - protein, 214 aa, Artificial Sequence; identical to SEQ ID NO: 11550
  Description of Artificial Sequence: Synthetic polypeptide
  XENP018161 1G6_H1.64_L1_IgG1_PVA_/S267K Light Chain

SEQ ID NO: 12361 - protein, 107 aa, Artificial Sequence; identical to SEQ ID NO: 6247
  Description of Artificial Sequence: Synthetic polypeptide
  VL of XENP018161

SEQ ID NO: 12362 - protein, 11 aa, Artificial Sequence
  Description of Artificial Sequence: Synthetic peptide
  XENP018161 vlCDR1
RASQSVSNDVA

SEQ ID NO: 12363 - protein, 7 aa, Artificial Sequence
  Description of Artificial Sequence: Synthetic peptide
  XENP018161 vlCDR2
YASHRYT

SEQ ID NO: 12364 - protein, 9 aa, Artificial Sequence
  Description of Artificial Sequence: Synthetic peptide
  XENP018161 vlCDR3
QQDYSSPRT

SEQ ID NO: 12365 - protein, 451 aa, Artificial Sequence
  Description of Artificial Sequence: Synthetic polypeptide
  XENP018162 1G6_H1.65_L1_IgG1_PVA_/S267K Heavy Chain
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12366 - protein, 122 aa, Artificial Sequence; identical to SEQ ID NO: 6936
  Description of Artificial Sequence: Synthetic polypeptide
  VH of XENP018162

SEQ ID NO: 12367 - protein, 5 aa, Artificial Sequence
  Description of Artificial Sequence: Synthetic peptide
  XENP018162 vhCDR1
NYWMN

SEQ ID NO: 12368 - protein, 19 aa, Artificial Sequence
  Description of Artificial Sequence: Synthetic peptide
  XENP018162 vhCDR2
EIKLKSNNYATHYAEPVKG

SEQ ID NO: 12369 - protein, 11 aa, Artificial Sequence
  Description of Artificial Sequence: Synthetic peptide
  XENP018162 vhCDR3
YYGNYGGYFDV

SEQ ID NO: 12370 - protein, 214 aa, Artificial Sequence; identical to SEQ ID NO: 11550
  Description of Artificial Sequence: Synthetic polypeptide
  XENP018162 1G6_H1.65_L1_IgG1_PVA_/S267K Light Chain

SEQ ID NO: 12371 - protein, 107 aa, Artificial Sequence; identical to SEQ ID NO: 6247
  Description of Artificial Sequence: Synthetic polypeptide
  VL of XENP018162

SEQ ID NO: 12372 - protein, 11 aa, Artificial Sequence
  Description of Artificial Sequence: Synthetic peptide
  XENP018162 vlCDR1
RASQSVSNDVA

SEQ ID NO: 12373 - protein, 7 aa, Artificial Sequence
  Description of Artificial Sequence: Synthetic peptide
  XENP018162 vlCDR2
YASHRYT

SEQ ID NO: 12374 - protein, 9 aa, Artificial Sequence
  Description of Artificial Sequence: Synthetic peptide
  XENP018162 vlCDR3
QQDYSSPRT

SEQ ID NO: 12375 - protein, 451 aa, Artificial Sequence
  Description of Artificial Sequence: Synthetic polypeptide
  XENP018163 1G6_H1.66_L1_IgG1_PVA_/S267K Heavy Chain
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12376 - protein, 122 aa, Artificial Sequence; identical to SEQ ID NO: 6945
  Description of Artificial Sequence: Synthetic polypeptide
  VH of XENP018163

SEQ ID NO: 12377 - protein, 5 aa, Artificial Sequence
  Description of Artificial Sequence: Synthetic peptide
  XENP018163 vhCDR1
NYWMN

SEQ ID NO: 12378 - protein, 19 aa, Artificial Sequence
  Description of Artificial Sequence: Synthetic peptide
  XENP018163 vhCDR2
EIELKSNNYATHYAEPVKG

SEQ ID NO: 12379 - protein, 11 aa, Artificial Sequence
  Description of Artificial Sequence: Synthetic peptide
  XENP018163 vhCDR3
YYGNYGGYFDV

SEQ ID NO: 12380 - protein, 214 aa, Artificial Sequence; identical to SEQ ID NO: 11550
  Description of Artificial Sequence: Synthetic polypeptide
  XENP018163 1G6_H1.66_L1_IgG1_PVA_/S267K Light Chain

SEQ ID NO: 12381 - protein, 107 aa, Artificial Sequence; identical to SEQ ID NO: 6247
  Description of Artificial Sequence: Synthetic polypeptide
  VL of XENP018163

SEQ ID NO: 12382 - protein, 11 aa, Artificial Sequence
  Description of Artificial Sequence: Synthetic peptide
  XENP018163 vlCDR1
RASQSVSNDVA

SEQ ID NO: 12383 - protein, 7 aa, Artificial Sequence
  Description of Artificial Sequence: Synthetic peptide
  XENP018163 vlCDR2
YASHRYT

SEQ ID NO: 12384 - protein, 9 aa, Artificial Sequence
  Description of Artificial Sequence: Synthetic peptide
  XENP018163 vlCDR3
QQDYSSPRT

SEQ ID NO: 12385 - protein, 451 aa, Artificial Sequence
  Description of Artificial Sequence: Synthetic polypeptide
  XENP018164 1G6_H1.67_L1_IgG1_PVA_/S267K Heavy Chain
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12386 - protein, 122 aa, Artificial Sequence; identical to SEQ ID NO: 6954
  Description of Artificial Sequence: Synthetic polypeptide
  VH of XENP018164

SEQ ID NO: 12387 - protein, 5 aa, Artificial Sequence
  Description of Artificial Sequence: Synthetic peptide
  XENP018164 vhCDR1
NYWMN

SEQ ID NO: 12388 - protein, 19 aa, Artificial Sequence
  Description of Artificial Sequence: Synthetic peptide
  XENP018164 vhCDR2
EIDLKSNNYATHYAEPVKG

SEQ ID NO: 12389 - protein, 11 aa, Artificial Sequence
  Description of Artificial Sequence: Synthetic peptide
  XENP018164 vhCDR3
YYGNYGGYFDV

SEQ ID NO: 12390 - protein, 214 aa, Artificial Sequence; identical to SEQ ID NO: 11550
  Description of Artificial Sequence: Synthetic polypeptide
  XENP018164 1G6_H1.67_L1_IgG1_PVA_/S267K Light Chain

SEQ ID NO: 12391 - protein, 107 aa, Artificial Sequence; identical to SEQ ID NO: 6247
  Description of Artificial Sequence: Synthetic polypeptide
  VL of XENP018164

SEQ ID NO: 12392 - protein, 11 aa, Artificial Sequence
  Description of Artificial Sequence: Synthetic peptide
  XENP018164 vlCDR1
RASQSVSNDVA

SEQ ID NO: 12393 - protein, 7 aa, Artificial Sequence
  Description of Artificial Sequence: Synthetic peptide
  XENP018164 vlCDR2
YASHRYT

SEQ ID NO: 12394 - protein, 9 aa, Artificial Sequence
  Description of Artificial Sequence: Synthetic peptide
  XENP018164 vlCDR3
QQDYSSPRT

SEQ ID NO: 12395 - protein, 451 aa, Artificial Sequence
  Description of Artificial Sequence: Synthetic polypeptide
  XENP018165 1G6_H1.68_L1_IgG1_PVA_/S267K Heavy Chain
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12396 - protein, 122 aa, Artificial Sequence; identical to SEQ ID NO: 6963
  Description of Artificial Sequence: Synthetic polypeptide
  VH of XENP018165

SEQ ID NO: 12397 - protein, 5 aa, Artificial Sequence
  Description of Artificial Sequence: Synthetic peptide
  XENP018165 vhCDR1
NYWMN

SEQ ID NO: 12398 - protein, 19 aa, Artificial Sequence
  Description of Artificial Sequence: Synthetic peptide
  XENP018165 vhCDR2
EIHLKSNNYATHYAEPVKG

SEQ ID NO: 12399 - protein, 11 aa, Artificial Sequence
  Description of Artificial Sequence: Synthetic peptide
  XENP018165 vhCDR3
YYGNYGGYFDV

SEQ ID NO: 12400 - protein, 214 aa, Artificial Sequence; identical to SEQ ID NO: 11550
  Description of Artificial Sequence: Synthetic polypeptide
  XENP018165 1G6_H1.68_L1_IgG1_PVA_/S267K Light Chain

SEQ ID NO: 12401 - protein, 107 aa, Artificial Sequence; identical to SEQ ID NO: 6247
  Description of Artificial Sequence: Synthetic polypeptide
  VL of XENP018165

SEQ ID NO: 12402 - protein, 11 aa, Artificial Sequence
  Description of Artificial Sequence: Synthetic peptide
  XENP018165 vlCDR1
RASQSVSNDVA

SEQ ID NO: 12403 - protein, 7 aa, Artificial Sequence
  Description of Artificial Sequence: Synthetic peptide
  XENP018165 vlCDR2
YASHRYT

SEQ ID NO: 12404 - protein, 9 aa, Artificial Sequence
  Description of Artificial Sequence: Synthetic peptide
  XENP018165 vlCDR3
QQDYSSPRT

SEQ ID NO: 12405 - protein, 451 aa, Artificial Sequence
  Description of Artificial Sequence: Synthetic polypeptide
  XENP018166 1G6_H1.69_L1_IgG1_PVA_/S267K Heavy Chain
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12406 - protein, 122 aa, Artificial Sequence; identical to SEQ ID NO: 6972
  Description of Artificial Sequence: Synthetic polypeptide
  VH of XENP018166

SEQ ID NO: 12407 - protein, 5 aa, Artificial Sequence
  Description of Artificial Sequence: Synthetic peptide
  XENP018166 vhCDR1
NYWMN

SEQ ID NO: 12408 - protein, 19 aa, Artificial Sequence
  Description of Artificial Sequence: Synthetic peptide
  XENP018166 vhCDR2
EISLKSNNYATHYAEPVKG

SEQ ID NO: 12409 - protein, 11 aa, Artificial Sequence
  Description of Artificial Sequence: Synthetic peptide
  XENP018166 vhCDR3
YYGNYGGYFDV

SEQ ID NO: 12410 - protein, 214 aa, Artificial Sequence; identical to SEQ ID NO: 11550
  Description of Artificial Sequence: Synthetic polypeptide
  XENP018166 1G6_H1.69_L1_IgG1_PVA_/S267K Light Chain

SEQ ID NO: 12411 - protein, 107 aa, Artificial Sequence; identical to SEQ ID NO: 6247
  Description of Artificial Sequence: Synthetic polypeptide
  VL of XENP018166

SEQ ID NO: 12412 - protein, 11 aa, Artificial Sequence
  Description of Artificial Sequence: Synthetic peptide
  XENP018166 vlCDR1
RASQSVSNDVA

SEQ ID NO: 12413 - protein, 7 aa, Artificial Sequence
  Description of Artificial Sequence: Synthetic peptide
  XENP018166 vlCDR2
YASHRYT

SEQ ID NO: 12414 - protein, 9 aa, Artificial Sequence
  Description of Artificial Sequence: Synthetic peptide
  XENP018166 vlCDR3
QQDYSSPRT

SEQ ID NO: 12415 - protein, 451 aa, Artificial Sequence
  Description of Artificial Sequence: Synthetic polypeptide
  XENP018167 1G6_H1.70_L1_IgG1_PVA_/S267K Heavy Chain
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12416 - protein, 122 aa, Artificial Sequence; identical to SEQ ID NO: 6981
  Description of Artificial Sequence: Synthetic polypeptide
  VH of XENP018167

SEQ ID NO: 12417 - protein, 5 aa, Artificial Sequence
  Description of Artificial Sequence: Synthetic peptide
  XENP018167 vhCDR1
NYWMN

SEQ ID NO: 12418 - protein, 19 aa, Artificial Sequence
  Description of Artificial Sequence: Synthetic peptide
  XENP018167 vhCDR2
EIGLKSNNYATHYAEPVKG

SEQ ID NO: 12419 - protein, 11 aa, Artificial Sequence
  Description of Artificial Sequence: Synthetic peptide
  XENP018167 vhCDR3
YYGNYGGYFDV

SEQ ID NO: 12420 - protein, 214 aa, Artificial Sequence; identical to SEQ ID NO: 11550
  Description of Artificial Sequence: Synthetic polypeptide
  XENP018167 1G6_H1.70_L1_IgG1_PVA_/S267K Light Chain

SEQ ID NO: 12421 - protein, 107 aa, Artificial Sequence; identical to SEQ ID NO: 6247
  Description of Artificial Sequence: Synthetic polypeptide
  VL of XENP018167

SEQ ID NO: 12422 - protein, 11 aa, Artificial Sequence
  Description of Artificial Sequence: Synthetic peptide
  XENP018167 vlCDR1
RASQSVSNDVA

SEQ ID NO: 12423 - protein, 7 aa, Artificial Sequence
  Description of Artificial Sequence: Synthetic peptide
  XENP018167 vlCDR2
YASHRYT

SEQ ID NO: 12424 - protein, 9 aa, Artificial Sequence
  Description of Artificial Sequence: Synthetic peptide
  XENP018167 vlCDR3
QQDYSSPRT

SEQ ID NO: 12425 - protein, 451 aa, Artificial Sequence
  Description of Artificial Sequence: Synthetic polypeptide
  XENP018168 1G6_H1.71_L1_IgG1_PVA_/S267K Heavy Chain
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12426 - protein, 122 aa, Artificial Sequence; identical to SEQ ID NO: 6990
  Description of Artificial Sequence: Synthetic polypeptide
  VH of XENP018168

SEQ ID NO: 12427 - protein, 5 aa, Artificial Sequence
  Description of Artificial Sequence: Synthetic peptide
  XENP018168 vhCDR1
NYWMN

SEQ ID NO: 12428 - protein, 19 aa, Artificial Sequence
  Description of Artificial Sequence: Synthetic peptide
  XENP018168 vhCDR2
EIYLKSNNYATHYAEPVKG

SEQ ID NO: 12429 - protein, 11 aa, Artificial Sequence
  Description of Artificial Sequence: Synthetic peptide
  XENP018168 vhCDR3
YYGNYGGYFDV

SEQ ID NO: 12430 - protein, 214 aa, Artificial Sequence; identical to SEQ ID NO: 11550
  Description of Artificial Sequence: Synthetic polypeptide
  XENP018168 1G6_H1.71_L1_IgG1_PVA_/S267K Light Chain

SEQ ID NO: 12431 - protein, 107 aa, Artificial Sequence; identical to SEQ ID NO: 6247
  Description of Artificial Sequence: Synthetic polypeptide
  VL of XENP018168

SEQ ID NO: 12432 - protein, 11 aa, Artificial Sequence
  Description of Artificial Sequence: Synthetic peptide
  XENP018168 vlCDR1
RASQSVSNDVA

SEQ ID NO: 12433 - protein, 7 aa, Artificial Sequence
  Description of Artificial Sequence: Synthetic peptide
  XENP018168 vlCDR2
YASHRYT

SEQ ID NO: 12434 - protein, 9 aa, Artificial Sequence
  Description of Artificial Sequence: Synthetic peptide
  XENP018168 vlCDR3
QQDYSSPRT

SEQ ID NO: 12435 - protein, 451 aa, Artificial Sequence
  Description of Artificial Sequence: Synthetic polypeptide
  XENP018169 1G6_H1.72_L1_IgG1_PVA_/S267K Heavy Chain
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12436 - protein, 122 aa, Artificial Sequence; identical to SEQ ID NO: 6999
  Description of Artificial Sequence: Synthetic polypeptide
  VH of XENP018169

SEQ ID NO: 12437 - protein, 5 aa, Artificial Sequence
  Description of Artificial Sequence: Synthetic peptide
  XENP018169 vhCDR1
NYWMN

SEQ ID NO: 12438 - protein, 19 aa, Artificial Sequence
  Description of Artificial Sequence: Synthetic peptide
  XENP018169 vhCDR2
EIILKSNNYATHYAEPVKG

SEQ ID NO: 12439 - protein, 11 aa, Artificial Sequence
  Description of Artificial Sequence: Synthetic peptide
  XENP018169 vhCDR3
YYGNYGGYFDV

SEQ ID NO: 12440 - protein, 214 aa, Artificial Sequence; identical to SEQ ID NO: 11550
  Description of Artificial Sequence: Synthetic polypeptide
  XENP018169 1G6_H1.72_L1_IgG1_PVA_/S267K Light Chain

SEQ ID NO: 12441 - protein, 107 aa, Artificial Sequence; identical to SEQ ID NO: 6247
  Description of Artificial Sequence: Synthetic polypeptide
  VL of XENP018169

SEQ ID NO: 12442 - protein, 11 aa, Artificial Sequence
  Description of Artificial Sequence: Synthetic peptide
  XENP018169 vlCDR1
RASQSVSNDVA

SEQ ID NO: 12443 - protein, 7 aa, Artificial Sequence
  Description of Artificial Sequence: Synthetic peptide
  XENP018169 vlCDR2
YASHRYT

SEQ ID NO: 12444 - protein, 9 aa, Artificial Sequence
  Description of Artificial Sequence: Synthetic peptide
  XENP018169 vlCDR3
QQDYSSPRT

SEQ ID NO: 12445 - protein, 451 aa, Artificial Sequence
  Description of Artificial Sequence: Synthetic polypeptide
  XENP018170 1G6_H1.73_L1_IgG1_PVA_/S267K Heavy Chain
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12446 - protein, 122 aa, Artificial Sequence; identical to SEQ ID NO: 7008
  Description of Artificial Sequence: Synthetic polypeptide
  VH of XENP018170

SEQ ID NO: 12447 - protein, 5 aa, Artificial Sequence
  Description of Artificial Sequence: Synthetic peptide
  XENP018170 vhCDR1
NYWMN

SEQ ID NO: 12448 - protein, 19 aa, Artificial Sequence
  Description of Artificial Sequence: Synthetic peptide
  XENP018170 vhCDR2
EIWLKSNNYATHYAEPVKG

SEQ ID NO: 12449 - protein, 11 aa, Artificial Sequence
  Description of Artificial Sequence: Synthetic peptide
  XENP018170 vhCDR3
YYGNYGGYFDV

SEQ ID NO: 12450 - protein, 214 aa, Artificial Sequence; identical to SEQ ID NO: 11550
  Description of Artificial Sequence: Synthetic polypeptide
  XENP018170 1G6_H1.73_L1_IgG1_PVA_/S267K Light Chain

SEQ ID NO: 12451 - protein, 107 aa, Artificial Sequence; identical to SEQ ID NO: 6247
  Description of Artificial Sequence: Synthetic polypeptide
  VL of XENP018170

SEQ ID NO: 12452 - protein, 11 aa, Artificial Sequence
  Description of Artificial Sequence: Synthetic peptide
  XENP018170 vlCDR1
RASQSVSNDVA

SEQ ID NO: 12453 - protein, 7 aa, Artificial Sequence
  Description of Artificial Sequence: Synthetic peptide
  XENP018170 vlCDR2
YASHRYT

SEQ ID NO: 12454 - protein, 9 aa, Artificial Sequence
  Description of Artificial Sequence: Synthetic peptide
  XENP018170 vlCDR3
QQDYSSPRT

SEQ ID NO: 12455 - protein, 451 aa, Artificial Sequence
  Description of Artificial Sequence: Synthetic polypeptide
  XENP018171 1G6_H1.74_L1_IgG1_PVA_/S267K Heavy Chain
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12456 - protein, 122 aa, Artificial Sequence; identical to SEQ ID NO: 7017
  Description of Artificial Sequence: Synthetic polypeptide
  VH of XENP018171

SEQ ID NO: 12457 - protein, 5 aa, Artificial Sequence
  Description of Artificial Sequence: Synthetic peptide
  XENP018171 vhCDR1
NYWMN

SEQ ID NO: 12458 - protein, 19 aa, Artificial Sequence
  Description of Artificial Sequence: Synthetic peptide
  XENP018171 vhCDR2
EIRIKSNNYATHYAEPVKG

SEQ ID NO: 12459 - protein, 11 aa, Artificial Sequence
  Description of Artificial Sequence: Synthetic peptide
  XENP018171 vhCDR3
YYGNYGGYFDV

SEQ ID NO: 12460 - protein, 214 aa, Artificial Sequence; identical to SEQ ID NO: 11550
  Description of Artificial Sequence: Synthetic polypeptide
  XENP018171 1G6_H1.74_L1_IgG1_PVA_/S267K Light Chain

SEQ ID NO: 12461 - protein, 107 aa, Artificial Sequence; identical to SEQ ID NO: 6247
  Description of Artificial Sequence: Synthetic polypeptide
  VL of XENP018171

SEQ ID NO: 12462 - protein, 11 aa, Artificial Sequence
  Description of Artificial Sequence: Synthetic peptide
  XENP018171 vlCDR1
RASQSVSNDVA

SEQ ID NO: 12463 - protein, 7 aa, Artificial Sequence
  Description of Artificial Sequence: Synthetic peptide
  XENP018171 vlCDR2
YASHRYT

SEQ ID NO: 12464 - protein, 9 aa, Artificial Sequence
  Description of Artificial Sequence: Synthetic peptide
  XENP018171 vlCDR3
QQDYSSPRT

SEQ ID NO: 12465 - protein, 451 aa, Artificial Sequence
  Description of Artificial Sequence: Synthetic polypeptide
  XENP018172 1G6_H1.75_L1_IgG1_PVA_/S267K Heavy Chain
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12466 - protein, 122 aa, Artificial Sequence; identical to SEQ ID NO: 7026
  Description of Artificial Sequence: Synthetic polypeptide
  VH of XENP018172

SEQ ID NO: 12467 - protein, 5 aa, Artificial Sequence
  Description of Artificial Sequence: Synthetic peptide
  XENP018172 vhCDR1
NYWMN

SEQ ID NO: 12468 - protein, 19 aa, Artificial Sequence
  Description of Artificial Sequence: Synthetic peptide
  XENP018172 vhCDR2
EIRFKSNNYATHYAEPVKG

SEQ ID NO: 12469 - protein, 11 aa, Artificial Sequence
  Description of Artificial Sequence: Synthetic peptide
  XENP018172 vhCDR3
YYGNYGGYFDV

SEQ ID NO: 12470 - protein, 214 aa, Artificial Sequence; identical to SEQ ID NO: 11550
  Description of Artificial Sequence: Synthetic polypeptide
  XENP018172 1G6_H1.75_L1_IgG1_PVA_/S267K Light Chain

SEQ ID NO: 12471 - protein, 107 aa, Artificial Sequence; identical to SEQ ID NO: 6247
  Description of Artificial Sequence: Synthetic polypeptide
  VL of XENP018172

SEQ ID NO: 12472 - protein, 11 aa, Artificial Sequence
  Description of Artificial Sequence: Synthetic peptide
  XENP018172 vlCDR1
RASQSVSNDVA

SEQ ID NO: 12473 - protein, 7 aa, Artificial Sequence
  Description of Artificial Sequence: Synthetic peptide
  XENP018172 vlCDR2
YASHRYT

SEQ ID NO: 12474 - protein, 9 aa, Artificial Sequence
  Description of Artificial Sequence: Synthetic peptide
  XENP018172 vlCDR3
QQDYSSPRT

SEQ ID NO: 12475 - protein, 451 aa, Artificial Sequence
  Description of Artificial Sequence: Synthetic polypeptide
  XENP018173 1G6_H1.76_L1_IgG1_PVA_/S267K Heavy Chain
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12476 - protein, 122 aa, Artificial Sequence; identical to SEQ ID NO: 7035
  Description of Artificial Sequence: Synthetic polypeptide
  VH of XENP018173

SEQ ID NO: 12477 - protein, 5 aa, Artificial Sequence
  Description of Artificial Sequence: Synthetic peptide
  XENP018173 vhCDR1
NYWMN

SEQ ID NO: 12478 - protein, 19 aa, Artificial Sequence
  Description of Artificial Sequence: Synthetic peptide
  XENP018173 vhCDR2
EIRVKSNNYATHYAEPVKG

SEQ ID NO: 12479 - protein, 11 aa, Artificial Sequence
  Description of Artificial Sequence: Synthetic peptide
  XENP018173 vhCDR3
YYGNYGGYFDV

SEQ ID NO: 12480 - protein, 214 aa, Artificial Sequence; identical to SEQ ID NO: 11550
  Description of Artificial Sequence: Synthetic polypeptide
  XENP018173 1G6_H1.76_L1_IgG1_PVA_/S267K Light Chain

SEQ ID NO: 12481 - protein, 107 aa, Artificial Sequence; identical to SEQ ID NO: 6247
  Description of Artificial Sequence: Synthetic polypeptide
  VL of XENP018173

SEQ ID NO: 12482 - protein, 11 aa, Artificial Sequence
  Description of Artificial Sequence: Synthetic peptide
  XENP018173 vlCDR1
RASQSVSNDVA

SEQ ID NO: 12483 - protein, 7 aa, Artificial Sequence
  Description of Artificial Sequence: Synthetic peptide
  XENP018173 vlCDR2
YASHRYT

SEQ ID NO: 12484 - protein, 9 aa, Artificial Sequence
  Description of Artificial Sequence: Synthetic peptide
  XENP018173 vlCDR3
QQDYSSPRT

SEQ ID NO: 12485 - protein, 451 aa, Artificial Sequence
  Description of Artificial Sequence: Synthetic polypeptide
  XENP018174 1G6_H1.77_L1_IgG1_PVA_/S267K Heavy Chain
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12486 - protein, 122 aa, Artificial Sequence; identical to SEQ ID NO: 7044
  Description of Artificial Sequence: Synthetic polypeptide
  VH of XENP018174

SEQ ID NO: 12487 - protein, 5 aa, Artificial Sequence
  Description of Artificial Sequence: Synthetic peptide
  XENP018174 vhCDR1
NYWMN

SEQ ID NO: 12488 - protein, 19 aa, Artificial Sequence
  Description of Artificial Sequence: Synthetic peptide
  XENP018174 vhCDR2
EIRYKSNNYATHYAEPVKG

SEQ ID NO: 12489 - protein, 11 aa, Artificial Sequence
  Description of Artificial Sequence: Synthetic peptide
  XENP018174 vhCDR3
YYGNYGGYFDV

SEQ ID NO: 12490 - protein, 214 aa, Artificial Sequence; identical to SEQ ID NO: 11550
  Description of Artificial Sequence: Synthetic polypeptide
  XENP018174 1G6_H1.77_L1_IgG1_PVA_/S267K Light Chain

SEQ ID NO: 12491 - protein, 107 aa, Artificial Sequence; identical to SEQ ID NO: 6247
  Description of Artificial Sequence: Synthetic polypeptide
  VL of XENP018174

SEQ ID NO: 12492 - protein, 11 aa, Artificial Sequence
  Description of Artificial Sequence: Synthetic peptide
  XENP018174 vlCDR1
RASQSVSNDVA

SEQ ID NO: 12493 - protein, 7 aa, Artificial Sequence
  Description of Artificial Sequence: Synthetic peptide
  XENP018174 vlCDR2
YASHRYT

SEQ ID NO: 12494 - protein, 9 aa, Artificial Sequence
  Description of Artificial Sequence: Synthetic peptide
  XENP018174 vlCDR3
QQDYSSPRT

SEQ ID NO: 12495 - protein, 451 aa, Artificial Sequence
  Description of Artificial Sequence: Synthetic polypeptide
  XENP018175 1G6_H1.78_L1_IgG1_PVA_/S267K Heavy Chain
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12496 - protein, 122 aa, Artificial Sequence; identical to SEQ ID NO: 7053
  Description of Artificial Sequence: Synthetic polypeptide
  VH of XENP018175

SEQ ID NO: 12497 - protein, 5 aa, Artificial Sequence
  Description of Artificial Sequence: Synthetic peptide
  XENP018175 vhCDR1
NYWMN

SEQ ID NO: 12498 - protein, 19 aa, Artificial Sequence
  Description of Artificial Sequence: Synthetic peptide
  XENP018175 vhCDR2
EIRWKSNNYATHYAEPVKG

SEQ ID NO: 12499 - protein, 11 aa, Artificial Sequence
  Description of Artificial Sequence: Synthetic peptide
  XENP018175 vhCDR3
YYGNYGGYFDV

SEQ ID NO: 12500 - protein, 214 aa, Artificial Sequence; identical to SEQ ID NO: 11550
  Description of Artificial Sequence: Synthetic polypeptide
  XENP018175 1G6_H1.78_L1_IgG1_PVA_/S267K Light Chain

SEQ ID NO: 12501 - protein, 107 aa, Artificial Sequence; identical to SEQ ID NO: 6247
  Description of Artificial Sequence: Synthetic polypeptide
  VL of XENP018175

SEQ ID NO: 12502 - protein, 11 aa, Artificial Sequence
  Description of Artificial Sequence: Synthetic peptide
  XENP018175 vlCDR1
RASQSVSNDVA

SEQ ID NO: 12503 - protein, 7 aa, Artificial Sequence
  Description of Artificial Sequence: Synthetic peptide
  XENP018175 vlCDR2
YASHRYT

SEQ ID NO: 12504 - protein, 9 aa, Artificial Sequence
  Description of Artificial Sequence: Synthetic peptide
  XENP018175 vlCDR3
QQDYSSPRT

SEQ ID NO: 12505 - protein, 451 aa, Artificial Sequence
  Description of Artificial Sequence: Synthetic polypeptide
  XENP018176 1G6_H1.79_L1_IgG1_PVA_/S267K Heavy Chain
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12506 - protein, 122 aa, Artificial Sequence; identical to SEQ ID NO: 7062
  Description of Artificial Sequence: Synthetic polypeptide
  VH of XENP018176

SEQ ID NO: 12507 - protein, 5 aa, Artificial Sequence
  Description of Artificial Sequence: Synthetic peptide
  XENP018176 vhCDR1
NYWMN

SEQ ID NO: 12508 - protein, 19 aa, Artificial Sequence
  Description of Artificial Sequence: Synthetic peptide
  XENP018176 vhCDR2
EIRDKSNNYATHYAEPVKG

SEQ ID NO: 12509 - protein, 11 aa, Artificial Sequence
  Description of Artificial Sequence: Synthetic peptide
  XENP018176 vhCDR3
YYGNYGGYFDV

SEQ ID NO: 12510 - protein, 214 aa, Artificial Sequence; identical to SEQ ID NO: 11550
  Description of Artificial Sequence: Synthetic polypeptide
  XENP018176 1G6_H1.79_L1_IgG1_PVA_/S267K Light Chain

SEQ ID NO: 12511 - protein, 107 aa, Artificial Sequence; identical to SEQ ID NO: 6247
  Description of Artificial Sequence: Synthetic polypeptide
  VL of XENP018176

SEQ ID NO: 12512 - protein, 11 aa, Artificial Sequence
  Description of Artificial Sequence: Synthetic peptide
  XENP018176 vlCDR1
RASQSVSNDVA

SEQ ID NO: 12513 - protein, 7 aa, Artificial Sequence
  Description of Artificial Sequence: Synthetic peptide
  XENP018176 vlCDR2
YASHRYT

SEQ ID NO: 12514 - protein, 9 aa, Artificial Sequence
  Description of Artificial Sequence: Synthetic peptide
  XENP018176 vlCDR3
QQDYSSPRT

SEQ ID NO: 12515 - protein, 451 aa, Artificial Sequence
  Description of Artificial Sequence: Synthetic polypeptide
  XENP018177 1G6_H1.80_L1_IgG1_PVA_/S267K Heavy Chain
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12516 - protein, 122 aa, Artificial Sequence; identical to SEQ ID NO: 7071
  Description of Artificial Sequence: Synthetic polypeptide
  VH of XENP018177

SEQ ID NO: 12517 - protein, 5 aa, Artificial Sequence
  Description of Artificial Sequence: Synthetic peptide
  XENP018177 vhCDR1
NYWMN

SEQ ID NO: 12518 - protein, 19 aa, Artificial Sequence
  Description of Artificial Sequence: Synthetic peptide
  XENP018177 vhCDR2
EIRAKSNNYATHYAEPVKG

SEQ ID NO: 12519 - protein, 11 aa, Artificial Sequence
  Description of Artificial Sequence: Synthetic peptide
  XENP018177 vhCDR3
YYGNYGGYFDV

SEQ ID NO: 12520 - protein, 214 aa, Artificial Sequence; identical to SEQ ID NO: 11550
  Description of Artificial Sequence: Synthetic polypeptide
  XENP018177 1G6_H1.80_L1_IgG1_PVA_/S267K Light Chain

SEQ ID NO: 12521 - protein, 107 aa, Artificial Sequence; identical to SEQ ID NO: 6247
  Description of Artificial Sequence: Synthetic polypeptide
  VL of XENP018177

SEQ ID NO: 12522 - protein, 11 aa, Artificial Sequence
  Description of Artificial Sequence: Synthetic peptide
  XENP018177 vlCDR1
RASQSVSNDVA

SEQ ID NO: 12523 - protein, 7 aa, Artificial Sequence
  Description of Artificial Sequence: Synthetic peptide
  XENP018177 vlCDR2
YASHRYT

SEQ ID NO: 12524 - protein, 9 aa, Artificial Sequence
  Description of Artificial Sequence: Synthetic peptide
  XENP018177 vlCDR3
QQDYSSPRT

SEQ ID NO: 12525 - protein, 451 aa, Artificial Sequence
  Description of Artificial Sequence: Synthetic polypeptide
  XENP018178 1G6_H1.81_L1_IgG1_PVA_/S267K Heavy Chain
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12526 - protein, 122 aa, Artificial Sequence; identical to SEQ ID NO: 7080
  Description of Artificial Sequence: Synthetic polypeptide
  VH of XENP018178

SEQ ID NO: 12527 - protein, 5 aa, Artificial Sequence
  Description of Artificial Sequence: Synthetic peptide
  XENP018178 vhCDR1
NYWMN

SEQ ID NO: 12528 - protein, 19 aa, Artificial Sequence
  Description of Artificial Sequence: Synthetic peptide
  XENP018178 vhCDR2
EIRQKSNNYATHYAEPVKG

SEQ ID NO: 12529 - protein, 11 aa, Artificial Sequence
  Description of Artificial Sequence: Synthetic peptide
  XENP018178 vhCDR3
YYGNYGGYFDV

SEQ ID NO: 12530 - protein, 214 aa, Artificial Sequence; identical to SEQ ID NO: 11550
  Description of Artificial Sequence: Synthetic polypeptide
  XENP018178 1G6_H1.81_L1_IgG1_PVA_/S267K Light Chain

SEQ ID NO: 12531 - protein, 107 aa, Artificial Sequence; identical to SEQ ID NO: 6247
  Description of Artificial Sequence: Synthetic polypeptide
  VL of XENP018178

SEQ ID NO: 12532 - protein, 11 aa, Artificial Sequence
  Description of Artificial Sequence: Synthetic peptide
  XENP018178 vlCDR1
RASQSVSNDVA

SEQ ID NO: 12533 - protein, 7 aa, Artificial Sequence
  Description of Artificial Sequence: Synthetic peptide
  XENP018178 vlCDR2
YASHRYT

SEQ ID NO: 12534 - protein, 9 aa, Artificial Sequence
  Description of Artificial Sequence: Synthetic peptide
  XENP018178 vlCDR3
QQDYSSPRT

SEQ ID NO: 12535 - protein, 451 aa, Artificial Sequence
  Description of Artificial Sequence: Synthetic polypeptide
  XENP018179 1G6_H1.82_L1_IgG1_PVA_/S267K Heavy Chain
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12536 - protein, 122 aa, Artificial Sequence; identical to SEQ ID NO: 7089
  Description of Artificial Sequence: Synthetic polypeptide
  VH of XENP018179

SEQ ID NO: 12537 - protein, 5 aa, Artificial Sequence
  Description of Artificial Sequence: Synthetic peptide
  XENP018179 vhCDR1
NYWMN

SEQ ID NO: 12538 - protein, 19 aa, Artificial Sequence
  Description of Artificial Sequence: Synthetic peptide
  XENP018179 vhCDR2
EIRKKSNNYATHYAEPVKG

SEQ ID NO: 12539 - protein, 11 aa, Artificial Sequence
  Description of Artificial Sequence: Synthetic peptide
  XENP018179 vhCDR3
YYGNYGGYFDV

SEQ ID NO: 12540 - protein, 214 aa, Artificial Sequence; identical to SEQ ID NO: 11550
  Description of Artificial Sequence: Synthetic polypeptide
  XENP018179 1G6_H1.82_L1_IgG1_PVA_/S267K Light Chain

SEQ ID NO: 12541 - protein, 107 aa, Artificial Sequence; identical to SEQ ID NO: 6247
  Description of Artificial Sequence: Synthetic polypeptide
  VL of XENP018179

SEQ ID NO: 12542 - protein, 11 aa, Artificial Sequence
  Description of Artificial Sequence: Synthetic peptide
  XENP018179 vlCDR1
RASQSVSNDVA

SEQ ID NO: 12543 - protein, 7 aa, Artificial Sequence
  Description of Artificial Sequence: Synthetic peptide
  XENP018179 vlCDR2
YASHRYT

SEQ ID NO: 12544 - protein, 9 aa, Artificial Sequence
  Description of Artificial Sequence: Synthetic peptide
  XENP018179 vlCDR3
QQDYSSPRT

SEQ ID NO: 12545 - protein, 451 aa, Artificial Sequence
  Description of Artificial Sequence: Synthetic polypeptide
  XENP018180 1G6_H1.83_L1_IgG1_PVA_/S267K Heavy Chain
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12546 - protein, 122 aa, Artificial Sequence; identical to SEQ ID NO: 7098
  Description of Artificial Sequence: Synthetic polypeptide
  VH of XENP018180

SEQ ID NO: 12547 - protein, 5 aa, Artificial Sequence
  Description of Artificial Sequence: Synthetic peptide
  XENP018180 vhCDR1
NYWMN

SEQ ID NO: 12548 - protein, 19 aa, Artificial Sequence
  Description of Artificial Sequence: Synthetic peptide
  XENP018180 vhCDR2
EIRLRSNNYATHYAEPVKG

SEQ ID NO: 12549 - protein, 11 aa, Artificial Sequence
  Description of Artificial Sequence: Synthetic peptide
  XENP018180 vhCDR3
YYGNYGGYFDV

SEQ ID NO: 12550 - protein, 214 aa, Artificial Sequence; identical to SEQ ID NO: 11550
  Description of Artificial Sequence: Synthetic polypeptide
  XENP018180 1G6_H1.83_L1_IgG1_PVA_/S267K Light Chain

SEQ ID NO: 12551 - protein, 107 aa, Artificial Sequence; identical to SEQ ID NO: 6247
  Description of Artificial Sequence: Synthetic polypeptide
  VL of XENP018180

SEQ ID NO: 12552 - protein, 11 aa, Artificial Sequence
  Description of Artificial Sequence: Synthetic peptide
  XENP018180 vlCDR1
RASQSVSNDVA

SEQ ID NO: 12553 - protein, 7 aa, Artificial Sequence
  Description of Artificial Sequence: Synthetic peptide
  XENP018180 vlCDR2
YASHRYT

SEQ ID NO: 12554 - protein, 9 aa, Artificial Sequence
  Description of Artificial Sequence: Synthetic peptide
  XENP018180 vlCDR3
QQDYSSPRT

SEQ ID NO: 12555 - protein, 451 aa, Artificial Sequence
  Description of Artificial Sequence: Synthetic polypeptide
  XENP018181 1G6_H1.84_L1_IgG1_PVA_/S267K Heavy Chain
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12556 - protein, 122 aa, Artificial Sequence; identical to SEQ ID NO: 7107
  Description of Artificial Sequence: Synthetic polypeptide
  VH of XENP018181

SEQ ID NO: 12557 - protein, 5 aa, Artificial Sequence
  Description of Artificial Sequence: Synthetic peptide
  XENP018181 vhCDR1
NYWMN

SEQ ID NO: 12558 - protein, 19 aa, Artificial Sequence
  Description of Artificial Sequence: Synthetic peptide
  XENP018181 vhCDR2
EIRLESNNYATHYAEPVKG

SEQ ID NO: 12559 - protein, 11 aa, Artificial Sequence
  Description of Artificial Sequence: Synthetic peptide
  XENP018181 vhCDR3
YYGNYGGYFDV

SEQ ID NO: 12560 - protein, 214 aa, Artificial Sequence; identical to SEQ ID NO: 11550
  Description of Artificial Sequence: Synthetic polypeptide
  XENP018181 1G6_H1.84_L1_IgG1_PVA_/S267K Light Chain

SEQ ID NO: 12561 - protein, 107 aa, Artificial Sequence; identical to SEQ ID NO: 6247
  Description of Artificial Sequence: Synthetic polypeptide
  VL of XENP018181

SEQ ID NO: 12562 - protein, 11 aa, Artificial Sequence
  Description of Artificial Sequence: Synthetic peptide
  XENP018181 vlCDR1
RASQSVSNDVA

SEQ ID NO: 12563 - protein, 7 aa, Artificial Sequence
  Description of Artificial Sequence: Synthetic peptide
  XENP018181 vlCDR2
YASHRYT

SEQ ID NO: 12564 - protein, 9 aa, Artificial Sequence
  Description of Artificial Sequence: Synthetic peptide
  XENP018181 vlCDR3
QQDYSSPRT

SEQ ID NO: 12565 - protein, 451 aa, Artificial Sequence
  Description of Artificial Sequence: Synthetic polypeptide
  XENP018182 1G6_H1.85_L1_IgG1_PVA_/S267K Heavy Chain
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12566 - protein, 122 aa, Artificial Sequence; identical to SEQ ID NO: 7116
  Description of Artificial Sequence: Synthetic polypeptide
  VH of XENP018182

SEQ ID NO: 12567 - protein, 5 aa, Artificial Sequence
  Description of Artificial Sequence: Synthetic peptide
  XENP018182 vhCDR1
NYWMN

SEQ ID NO: 12568 - protein, 19 aa, Artificial Sequence
  Description of Artificial Sequence: Synthetic peptide
  XENP018182 vhCDR2
EIRLHSNNYATHYAEPVKG

SEQ ID NO: 12569 - protein, 11 aa, Artificial Sequence
  Description of Artificial Sequence: Synthetic peptide
  XENP018182 vhCDR3
YYGNYGGYFDV

SEQ ID NO: 12570 - protein, 214 aa, Artificial Sequence; identical to SEQ ID NO: 11550
  Description of Artificial Sequence: Synthetic polypeptide
  XENP018182 1G6_H1.85_L1_IgG1_PVA_/S267K Light Chain

SEQ ID NO: 12571 - protein, 107 aa, Artificial Sequence; identical to SEQ ID NO: 6247
  Description of Artificial Sequence: Synthetic polypeptide
  VL of XENP018182

SEQ ID NO: 12572 - protein, 11 aa, Artificial Sequence
  Description of Artificial Sequence: Synthetic peptide
  XENP018182 vlCDR1
RASQSVSNDVA

SEQ ID NO: 12573 - protein, 7 aa, Artificial Sequence
  Description of Artificial Sequence: Synthetic peptide
  XENP018182 vlCDR2
YASHRYT

SEQ ID NO: 12574 - protein, 9 aa, Artificial Sequence
  Description of Artificial Sequence: Synthetic peptide
  XENP018182 vlCDR3
QQDYSSPRT

SEQ ID NO: 12575 - protein, 451 aa, Artificial Sequence
  Description of Artificial Sequence: Synthetic polypeptide
  XENP018183 1G6_H1.86_L1_IgG1_PVA_/S267K Heavy Chain
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12576 - protein, 122 aa, Artificial Sequence; identical to SEQ ID NO: 7125
  Description of Artificial Sequence: Synthetic polypeptide
  VH of XENP018183

SEQ ID NO: 12577 - protein, 5 aa, Artificial Sequence
  Description of Artificial Sequence: Synthetic peptide
  XENP018183 vhCDR1
NYWMN

SEQ ID NO: 12578 - protein, 19 aa, Artificial Sequence
  Description of Artificial Sequence: Synthetic peptide
  XENP018183 vhCDR2
EIRLSSNNYATHYAEPVKG

SEQ ID NO: 12579 - protein, 11 aa, Artificial Sequence
  Description of Artificial Sequence: Synthetic peptide
  XENP018183 vhCDR3
YYGNYGGYFDV

SEQ ID NO: 12580 - protein, 214 aa, Artificial Sequence; identical to SEQ ID NO: 11550
  Description of Artificial Sequence: Synthetic polypeptide
  XENP018183 1G6_H1.86_L1_IgG1_PVA_/S267K Light Chain

SEQ ID NO: 12581 - protein, 107 aa, Artificial Sequence; identical to SEQ ID NO: 6247
  Description of Artificial Sequence: Synthetic polypeptide
  VL of XENP018183

SEQ ID NO: 12582 - protein, 11 aa, Artificial Sequence
  Description of Artificial Sequence: Synthetic peptide
  XENP018183 vlCDR1
RASQSVSNDVA

SEQ ID NO: 12583 - protein, 7 aa, Artificial Sequence
  Description of Artificial Sequence: Synthetic peptide
  XENP018183 vlCDR2
YASHRYT

SEQ ID NO: 12584 - protein, 9 aa, Artificial Sequence
  Description of Artificial Sequence: Synthetic peptide
  XENP018183 vlCDR3
QQDYSSPRT

SEQ ID NO: 12585 - protein, 451 aa, Artificial Sequence
  Description of Artificial Sequence: Synthetic polypeptide
  XENP018184 1G6_H1.87_L1_IgG1_PVA_/S267K Heavy Chain
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12586 - protein, 122 aa, Artificial Sequence; identical to SEQ ID NO: 7134
  Description of Artificial Sequence: Synthetic polypeptide
  VH of XENP018184

SEQ ID NO: 12587 - protein, 5 aa, Artificial Sequence
  Description of Artificial Sequence: Synthetic peptide
  XENP018184 vhCDR1
NYWMN

SEQ ID NO: 12588 - protein, 19 aa, Artificial Sequence
  Description of Artificial Sequence: Synthetic peptide
  XENP018184 vhCDR2
EIRLDSNNYATHYAEPVKG

SEQ ID NO: 12589 - protein, 11 aa, Artificial Sequence
  Description of Artificial Sequence: Synthetic peptide
  XENP018184 vhCDR3
YYGNYGGYFDV

SEQ ID NO: 12590 - protein, 214 aa, Artificial Sequence; identical to SEQ ID NO: 11550
  Description of Artificial Sequence: Synthetic polypeptide
  XENP018184 1G6_H1.87_L1_IgG1_PVA_/S267K Light Chain

SEQ ID NO: 12591 - protein, 107 aa, Artificial Sequence; identical to SEQ ID NO: 6247
  Description of Artificial Sequence: Synthetic polypeptide
  VL of XENP018184

SEQ ID NO: 12592 - protein, 11 aa, Artificial Sequence
  Description of Artificial Sequence: Synthetic peptide
  XENP018184 vlCDR1
RASQSVSNDVA

SEQ ID NO: 12593 - protein, 7 aa, Artificial Sequence
  Description of Artificial Sequence: Synthetic peptide
  XENP018184 vlCDR2
YASHRYT

SEQ ID NO: 12594 - protein, 9 aa, Artificial Sequence
  Description of Artificial Sequence: Synthetic peptide
  XENP018184 vlCDR3
QQDYSSPRT

SEQ ID NO: 12595 - protein, 451 aa, Artificial Sequence
  Description of Artificial Sequence: Synthetic polypeptide
  XENP018185 1G6_H1.88_L1_IgG1_PVA_/S267K Heavy Chain
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12596 - protein, 122 aa, Artificial Sequence; identical to SEQ ID NO: 7143
  Description of Artificial Sequence: Synthetic polypeptide
  VH of XENP018185

SEQ ID NO: 12597 - protein, 5 aa, Artificial Sequence
  Description of Artificial Sequence: Synthetic peptide
  XENP018185 vhCDR1
NYWMN

SEQ ID NO: 12598 - protein, 19 aa, Artificial Sequence
  Description of Artificial Sequence: Synthetic peptide
  XENP018185 vhCDR2
EIRLASNNYATHYAEPVKG

SEQ ID NO: 12599 - protein, 11 aa, Artificial Sequence
  Description of Artificial Sequence: Synthetic peptide
  XENP018185 vhCDR3
YYGNYGGYFDV

SEQ ID NO: 12600 - protein, 214 aa, Artificial Sequence; identical to SEQ ID NO: 11550
  Description of Artificial Sequence: Synthetic polypeptide
  XENP018185 1G6_H1.88_L1_IgG1_PVA_/S267K Light Chain

SEQ ID NO: 12601 - protein, 107 aa, Artificial Sequence; identical to SEQ ID NO: 6247
  Description of Artificial Sequence: Synthetic polypeptide
  VL of XENP018185

SEQ ID NO: 12602 - protein, 11 aa, Artificial Sequence
  Description of Artificial Sequence: Synthetic peptide
  XENP018185 vlCDR1
RASQSVSNDVA

SEQ ID NO: 12603 - protein, 7 aa, Artificial Sequence
  Description of Artificial Sequence: Synthetic peptide
  XENP018185 vlCDR2
YASHRYT

SEQ ID NO: 12604 - protein, 9 aa, Artificial Sequence
  Description of Artificial Sequence: Synthetic peptide
  XENP018185 vlCDR3
QQDYSSPRT

SEQ ID NO: 12605 - protein, 451 aa, Artificial Sequence
  Description of Artificial Sequence: Synthetic polypeptide
  XENP018186 1G6_H1.89_L1_IgG1_PVA_/S267K Heavy Chain
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12606 - protein, 122 aa, Artificial Sequence; identical to SEQ ID NO: 7152
  Description of Artificial Sequence: Synthetic polypeptide
  VH of XENP018186

SEQ ID NO: 12607 - protein, 5 aa, Artificial Sequence
  Description of Artificial Sequence: Synthetic peptide
  XENP018186 vhCDR1
NYWMN

SEQ ID NO: 12608 - protein, 19 aa, Artificial Sequence
  Description of Artificial Sequence: Synthetic peptide
  XENP018186 vhCDR2
EIRLGSNNYATHYAEPVKG

SEQ ID NO: 12609 - protein, 11 aa, Artificial Sequence
  Description of Artificial Sequence: Synthetic peptide
  XENP018186 vhCDR3
YYGNYGGYFDV

SEQ ID NO: 12610 - protein, 214 aa, Artificial Sequence; identical to SEQ ID NO: 11550
  Description of Artificial Sequence: Synthetic polypeptide
  XENP018186 1G6_H1.89_L1_IgG1_PVA_/S267K Light Chain

SEQ ID NO: 12611 - protein, 107 aa, Artificial Sequence; identical to SEQ ID NO: 6247
  Description of Artificial Sequence: Synthetic polypeptide
  VL of XENP018186

SEQ ID NO: 12612 - protein, 11 aa, Artificial Sequence
  Description of Artificial Sequence: Synthetic peptide
  XENP018186 vlCDR1
RASQSVSNDVA

SEQ ID NO: 12613 - protein, 7 aa, Artificial Sequence
  Description of Artificial Sequence: Synthetic peptide
  XENP018186 vlCDR2
YASHRYT

SEQ ID NO: 12614 - protein, 9 aa, Artificial Sequence
  Description of Artificial Sequence: Synthetic peptide
  XENP018186 vlCDR3
QQDYSSPRT

SEQ ID NO: 12615 - protein, 451 aa, Artificial Sequence
  Description of Artificial Sequence: Synthetic polypeptide
  XENP018187 1G6_H1.90_L1_IgG1_PVA_/S267K Heavy Chain
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12616 - protein, 122 aa, Artificial Sequence; identical to SEQ ID NO: 7161
  Description of Artificial Sequence: Synthetic polypeptide
  VH of XENP018187

SEQ ID NO: 12617 - protein, 5 aa, Artificial Sequence
  Description of Artificial Sequence: Synthetic peptide
  XENP018187 vhCDR1
NYWMN

SEQ ID NO: 12618 - protein, 19 aa, Artificial Sequence
  Description of Artificial Sequence: Synthetic peptide
  XENP018187 vhCDR2
EIRLYSNNYATHYAEPVKG

SEQ ID NO: 12619 - protein, 11 aa, Artificial Sequence
  Description of Artificial Sequence: Synthetic peptide
  XENP018187 vhCDR3
YYGNYGGYFDV

SEQ ID NO: 12620 - protein, 214 aa, Artificial Sequence; identical to SEQ ID NO: 11550
  Description of Artificial Sequence: Synthetic polypeptide
  XENP018187 1G6_H1.90_L1_IgG1_PVA_/S267K Light Chain

SEQ ID NO: 12621 - protein, 107 aa, Artificial Sequence; identical to SEQ ID NO: 6247
  Description of Artificial Sequence: Synthetic polypeptide
  VL of XENP018187

SEQ ID NO: 12622 - protein, 11 aa, Artificial Sequence
  Description of Artificial Sequence: Synthetic peptide
  XENP018187 vlCDR1
RASQSVSNDVA

SEQ ID NO: 12623 - protein, 7 aa, Artificial Sequence
  Description of Artificial Sequence: Synthetic peptide
  XENP018187 vlCDR2
YASHRYT

SEQ ID NO: 12624 - protein, 9 aa, Artificial Sequence
  Description of Artificial Sequence: Synthetic peptide
  XENP018187 vlCDR3
QQDYSSPRT

SEQ ID NO: 12625 - protein, 451 aa, Artificial Sequence
  Description of Artificial Sequence: Synthetic polypeptide
  XENP018188 1G6_H1.91_L1_IgG1_PVA_/S267K Heavy Chain
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12626 - protein, 122 aa, Artificial Sequence; identical to SEQ ID NO: 7170
  Description of Artificial Sequence: Synthetic polypeptide
  VH of XENP018188

SEQ ID NO: 12627 - protein, 5 aa, Artificial Sequence
  Description of Artificial Sequence: Synthetic peptide
  XENP018188 vhCDR1
NYWMN

SEQ ID NO: 12628 - protein, 19 aa, Artificial Sequence
  Description of Artificial Sequence: Synthetic peptide
  XENP018188 vhCDR2
EIRLISNNYATHYAEPVKG

SEQ ID NO: 12629 - protein, 11 aa, Artificial Sequence
  Description of Artificial Sequence: Synthetic peptide
  XENP018188 vhCDR3
YYGNYGGYFDV

SEQ ID NO: 12630 - protein, 214 aa, Artificial Sequence; identical to SEQ ID NO: 11550
  Description of Artificial Sequence: Synthetic polypeptide
  XENP018188 1G6_H1.91_L1_IgG1_PVA_/S267K Light Chain

SEQ ID NO: 12631 - protein, 107 aa, Artificial Sequence; identical to SEQ ID NO: 6247
  Description of Artificial Sequence: Synthetic polypeptide
  VL of XENP018188

SEQ ID NO: 12632 - protein, 11 aa, Artificial Sequence
  Description of Artificial Sequence: Synthetic peptide
  XENP018188 vlCDR1
RASQSVSNDVA

SEQ ID NO: 12633 - protein, 7 aa, Artificial Sequence
  Description of Artificial Sequence: Synthetic peptide
  XENP018188 vlCDR2
YASHRYT

SEQ ID NO: 12634 - protein, 9 aa, Artificial Sequence
  Description of Artificial Sequence: Synthetic peptide
  XENP018188 vlCDR3
QQDYSSPRT

SEQ ID NO: 12635 - protein, 451 aa, Artificial Sequence
  Description of Artificial Sequence: Synthetic polypeptide
  XENP018189 1G6_H1.92_L1_IgG1_PVA_/S267K Heavy Chain
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12636 - protein, 122 aa, Artificial Sequence; identical to SEQ ID NO: 7179
  Description of Artificial Sequence: Synthetic polypeptide
  VH of XENP018189

SEQ ID NO: 12637 - protein, 5 aa, Artificial Sequence
  Description of Artificial Sequence: Synthetic peptide
  XENP018189 vhCDR1
NYWMN

SEQ ID NO: 12638 - protein, 19 aa, Artificial Sequence
  Description of Artificial Sequence: Synthetic peptide
  XENP018189 vhCDR2
EIRLKTNNYATHYAEPVKG

SEQ ID NO: 12639 - protein, 11 aa, Artificial Sequence
  Description of Artificial Sequence: Synthetic peptide
  XENP018189 vhCDR3
YYGNYGGYFDV

SEQ ID NO: 12640 - protein, 214 aa, Artificial Sequence; identical to SEQ ID NO: 11550
  Description of Artificial Sequence: Synthetic polypeptide
  XENP018189 1G6_H1.92_L1_IgG1_PVA_/S267K Light Chain

SEQ ID NO: 12641 - protein, 107 aa, Artificial Sequence; identical to SEQ ID NO: 6247
  Description of Artificial Sequence: Synthetic polypeptide
  VL of XENP018189

SEQ ID NO: 12642 - protein, 11 aa, Artificial Sequence
  Description of Artificial Sequence: Synthetic peptide
  XENP018189 vlCDR1
RASQSVSNDVA

SEQ ID NO: 12643 - protein, 7 aa, Artificial Sequence
  Description of Artificial Sequence: Synthetic peptide
  XENP018189 vlCDR2
YASHRYT

SEQ ID NO: 12644 - protein, 9 aa, Artificial Sequence
  Description of Artificial Sequence: Synthetic peptide
  XENP018189 vlCDR3
QQDYSSPRT

SEQ ID NO: 12645 - protein, 451 aa, Artificial Sequence
  Description of Artificial Sequence: Synthetic polypeptide
  XENP018190 1G6_H1.93_L1_IgG1_PVA_/S267K Heavy Chain
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12646 - protein, 122 aa, Artificial Sequence; identical to SEQ ID NO: 7188
  Description of Artificial Sequence: Synthetic polypeptide
  VH of XENP018190

SEQ ID NO: 12647 - protein, 5 aa, Artificial Sequence
  Description of Artificial Sequence: Synthetic peptide
  XENP018190 vhCDR1
NYWMN

SEQ ID NO: 12648 - protein, 19 aa, Artificial Sequence
  Description of Artificial Sequence: Synthetic peptide
  XENP018190 vhCDR2
EIRLKANNYATHYAEPVKG

SEQ ID NO: 12649 - protein, 11 aa, Artificial Sequence
  Description of Artificial Sequence: Synthetic peptide
  XENP018190 vhCDR3
YYGNYGGYFDV

SEQ ID NO: 12650 - protein, 214 aa, Artificial Sequence; identical to SEQ ID NO: 11550
  Description of Artificial Sequence: Synthetic polypeptide
  XENP018190 1G6_H1.93_L1_IgG1_PVA_/S267K Light Chain

SEQ ID NO: 12651 - protein, 107 aa, Artificial Sequence; identical to SEQ ID NO: 6247
  Description of Artificial Sequence: Synthetic polypeptide
  VL of XENP018190

SEQ ID NO: 12652 - protein, 11 aa, Artificial Sequence
  Description of Artificial Sequence: Synthetic peptide
  XENP018190 vlCDR1
RASQSVSNDVA

SEQ ID NO: 12653 - protein, 7 aa, Artificial Sequence
  Description of Artificial Sequence: Synthetic peptide
  XENP018190 vlCDR2
YASHRYT

SEQ ID NO: 12654 - protein, 9 aa, Artificial Sequence
  Description of Artificial Sequence: Synthetic peptide
  XENP018190 vlCDR3
QQDYSSPRT

SEQ ID NO: 12655 - protein, 451 aa, Artificial Sequence
  Description of Artificial Sequence: Synthetic polypeptide
  XENP018191 1G6_H1.94_L1_IgG1_PVA_/S267K Heavy Chain
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12656 - protein, 122 aa, Artificial Sequence; identical to SEQ ID NO: 7197
  Description of Artificial Sequence: Synthetic polypeptide
  VH of XENP018191

SEQ ID NO: 12657 - protein, 5 aa, Artificial Sequence
  Description of Artificial Sequence: Synthetic peptide
  XENP018191 vhCDR1
NYWMN

SEQ ID NO: 12658 - protein, 19 aa, Artificial Sequence
  Description of Artificial Sequence: Synthetic peptide
  XENP018191 vhCDR2
EIRLKQNNYATHYAEPVKG

SEQ ID NO: 12659 - protein, 11 aa, Artificial Sequence
  Description of Artificial Sequence: Synthetic peptide
  XENP018191 vhCDR3
YYGNYGGYFDV

SEQ ID NO: 12660 - protein, 214 aa, Artificial Sequence; identical to SEQ ID NO: 11550
  Description of Artificial Sequence: Synthetic polypeptide
  XENP018191 1G6_H1.94_L1_IgG1_PVA_/S267K Light Chain

SEQ ID NO: 12661 - protein, 107 aa, Artificial Sequence; identical to SEQ ID NO: 6247
  Description of Artificial Sequence: Synthetic polypeptide
  VL of XENP018191

SEQ ID NO: 12662 - protein, 11 aa, Artificial Sequence
  Description of Artificial Sequence: Synthetic peptide
  XENP018191 vlCDR1
RASQSVSNDVA

SEQ ID NO: 12663 - protein, 7 aa, Artificial Sequence
  Description of Artificial Sequence: Synthetic peptide
  XENP018191 vlCDR2
YASHRYT

SEQ ID NO: 12664 - protein, 9 aa, Artificial Sequence
  Description of Artificial Sequence: Synthetic peptide
  XENP018191 vlCDR3
QQDYSSPRT

SEQ ID NO: 12665 - protein, 451 aa, Artificial Sequence
  Description of Artificial Sequence: Synthetic polypeptide
  XENP018192 1G6_H1.95_L1_IgG1_PVA_/S267K Heavy Chain
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12666 - protein, 122 aa, Artificial Sequence; identical to SEQ ID NO: 7206
  Description of Artificial Sequence: Synthetic polypeptide
  VH of XENP018192

SEQ ID NO: 12667 - protein, 5 aa, Artificial Sequence
  Description of Artificial Sequence: Synthetic peptide
  XENP018192 vhCDR1
NYWMN

SEQ ID NO: 12668 - protein, 19 aa, Artificial Sequence
  Description of Artificial Sequence: Synthetic peptide
  XENP018192 vhCDR2
EIRLKGNNYATHYAEPVKG

SEQ ID NO: 12669 - protein, 11 aa, Artificial Sequence
  Description of Artificial Sequence: Synthetic peptide
  XENP018192 vhCDR3
YYGNYGGYFDV

SEQ ID NO: 12670 - protein, 214 aa, Artificial Sequence; identical to SEQ ID NO: 11550
  Description of Artificial Sequence: Synthetic polypeptide
  XENP018192 1G6_H1.95_L1_IgG1_PVA_/S267K Light Chain

SEQ ID NO: 12671 - protein, 107 aa, Artificial Sequence; identical to SEQ ID NO: 6247
  Description of Artificial Sequence: Synthetic polypeptide
  VL of XENP018192

SEQ ID NO: 12672 - protein, 11 aa, Artificial Sequence
  Description of Artificial Sequence: Synthetic peptide
  XENP018192 vlCDR1
RASQSVSNDVA

SEQ ID NO: 12673 - protein, 7 aa, Artificial Sequence
  Description of Artificial Sequence: Synthetic peptide
  XENP018192 vlCDR2
YASHRYT

SEQ ID NO: 12674 - protein, 9 aa, Artificial Sequence
  Description of Artificial Sequence: Synthetic peptide
  XENP018192 vlCDR3
QQDYSSPRT

SEQ ID NO: 12675 - protein, 451 aa, Artificial Sequence
  Description of Artificial Sequence: Synthetic polypeptide
  XENP018193 1G6_H1.96_L1_IgG1_PVA_/S267K Heavy Chain
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12676 - protein, 122 aa, Artificial Sequence; identical to SEQ ID NO: 7215
  Description of Artificial Sequence: Synthetic polypeptide
  VH of XENP018193

SEQ ID NO: 12677 - protein, 5 aa, Artificial Sequence
  Description of Artificial Sequence: Synthetic peptide
  XENP018193 vhCDR1
NYWMN

SEQ ID NO: 12678 - protein, 19 aa, Artificial Sequence
  Description of Artificial Sequence: Synthetic peptide
  XENP018193 vhCDR2
EIRLKVNNYATHYAEPVKG

SEQ ID NO: 12679 - protein, 11 aa, Artificial Sequence
  Description of Artificial Sequence: Synthetic peptide
  XENP018193 vhCDR3
YYGNYGGYFDV

SEQ ID NO: 12680 - protein, 214 aa, Artificial Sequence; identical to SEQ ID NO: 11550
  Description of Artificial Sequence: Synthetic polypeptide
  XENP018193 1G6_H1.96_L1_IgG1_PVA_/S267K Light Chain

SEQ ID NO: 12681 - protein, 107 aa, Artificial Sequence; identical to SEQ ID NO: 6247
  Description of Artificial Sequence: Synthetic polypeptide
  VL of XENP018193

SEQ ID NO: 12682 - protein, 11 aa, Artificial Sequence
  Description of Artificial Sequence: Synthetic peptide
  XENP018193 vlCDR1
RASQSVSNDVA

SEQ ID NO: 12683 - protein, 7 aa, Artificial Sequence
  Description of Artificial Sequence: Synthetic peptide
  XENP018193 vlCDR2
YASHRYT

SEQ ID NO: 12684 - protein, 9 aa, Artificial Sequence
  Description of Artificial Sequence: Synthetic peptide
  XENP018193 vlCDR3
QQDYSSPRT

SEQ ID NO: 12685 - protein, 451 aa, Artificial Sequence
  Description of Artificial Sequence: Synthetic polypeptide
  XENP018194 1G6_H1.97_L1_IgG1_PVA_/S267K Heavy Chain
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12686 - protein, 122 aa, Artificial Sequence; identical to SEQ ID NO: 7224
  Description of Artificial Sequence: Synthetic polypeptide
  VH of XENP018194

SEQ ID NO: 12687 - protein, 5 aa, Artificial Sequence
  Description of Artificial Sequence: Synthetic peptide
  XENP018194 vhCDR1
NYWMN

SEQ ID NO: 12688 - protein, 19 aa, Artificial Sequence
  Description of Artificial Sequence: Synthetic peptide
  XENP018194 vhCDR2
EIRLKHNNYATHYAEPVKG

SEQ ID NO: 12689 - protein, 11 aa, Artificial Sequence
  Description of Artificial Sequence: Synthetic peptide
  XENP018194 vhCDR3
YYGNYGGYFDV

SEQ ID NO: 12690 - protein, 214 aa, Artificial Sequence; identical to SEQ ID NO: 11550
  Description of Artificial Sequence: Synthetic polypeptide
  XENP018194 1G6_H1.97_L1_IgG1_PVA_/S267K Light Chain

SEQ ID NO: 12691 - protein, 107 aa, Artificial Sequence; identical to SEQ ID NO: 6247
  Description of Artificial Sequence: Synthetic polypeptide
  VL of XENP018194

SEQ ID NO: 12692 - protein, 11 aa, Artificial Sequence
  Description of Artificial Sequence: Synthetic peptide
  XENP018194 vlCDR1
RASQSVSNDVA

SEQ ID NO: 12693 - protein, 7 aa, Artificial Sequence
  Description of Artificial Sequence: Synthetic peptide
  XENP018194 vlCDR2
YASHRYT

SEQ ID NO: 12694 - protein, 9 aa, Artificial Sequence
  Description of Artificial Sequence: Synthetic peptide
  XENP018194 vlCDR3
QQDYSSPRT

SEQ ID NO: 12695 - protein, 451 aa, Artificial Sequence
  Description of Artificial Sequence: Synthetic polypeptide
  XENP018195 1G6_H1.98_L1_IgG1_PVA_/S267K Heavy Chain
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12696 - protein, 122 aa, Artificial Sequence; identical to SEQ ID NO: 7233
  Description of Artificial Sequence: Synthetic polypeptide
  VH of XENP018195

SEQ ID NO: 12697 - protein, 5 aa, Artificial Sequence
  Description of Artificial Sequence: Synthetic peptide
  XENP018195 vhCDR1
NYWMN

SEQ ID NO: 12698 - protein, 19 aa, Artificial Sequence
  Description of Artificial Sequence: Synthetic peptide
  XENP018195 vhCDR2
EIRLKDNNYATHYAEPVKG

SEQ ID NO: 12699 - protein, 11 aa, Artificial Sequence
  Description of Artificial Sequence: Synthetic peptide
  XENP018195 vhCDR3
YYGNYGGYFDV

SEQ ID NO: 12700 - protein, 214 aa, Artificial Sequence; identical to SEQ ID NO: 11550
  Description of Artificial Sequence: Synthetic polypeptide
  XENP018195 1G6_H1.98_L1_IgG1_PVA_/S267K Light Chain

SEQ ID NO: 12701 - protein, 107 aa, Artificial Sequence; identical to SEQ ID NO: 6247
  Description of Artificial Sequence: Synthetic polypeptide
  VL of XENP018195

SEQ ID NO: 12702 - protein, 11 aa, Artificial Sequence
  Description of Artificial Sequence: Synthetic peptide
  XENP018195 vlCDR1
RASQSVSNDVA

SEQ ID NO: 12703 - protein, 7 aa, Artificial Sequence
  Description of Artificial Sequence: Synthetic peptide
  XENP018195 vlCDR2
YASHRYT

SEQ ID NO: 12704 - protein, 9 aa, Artificial Sequence
  Description of Artificial Sequence: Synthetic peptide
  XENP018195 vlCDR3
QQDYSSPRT

SEQ ID NO: 12705 - protein, 451 aa, Artificial Sequence
  Description of Artificial Sequence: Synthetic polypeptide
  XENP018196 1G6_H1.99_L1_IgG1_PVA_/S267K Heavy Chain
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12706 - protein, 122 aa, Artificial Sequence; identical to SEQ ID NO: 7242
  Description of Artificial Sequence: Synthetic polypeptide
  VH of XENP018196

SEQ ID NO: 12707 - protein, 5 aa, Artificial Sequence
  Description of Artificial Sequence: Synthetic peptide
  XENP018196 vhCDR1
NYWMN

SEQ ID NO: 12708 - protein, 19 aa, Artificial Sequence
  Description of Artificial Sequence: Synthetic peptide
  XENP018196 vhCDR2
EIRLKKNNYATHYAEPVKG

SEQ ID NO: 12709 - protein, 11 aa, Artificial Sequence
  Description of Artificial Sequence: Synthetic peptide
  XENP018196 vhCDR3
YYGNYGGYFDV

SEQ ID NO: 12710 - protein, 214 aa, Artificial Sequence; identical to SEQ ID NO: 11550
  Description of Artificial Sequence: Synthetic polypeptide
  XENP018196 1G6_H1.99_L1_IgG1_PVA_/S267K Light Chain

SEQ ID NO: 12711 - protein, 107 aa, Artificial Sequence; identical to SEQ ID NO: 6247
  Description of Artificial Sequence: Synthetic polypeptide
  VL of XENP018196

SEQ ID NO: 12712 - protein, 11 aa, Artificial Sequence
  Description of Artificial Sequence: Synthetic peptide
  XENP018196 vlCDR1
RASQSVSNDVA

SEQ ID NO: 12713 - protein, 7 aa, Artificial Sequence
  Description of Artificial Sequence: Synthetic peptide
  XENP018196 vlCDR2
YASHRYT

SEQ ID NO: 12714 - protein, 9 aa, Artificial Sequence
  Description of Artificial Sequence: Synthetic peptide
  XENP018196 vlCDR3
QQDYSSPRT

SEQ ID NO: 12715 - protein, 451 aa, Artificial Sequence
  Description of Artificial Sequence: Synthetic polypeptide
  XENP018201 1G6_H1.100_L1_IgG1_PVA_/S267K Heavy Chain
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12716 - protein, 122 aa, Artificial Sequence; identical to SEQ ID NO: 7251
  Description of Artificial Sequence: Synthetic polypeptide
  VH of XENP018201

SEQ ID NO: 12717 - protein, 5 aa, Artificial Sequence
  Description of Artificial Sequence: Synthetic peptide
  XENP018201 vhCDR1
NYWMN

SEQ ID NO: 12718 - protein, 19 aa, Artificial Sequence
  Description of Artificial Sequence: Synthetic peptide
  XENP018201 vhCDR2
EIRLKYNNYATHYAEPVKG

SEQ ID NO: 12719 - protein, 11 aa, Artificial Sequence
  Description of Artificial Sequence: Synthetic peptide
  XENP018201 vhCDR3
YYGNYGGYFDV

SEQ ID NO: 12720 - protein, 214 aa, Artificial Sequence; identical to SEQ ID NO: 11550
  Description of Artificial Sequence: Synthetic polypeptide
  XENP018201 1G6_H1.100_L1_IgG1_PVA_/S267K Light Chain

SEQ ID NO: 12721 - protein, 107 aa, Artificial Sequence; identical to SEQ ID NO: 6247
  Description of Artificial Sequence: Synthetic polypeptide
  VL of XENP018201

SEQ ID NO: 12722 - protein, 11 aa, Artificial Sequence
  Description of Artificial Sequence: Synthetic peptide
  XENP018201 vlCDR1
RASQSVSNDVA

SEQ ID NO: 12723 - protein, 7 aa, Artificial Sequence
  Description of Artificial Sequence: Synthetic peptide
  XENP018201 vlCDR2
YASHRYT

SEQ ID NO: 12724 - protein, 9 aa, Artificial Sequence
  Description of Artificial Sequence: Synthetic peptide
  XENP018201 vlCDR3
QQDYSSPRT

SEQ ID NO: 12725 - protein, 451 aa, Artificial Sequence
  Description of Artificial Sequence: Synthetic polypeptide
  XENP018202 1G6_H1.101_L1_IgG1_PVA_/S267K Heavy Chain
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12726 - protein, 122 aa, Artificial Sequence; identical to SEQ ID NO: 7260
  Description of Artificial Sequence: Synthetic polypeptide
  VH of XENP018202

SEQ ID NO: 12727 - protein, 5 aa, Artificial Sequence
  Description of Artificial Sequence: Synthetic peptide
  XENP018202 vhCDR1
NYWMN

SEQ ID NO: 12728 - protein, 19 aa, Artificial Sequence
  Description of Artificial Sequence: Synthetic peptide
  XENP018202 vhCDR2
EIRLKSDNYATHYAEPVKG

SEQ ID NO: 12729 - protein, 11 aa, Artificial Sequence
  Description of Artificial Sequence: Synthetic peptide
  XENP018202 vhCDR3
YYGNYGGYFDV

SEQ ID NO: 12730 - protein, 214 aa, Artificial Sequence; identical to SEQ ID NO: 11550
  Description of Artificial Sequence: Synthetic polypeptide
  XENP018202 1G6_H1.101_L1_IgG1_PVA_/S267K Light Chain

SEQ ID NO: 12731 - protein, 107 aa, Artificial Sequence; identical to SEQ ID NO: 6247
  Description of Artificial Sequence: Synthetic polypeptide
  VL of XENP018202

SEQ ID NO: 12732 - protein, 11 aa, Artificial Sequence
  Description of Artificial Sequence: Synthetic peptide
  XENP018202 vlCDR1
RASQSVSNDVA

SEQ ID NO: 12733 - protein, 7 aa, Artificial Sequence
  Description of Artificial Sequence: Synthetic peptide
  XENP018202 vlCDR2
YASHRYT

SEQ ID NO: 12734 - protein, 9 aa, Artificial Sequence
  Description of Artificial Sequence: Synthetic peptide
  XENP018202 vlCDR3
QQDYSSPRT

SEQ ID NO: 12735 - protein, 451 aa, Artificial Sequence
  Description of Artificial Sequence: Synthetic polypeptide
  XENP018203 1G6_H1.102_L1_IgG1_PVA_/S267K Heavy Chain
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12736 - protein, 122 aa, Artificial Sequence; identical to SEQ ID NO: 7269
  Description of Artificial Sequence: Synthetic polypeptide
  VH of XENP018203

SEQ ID NO: 12737 - protein, 5 aa, Artificial Sequence
  Description of Artificial Sequence: Synthetic peptide
  XENP018203 vhCDR1
NYWMN

SEQ ID NO: 12738 - protein, 19 aa, Artificial Sequence
  Description of Artificial Sequence: Synthetic peptide
  XENP018203 vhCDR2
EIRLKSHNYATHYAEPVKG

SEQ ID NO: 12739 - protein, 11 aa, Artificial Sequence
  Description of Artificial Sequence: Synthetic peptide
  XENP018203 vhCDR3
YYGNYGGYFDV

SEQ ID NO: 12740 - protein, 214 aa, Artificial Sequence; identical to SEQ ID NO: 11550
  Description of Artificial Sequence: Synthetic polypeptide
  XENP018203 1G6_H1.102_L1_IgG1_PVA_/S267K Light Chain

SEQ ID NO: 12741 - protein, 107 aa, Artificial Sequence; identical to SEQ ID NO: 6247
  Description of Artificial Sequence: Synthetic polypeptide
  VL of XENP018203

SEQ ID NO: 12742 - protein, 11 aa, Artificial Sequence
  Description of Artificial Sequence: Synthetic peptide
  XENP018203 vlCDR1
RASQSVSNDVA

SEQ ID NO: 12743 - protein, 7 aa, Artificial Sequence
  Description of Artificial Sequence: Synthetic peptide
  XENP018203 vlCDR2
YASHRYT

SEQ ID NO: 12744 - protein, 9 aa, Artificial Sequence
  Description of Artificial Sequence: Synthetic peptide
  XENP018203 vlCDR3
QQDYSSPRT

SEQ ID NO: 12745 - protein, 451 aa, Artificial Sequence
  Description of Artificial Sequence: Synthetic polypeptide
  XENP018204 1G6_H1.103_L1_IgG1_PVA_/S267K Heavy Chain
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12746 - protein, 122 aa, Artificial Sequence; identical to SEQ ID NO: 7278
  Description of Artificial Sequence: Synthetic polypeptide
  VH of XENP018204

SEQ ID NO: 12747 - protein, 5 aa, Artificial Sequence
  Description of Artificial Sequence: Synthetic peptide
  XENP018204 vhCDR1
NYWMN

SEQ ID NO: 12748 - protein, 19 aa, Artificial Sequence
  Description of Artificial Sequence: Synthetic peptide
  XENP018204 vhCDR2
EIRLKSENYATHYAEPVKG

SEQ ID NO: 12749 - protein, 11 aa, Artificial Sequence
  Description of Artificial Sequence: Synthetic peptide
  XENP018204 vhCDR3
YYGNYGGYFDV

SEQ ID NO: 12750 - protein, 214 aa, Artificial Sequence; identical to SEQ ID NO: 11550
  Description of Artificial Sequence: Synthetic polypeptide
  XENP018204 1G6_H1.103_L1_IgG1_PVA_/S267K Light Chain

SEQ ID NO: 12751 - protein, 107 aa, Artificial Sequence; identical to SEQ ID NO: 6247
  Description of Artificial Sequence: Synthetic polypeptide
  VL of XENP018204

SEQ ID NO: 12752 - protein, 11 aa, Artificial Sequence
  Description of Artificial Sequence: Synthetic peptide
  XENP018204 vlCDR1
RASQSVSNDVA

SEQ ID NO: 12753 - protein, 7 aa, Artificial Sequence
  Description of Artificial Sequence: Synthetic peptide
  XENP018204 vlCDR2
YASHRYT

SEQ ID NO: 12754 - protein, 9 aa, Artificial Sequence
  Description of Artificial Sequence: Synthetic peptide
  XENP018204 vlCDR3
QQDYSSPRT

SEQ ID NO: 12755 - protein, 451 aa, Artificial Sequence
  Description of Artificial Sequence: Synthetic polypeptide
  XENP018205 1G6_H1.104_L1_IgG1_PVA_/S267K Heavy Chain
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12756 - protein, 122 aa, Artificial Sequence; identical to SEQ ID NO: 7287
  Description of Artificial Sequence: Synthetic polypeptide
  VH of XENP018205

SEQ ID NO: 12757 - protein, 5 aa, Artificial Sequence
  Description of Artificial Sequence: Synthetic peptide
  XENP018205 vhCDR1
NYWMN

SEQ ID NO: 12758 - protein, 19 aa, Artificial Sequence
  Description of Artificial Sequence: Synthetic peptide
  XENP018205 vhCDR2
EIRLKSSNYATHYAEPVKG

SEQ ID NO: 12759 - protein, 11 aa, Artificial Sequence
  Description of Artificial Sequence: Synthetic peptide
  XENP018205 vhCDR3
YYGNYGGYFDV

SEQ ID NO: 12760 - protein, 214 aa, Artificial Sequence; identical to SEQ ID NO: 11550
  Description of Artificial Sequence: Synthetic polypeptide
  XENP018205 1G6_H1.104_L1_IgG1_PVA_/S267K Light Chain

SEQ ID NO: 12761 - protein, 107 aa, Artificial Sequence; identical to SEQ ID NO: 6247
  Description of Artificial Sequence: Synthetic polypeptide
  VL of XENP018205

SEQ ID NO: 12762 - protein, 11 aa, Artificial Sequence
  Description of Artificial Sequence: Synthetic peptide
  XENP018205 vlCDR1
RASQSVSNDVA

SEQ ID NO: 12763 - protein, 7 aa, Artificial Sequence
  Description of Artificial Sequence: Synthetic peptide
  XENP018205 vlCDR2
YASHRYT

SEQ ID NO: 12764 - protein, 9 aa, Artificial Sequence
  Description of Artificial Sequence: Synthetic peptide
  XENP018205 vlCDR3
QQDYSSPRT

SEQ ID NO: 12765 - protein, 451 aa, Artificial Sequence
  Description of Artificial Sequence: Synthetic polypeptide
  XENP018206 1G6_H1.105_L1_IgG1_PVA_/S267K Heavy Chain
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12766 - protein, 122 aa, Artificial Sequence; identical to SEQ ID NO: 7296
  Description of Artificial Sequence: Synthetic polypeptide
  VH of XENP018206

SEQ ID NO: 12767 - protein, 5 aa, Artificial Sequence
  Description of Artificial Sequence: Synthetic peptide
  XENP018206 vhCDR1
NYWMN

SEQ ID NO: 12768 - protein, 19 aa, Artificial Sequence
  Description of Artificial Sequence: Synthetic peptide
  XENP018206 vhCDR2
EIRLKSRNYATHYAEPVKG

SEQ ID NO: 12769 - protein, 11 aa, Artificial Sequence
  Description of Artificial Sequence: Synthetic peptide
  XENP018206 vhCDR3
YYGNYGGYFDV

SEQ ID NO: 12770 - protein, 214 aa, Artificial Sequence; identical to SEQ ID NO: 11550
  Description of Artificial Sequence: Synthetic polypeptide
  XENP018206 1G6_H1.105_L1_IgG1_PVA_/S267K Light Chain

SEQ ID NO: 12771 - protein, 107 aa, Artificial Sequence; identical to SEQ ID NO: 6247
  Description of Artificial Sequence: Synthetic polypeptide
  VL of XENP018206

SEQ ID NO: 12772 - protein, 11 aa, Artificial Sequence
  Description of Artificial Sequence: Synthetic peptide
  XENP018206 vlCDR1
RASQSVSNDVA

SEQ ID NO: 12773 - protein, 7 aa, Artificial Sequence
  Description of Artificial Sequence: Synthetic peptide
  XENP018206 vlCDR2
YASHRYT

SEQ ID NO: 12774 - protein, 9 aa, Artificial Sequence
  Description of Artificial Sequence: Synthetic peptide
  XENP018206 vlCDR3
QQDYSSPRT

SEQ ID NO: 12775 - protein, 451 aa, Artificial Sequence
  Description of Artificial Sequence: Synthetic polypeptide
  XENP018207 1G6_H1.106_L1_IgG1_PVA_/S267K Heavy Chain
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12776 - protein, 122 aa, Artificial Sequence; identical to SEQ ID NO: 7305
  Description of Artificial Sequence: Synthetic polypeptide
  VH of XENP018207

SEQ ID NO: 12777 - protein, 5 aa, Artificial Sequence
  Description of Artificial Sequence: Synthetic peptide
  XENP018207 vhCDR1
NYWMN

SEQ ID NO: 12778 - protein, 19 aa, Artificial Sequence
  Description of Artificial Sequence: Synthetic peptide
  XENP018207 vhCDR2
EIRLKSLNYATHYAEPVKG

SEQ ID NO: 12779 - protein, 11 aa, Artificial Sequence
  Description of Artificial Sequence: Synthetic peptide
  XENP018207 vhCDR3
YYGNYGGYFDV

SEQ ID NO: 12780 - protein, 214 aa, Artificial Sequence; identical to SEQ ID NO: 11550
  Description of Artificial Sequence: Synthetic polypeptide
  XENP018207 1G6_H1.106_L1_IgG1_PVA_/S267K Light Chain

SEQ ID NO: 12781 - protein, 107 aa, Artificial Sequence; identical to SEQ ID NO: 6247
  Description of Artificial Sequence: Synthetic polypeptide
  VL of XENP018207

SEQ ID NO: 12782 - protein, 11 aa, Artificial Sequence
  Description of Artificial Sequence: Synthetic peptide
  XENP018207 vlCDR1
RASQSVSNDVA

SEQ ID NO: 12783 - protein, 7 aa, Artificial Sequence
  Description of Artificial Sequence: Synthetic peptide
  XENP018207 vlCDR2
YASHRYT

SEQ ID NO: 12784 - protein, 9 aa, Artificial Sequence
  Description of Artificial Sequence: Synthetic peptide
  XENP018207 vlCDR3
QQDYSSPRT

SEQ ID NO: 12785 - protein, 451 aa, Artificial Sequence
  Description of Artificial Sequence: Synthetic polypeptide
  XENP018208 1G6_H1.107_L1_IgG1_PVA_/S267K Heavy Chain
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12786 - protein, 122 aa, Artificial Sequence; identical to SEQ ID NO: 7314
  Description of Artificial Sequence: Synthetic polypeptide
  VH of XENP018208

SEQ ID NO: 12787 - protein, 5 aa, Artificial Sequence
  Description of Artificial Sequence: Synthetic peptide
  XENP018208 vhCDR1
NYWMN

SEQ ID NO: 12788 - protein, 19 aa, Artificial Sequence
  Description of Artificial Sequence: Synthetic peptide
  XENP018208 vhCDR2
EIRLKSTNYATHYAEPVKG

SEQ ID NO: 12789 - protein, 11 aa, Artificial Sequence
  Description of Artificial Sequence: Synthetic peptide
  XENP018208 vhCDR3
YYGNYGGYFDV

SEQ ID NO: 12790 - protein, 214 aa, Artificial Sequence; identical to SEQ ID NO: 11550
  Description of Artificial Sequence: Synthetic polypeptide
  XENP018208 1G6_H1.107_L1_IgG1_PVA_/S267K Light Chain

SEQ ID NO: 12791 - protein, 107 aa, Artificial Sequence; identical to SEQ ID NO: 6247
  Description of Artificial Sequence: Synthetic polypeptide
  VL of XENP018208

SEQ ID NO: 12792 - protein, 11 aa, Artificial Sequence
  Description of Artificial Sequence: Synthetic peptide
  XENP018208 vlCDR1
RASQSVSNDVA

SEQ ID NO: 12793 - protein, 7 aa, Artificial Sequence
  Description of Artificial Sequence: Synthetic peptide
  XENP018208 vlCDR2
YASHRYT

SEQ ID NO: 12794 - protein, 9 aa, Artificial Sequence
  Description of Artificial Sequence: Synthetic peptide
  XENP018208 vlCDR3
QQDYSSPRT

SEQ ID NO: 12795 - protein, 451 aa, Artificial Sequence
  Description of Artificial Sequence: Synthetic polypeptide
  XENP018209 1G6_H1.108_L1_IgG1_PVA_/S267K Heavy Chain
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12796 - protein, 122 aa, Artificial Sequence; identical to SEQ ID NO: 7323
  Description of Artificial Sequence: Synthetic polypeptide
  VH of XENP018209

SEQ ID NO: 12797 - protein, 5 aa, Artificial Sequence
  Description of Artificial Sequence: Synthetic peptide
  XENP018209 vhCDR1
NYWMN

SEQ ID NO: 12798 - protein, 19 aa, Artificial Sequence
  Description of Artificial Sequence: Synthetic peptide
  XENP018209 vhCDR2
EIRLKSGNYATHYAEPVKG

SEQ ID NO: 12799 - protein, 11 aa, Artificial Sequence
  Description of Artificial Sequence: Synthetic peptide
  XENP018209 vhCDR3
YYGNYGGYFDV

SEQ ID NO: 12800 - protein, 214 aa, Artificial Sequence; identical to SEQ ID NO: 11550
  Description of Artificial Sequence: Synthetic polypeptide
  XENP018209 1G6_H1.108_L1_IgG1_PVA_/S267K Light Chain

SEQ ID NO: 12801 - protein, 107 aa, Artificial Sequence; identical to SEQ ID NO: 6247
  Description of Artificial Sequence: Synthetic polypeptide
  VL of XENP018209

SEQ ID NO: 12802 - protein, 11 aa, Artificial Sequence
  Description of Artificial Sequence: Synthetic peptide
  XENP018209 vlCDR1
RASQSVSNDVA

SEQ ID NO: 12803 - protein, 7 aa, Artificial Sequence
  Description of Artificial Sequence: Synthetic peptide
  XENP018209 vlCDR2
YASHRYT

SEQ ID NO: 12804 - protein, 9 aa, Artificial Sequence
  Description of Artificial Sequence: Synthetic peptide
  XENP018209 vlCDR3
QQDYSSPRT

SEQ ID NO: 12805 - protein, 451 aa, Artificial Sequence
  Description of Artificial Sequence: Synthetic polypeptide
  XENP018210 1G6_H1.109_L1_IgG1_PVA_/S267K Heavy Chain
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12806 - protein, 122 aa, Artificial Sequence; identical to SEQ ID NO: 7332
  Description of Artificial Sequence: Synthetic polypeptide
  VH of XENP018210

SEQ ID NO: 12807 - protein, 5 aa, Artificial Sequence
  Description of Artificial Sequence: Synthetic peptide
  XENP018210 vhCDR1
NYWMN

SEQ ID NO: 12808 - protein, 19 aa, Artificial Sequence
  Description of Artificial Sequence: Synthetic peptide
  XENP018210 vhCDR2
EIRLKSYNYATHYAEPVKG

SEQ ID NO: 12809 - protein, 11 aa, Artificial Sequence
  Description of Artificial Sequence: Synthetic peptide
  XENP018210 vhCDR3
YYGNYGGYFDV

SEQ ID NO: 12810 - protein, 214 aa, Artificial Sequence; identical to SEQ ID NO: 11550
  Description of Artificial Sequence: Synthetic polypeptide
  XENP018210 1G6_H1.109_L1_IgG1_PVA_/S267K Light Chain

SEQ ID NO: 12811 - protein, 107 aa, Artificial Sequence; identical to SEQ ID NO: 6247
  Description of Artificial Sequence: Synthetic polypeptide
  VL of XENP018210

SEQ ID NO: 12812 - protein, 11 aa, Artificial Sequence
  Description of Artificial Sequence: Synthetic peptide
  XENP018210 vlCDR1
RASQSVSNDVA

SEQ ID NO: 12813 - protein, 7 aa, Artificial Sequence
  Description of Artificial Sequence: Synthetic peptide
  XENP018210 vlCDR2
YASHRYT

SEQ ID NO: 12814 - protein, 9 aa, Artificial Sequence
  Description of Artificial Sequence: Synthetic peptide
  XENP018210 vlCDR3
QQDYSSPRT

SEQ ID NO: 12815 - protein, 451 aa, Artificial Sequence
  Description of Artificial Sequence: Synthetic polypeptide
  XENP018211 1G6_H1.110_L1_IgG1_PVA_/S267K Heavy Chain
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12816 - protein, 122 aa, Artificial Sequence; identical to SEQ ID NO: 7341
  Description of Artificial Sequence: Synthetic polypeptide
  VH of XENP018211

SEQ ID NO: 12817 - protein, 5 aa, Artificial Sequence
  Description of Artificial Sequence: Synthetic peptide
  XENP018211 vhCDR1
NYWMN

SEQ ID NO: 12818 - protein, 19 aa, Artificial Sequence
  Description of Artificial Sequence: Synthetic peptide
  XENP018211 vhCDR2
EIRLKSNDYATHYAEPVKG

SEQ ID NO: 12819 - protein, 11 aa, Artificial Sequence
  Description of Artificial Sequence: Synthetic peptide
  XENP018211 vhCDR3
YYGNYGGYFDV

SEQ ID NO: 12820 - protein, 214 aa, Artificial Sequence; identical to SEQ ID NO: 11550
  Description of Artificial Sequence: Synthetic polypeptide
  XENP018211 1G6_H1.110_L1_IgG1_PVA_/S267K Light Chain

SEQ ID NO: 12821 - protein, 107 aa, Artificial Sequence; identical to SEQ ID NO: 6247
  Description of Artificial Sequence: Synthetic polypeptide
  VL of XENP018211

SEQ ID NO: 12822 - protein, 11 aa, Artificial Sequence
  Description of Artificial Sequence: Synthetic peptide
  XENP018211 vlCDR1
RASQSVSNDVA

SEQ ID NO: 12823 - protein, 7 aa, Artificial Sequence
  Description of Artificial Sequence: Synthetic peptide
  XENP018211 vlCDR2
YASHRYT

SEQ ID NO: 12824 - protein, 9 aa, Artificial Sequence
  Description of Artificial Sequence: Synthetic peptide
  XENP018211 vlCDR3
QQDYSSPRT

SEQ ID NO: 12825 - protein, 451 aa, Artificial Sequence
  Description of Artificial Sequence: Synthetic polypeptide
  XENP018212 1G6_H1.111_L1_IgG1_PVA_/S267K Heavy Chain
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12826 - protein, 122 aa, Artificial Sequence; identical to SEQ ID NO: 7350
  Description of Artificial Sequence: Synthetic polypeptide
  VH of XENP018212

SEQ ID NO: 12827 - protein, 5 aa, Artificial Sequence
  Description of Artificial Sequence: Synthetic peptide
  XENP018212 vhCDR1
NYWMN

SEQ ID NO: 12828 - protein, 19 aa, Artificial Sequence
  Description of Artificial Sequence: Synthetic peptide
  XENP018212 vhCDR2
EIRLKSNHYATHYAEPVKG

SEQ ID NO: 12829 - protein, 11 aa, Artificial Sequence
  Description of Artificial Sequence: Synthetic peptide
  XENP018212 vhCDR3
YYGNYGGYFDV

SEQ ID NO: 12830 - protein, 214 aa, Artificial Sequence; identical to SEQ ID NO: 11550
  Description of Artificial Sequence: Synthetic polypeptide
  XENP018212 1G6_H1.111_L1_IgG1_PVA_/S267K Light Chain

SEQ ID NO: 12831 - protein, 107 aa, Artificial Sequence; identical to SEQ ID NO: 6247
  Description of Artificial Sequence: Synthetic polypeptide
  VL of XENP018212

SEQ ID NO: 12832 - protein, 11 aa, Artificial Sequence
  Description of Artificial Sequence: Synthetic peptide
  XENP018212 vlCDR1
RASQSVSNDVA

SEQ ID NO: 12833 - protein, 7 aa, Artificial Sequence
  Description of Artificial Sequence: Synthetic peptide
  XENP018212 vlCDR2
YASHRYT

SEQ ID NO: 12834 - protein, 9 aa, Artificial Sequence
  Description of Artificial Sequence: Synthetic peptide
  XENP018212 vlCDR3
QQDYSSPRT

SEQ ID NO: 12835 - protein, 451 aa, Artificial Sequence
  Description of Artificial Sequence: Synthetic polypeptide
  XENP018213 1G6_H1.112_L1_IgG1_PVA_/S267K Heavy Chain
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12836 - protein, 122 aa, Artificial Sequence; identical to SEQ ID NO: 7359
  Description of Artificial Sequence: Synthetic polypeptide
  VH of XENP018213

SEQ ID NO: 12837 - protein, 5 aa, Artificial Sequence
  Description of Artificial Sequence: Synthetic peptide
  XENP018213 vhCDR1
NYWMN

SEQ ID NO: 12838 - protein, 19 aa, Artificial Sequence
  Description of Artificial Sequence: Synthetic peptide
  XENP018213 vhCDR2
EIRLKSNEYATHYAEPVKG

SEQ ID NO: 12839 - protein, 11 aa, Artificial Sequence
  Description of Artificial Sequence: Synthetic peptide
  XENP018213 vhCDR3
YYGNYGGYFDV

SEQ ID NO: 12840 - protein, 214 aa, Artificial Sequence; identical to SEQ ID NO: 11550
  Description of Artificial Sequence: Synthetic polypeptide
  XENP018213 1G6_H1.112_L1_IgG1_PVA_/S267K Light Chain

SEQ ID NO: 12841 - protein, 107 aa, Artificial Sequence; identical to SEQ ID NO: 6247
  Description of Artificial Sequence: Synthetic polypeptide
  VL of XENP018213

SEQ ID NO: 12842 - protein, 11 aa, Artificial Sequence
  Description of Artificial Sequence: Synthetic peptide
  XENP018213 vlCDR1
RASQSVSNDVA

SEQ ID NO: 12843 - protein, 7 aa, Artificial Sequence
  Description of Artificial Sequence: Synthetic peptide
  XENP018213 vlCDR2
YASHRYT

SEQ ID NO: 12844 - protein, 9 aa, Artificial Sequence
  Description of Artificial Sequence: Synthetic peptide
  XENP018213 vlCDR3
QQDYSSPRT

SEQ ID NO: 12845 - protein, 451 aa, Artificial Sequence
  Description of Artificial Sequence: Synthetic polypeptide
  XENP018214 1G6_H1.113_L1_IgG1_PVA_/S267K Heavy Chain
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12846 - protein, 122 aa, Artificial Sequence; identical to SEQ ID NO: 7368
  Description of Artificial Sequence: Synthetic polypeptide
  VH of XENP018214

SEQ ID NO: 12847 - protein, 5 aa, Artificial Sequence
  Description of Artificial Sequence: Synthetic peptide
  XENP018214 vhCDR1
NYWMN

SEQ ID NO: 12848 - protein, 19 aa, Artificial Sequence
  Description of Artificial Sequence: Synthetic peptide
  XENP018214 vhCDR2
EIRLKSNSYATHYAEPVKG

SEQ ID NO: 12849 - protein, 11 aa, Artificial Sequence
  Description of Artificial Sequence: Synthetic peptide
  XENP018214 vhCDR3
YYGNYGGYFDV

SEQ ID NO: 12850 - protein, 214 aa, Artificial Sequence; identical to SEQ ID NO: 11550
  Description of Artificial Sequence: Synthetic polypeptide
  XENP018214 1G6_H1.113_L1_IgG1_PVA_/S267K Light Chain

SEQ ID NO: 12851 - protein, 107 aa, Artificial Sequence; identical to SEQ ID NO: 6247
  Description of Artificial Sequence: Synthetic polypeptide
  VL of XENP018214

SEQ ID NO: 12852 - protein, 11 aa, Artificial Sequence
  Description of Artificial Sequence: Synthetic peptide
  XENP018214 vlCDR1
RASQSVSNDVA

SEQ ID NO: 12853 - protein, 7 aa, Artificial Sequence
  Description of Artificial Sequence: Synthetic peptide
  XENP018214 vlCDR2
YASHRYT

SEQ ID NO: 12854 - protein, 9 aa, Artificial Sequence
  Description of Artificial Sequence: Synthetic peptide
  XENP018214 vlCDR3
QQDYSSPRT

SEQ ID NO: 12855 - protein, 451 aa, Artificial Sequence
  Description of Artificial Sequence: Synthetic polypeptide
  XENP018215 1G6_H1.114_L1_IgG1_PVA_/S267K Heavy Chain
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12856 - protein, 122 aa, Artificial Sequence; identical to SEQ ID NO: 7377
  Description of Artificial Sequence: Synthetic polypeptide
  VH of XENP018215

SEQ ID NO: 12857 - protein, 5 aa, Artificial Sequence
  Description of Artificial Sequence: Synthetic peptide
  XENP018215 vhCDR1
NYWMN

SEQ ID NO: 12858 - protein, 19 aa, Artificial Sequence
  Description of Artificial Sequence: Synthetic peptide
  XENP018215 vhCDR2
EIRLKSNRYATHYAEPVKG

SEQ ID NO: 12859 - protein, 11 aa, Artificial Sequence
  Description of Artificial Sequence: Synthetic peptide
  XENP018215 vhCDR3
YYGNYGGYFDV

SEQ ID NO: 12860 - protein, 214 aa, Artificial Sequence; identical to SEQ ID NO: 11550
  Description of Artificial Sequence: Synthetic polypeptide
  XENP018215 1G6_H1.114_L1_IgG1_PVA_/S267K Light Chain

SEQ ID NO: 12861 - protein, 107 aa, Artificial Sequence; identical to SEQ ID NO: 6247
  Description of Artificial Sequence: Synthetic polypeptide
  VL of XENP018215

SEQ ID NO: 12862 - protein, 11 aa, Artificial Sequence
  Description of Artificial Sequence: Synthetic peptide
  XENP018215 vlCDR1
RASQSVSNDVA

SEQ ID NO: 12863 - protein, 7 aa, Artificial Sequence
  Description of Artificial Sequence: Synthetic peptide
  XENP018215 vlCDR2
YASHRYT

SEQ ID NO: 12864 - protein, 9 aa, Artificial Sequence
  Description of Artificial Sequence: Synthetic peptide
  XENP018215 vlCDR3
QQDYSSPRT

SEQ ID NO: 12865 - protein, 451 aa, Artificial Sequence
  Description of Artificial Sequence: Synthetic polypeptide
  XENP018216 1G6_H1.115_L1_IgG1_PVA_/S267K Heavy Chain
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12866 - protein, 122 aa, Artificial Sequence; identical to SEQ ID NO: 7386
  Description of Artificial Sequence: Synthetic polypeptide
  VH of XENP018216

SEQ ID NO: 12867 - protein, 5 aa, Artificial Sequence
  Description of Artificial Sequence: Synthetic peptide
  XENP018216 vhCDR1
NYWMN

SEQ ID NO: 12868 - protein, 19 aa, Artificial Sequence
  Description of Artificial Sequence: Synthetic peptide
  XENP018216 vhCDR2
EIRLKSNLYATHYAEPVKG

SEQ ID NO: 12869 - protein, 11 aa, Artificial Sequence
  Description of Artificial Sequence: Synthetic peptide
  XENP018216 vhCDR3
YYGNYGGYFDV

SEQ ID NO: 12870 - protein, 214 aa, Artificial Sequence; identical to SEQ ID NO: 11550
  Description of Artificial Sequence: Synthetic polypeptide
  XENP018216 1G6_H1.115_L1_IgG1_PVA_/S267K Light Chain

SEQ ID NO: 12871 - protein, 107 aa, Artificial Sequence; identical to SEQ ID NO: 6247
  Description of Artificial Sequence: Synthetic polypeptide
  VL of XENP018216

SEQ ID NO: 12872 - protein, 11 aa, Artificial Sequence
  Description of Artificial Sequence: Synthetic peptide
  XENP018216 vlCDR1
RASQSVSNDVA

SEQ ID NO: 12873 - protein, 7 aa, Artificial Sequence
  Description of Artificial Sequence: Synthetic peptide
  XENP018216 vlCDR2
YASHRYT

SEQ ID NO: 12874 - protein, 9 aa, Artificial Sequence
  Description of Artificial Sequence: Synthetic peptide
  XENP018216 vlCDR3
QQDYSSPRT

SEQ ID NO: 12875 - protein, 451 aa, Artificial Sequence
  Description of Artificial Sequence: Synthetic polypeptide
  XENP018217 1G6_H1.116_L1_IgG1_PVA_/S267K Heavy Chain
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12876 - protein, 122 aa, Artificial Sequence; identical to SEQ ID NO: 7395
  Description of Artificial Sequence: Synthetic polypeptide
  VH of XENP018217

SEQ ID NO: 12877 - protein, 5 aa, Artificial Sequence
  Description of Artificial Sequence: Synthetic peptide
  XENP018217 vhCDR1
NYWMN

SEQ ID NO: 12878 - protein, 19 aa, Artificial Sequence
  Description of Artificial Sequence: Synthetic peptide
  XENP018217 vhCDR2
EIRLKSNTYATHYAEPVKG

SEQ ID NO: 12879 - protein, 11 aa, Artificial Sequence
  Description of Artificial Sequence: Synthetic peptide
  XENP018217 vhCDR3
YYGNYGGYFDV

SEQ ID NO: 12880 - protein, 214 aa, Artificial Sequence; identical to SEQ ID NO: 11550
  Description of Artificial Sequence: Synthetic polypeptide
  XENP018217 1G6_H1.116_L1_IgG1_PVA_/S267K Light Chain

SEQ ID NO: 12881 - protein, 107 aa, Artificial Sequence; identical to SEQ ID NO: 6247
  Description of Artificial Sequence: Synthetic polypeptide
  VL of XENP018217

SEQ ID NO: 12882 - protein, 11 aa, Artificial Sequence
  Description of Artificial Sequence: Synthetic peptide
  XENP018217 vlCDR1
RASQSVSNDVA

SEQ ID NO: 12883 - protein, 7 aa, Artificial Sequence
  Description of Artificial Sequence: Synthetic peptide
  XENP018217 vlCDR2
YASHRYT

SEQ ID NO: 12884 - protein, 9 aa, Artificial Sequence
  Description of Artificial Sequence: Synthetic peptide
  XENP018217 vlCDR3
QQDYSSPRT

SEQ ID NO: 12885 - protein, 451 aa, Artificial Sequence
  Description of Artificial Sequence: Synthetic polypeptide
  XENP018218 1G6_H1.117_L1_IgG1_PVA_/S267K Heavy Chain
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12886 - protein, 122 aa, Artificial Sequence; identical to SEQ ID NO: 7404
  Description of Artificial Sequence: Synthetic polypeptide
  VH of XENP018218

SEQ ID NO: 12887 - protein, 5 aa, Artificial Sequence
  Description of Artificial Sequence: Synthetic peptide
  XENP018218 vhCDR1
NYWMN

SEQ ID NO: 12888 - protein, 19 aa, Artificial Sequence
  Description of Artificial Sequence: Synthetic peptide
  XENP018218 vhCDR2
EIRLKSNGYATHYAEPVKG

SEQ ID NO: 12889 - protein, 11 aa, Artificial Sequence
  Description of Artificial Sequence: Synthetic peptide
  XENP018218 vhCDR3
YYGNYGGYFDV

SEQ ID NO: 12890 - protein, 214 aa, Artificial Sequence; identical to SEQ ID NO: 11550
  Description of Artificial Sequence: Synthetic polypeptide
  XENP018218 1G6_H1.117_L1_IgG1_PVA_/S267K Light Chain

SEQ ID NO: 12891 - protein, 107 aa, Artificial Sequence; identical to SEQ ID NO: 6247
  Description of Artificial Sequence: Synthetic polypeptide
  VL of XENP018218

SEQ ID NO: 12892 - protein, 11 aa, Artificial Sequence
  Description of Artificial Sequence: Synthetic peptide
  XENP018218 vlCDR1
RASQSVSNDVA

SEQ ID NO: 12893 - protein, 7 aa, Artificial Sequence
  Description of Artificial Sequence: Synthetic peptide
  XENP018218 vlCDR2
YASHRYT

SEQ ID NO: 12894 - protein, 9 aa, Artificial Sequence
  Description of Artificial Sequence: Synthetic peptide
  XENP018218 vlCDR3
QQDYSSPRT

SEQ ID NO: 12895 - protein, 451 aa, Artificial Sequence
  Description of Artificial Sequence: Synthetic polypeptide
  XENP018219 1G6_H1.118_L1_IgG1_PVA_/S267K Heavy Chain
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12896 - protein, 122 aa, Artificial Sequence; identical to SEQ ID NO: 7413
  Description of Artificial Sequence: Synthetic polypeptide
  VH of XENP018219

SEQ ID NO: 12897 - protein, 5 aa, Artificial Sequence
  Description of Artificial Sequence: Synthetic peptide
  XENP018219 vhCDR1
NYWMN

SEQ ID NO: 12898 - protein, 19 aa, Artificial Sequence
  Description of Artificial Sequence: Synthetic peptide
  XENP018219 vhCDR2
EIRLKSNYYATHYAEPVKG

SEQ ID NO: 12899 - protein, 11 aa, Artificial Sequence
  Description of Artificial Sequence: Synthetic peptide
  XENP018219 vhCDR3
YYGNYGGYFDV

SEQ ID NO: 12900 - protein, 214 aa, Artificial Sequence; identical to SEQ ID NO: 11550
  Description of Artificial Sequence: Synthetic polypeptide
  XENP018219 1G6_H1.118_L1_IgG1_PVA_/S267K Light Chain

SEQ ID NO: 12901 - protein, 107 aa, Artificial Sequence; identical to SEQ ID NO: 6247
  Description of Artificial Sequence: Synthetic polypeptide
  VL of XENP018219

SEQ ID NO: 12902 - protein, 11 aa, Artificial Sequence
  Description of Artificial Sequence: Synthetic peptide
  XENP018219 vlCDR1
RASQSVSNDVA

SEQ ID NO: 12903 - protein, 7 aa, Artificial Sequence
  Description of Artificial Sequence: Synthetic peptide
  XENP018219 vlCDR2
YASHRYT

SEQ ID NO: 12904 - protein, 9 aa, Artificial Sequence
  Description of Artificial Sequence: Synthetic peptide
  XENP018219 vlCDR3
QQDYSSPRT

SEQ ID NO: 12905 - protein, 451 aa, Artificial Sequence
  Description of Artificial Sequence: Synthetic polypeptide
  XENP018220 1G6_H1.119_L1_IgG1_PVA_/S267K Heavy Chain
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12906 - protein, 122 aa, Artificial Sequence; identical to SEQ ID NO: 7422
  Description of Artificial Sequence: Synthetic polypeptide
  VH of XENP018220

SEQ ID NO: 12907 - protein, 5 aa, Artificial Sequence
  Description of Artificial Sequence: Synthetic peptide
  XENP018220 vhCDR1
NYWMN

SEQ ID NO: 12908 - protein, 19 aa, Artificial Sequence
  Description of Artificial Sequence: Synthetic peptide
  XENP018220 vhCDR2
EIRLKSNNFATHYAEPVKG

SEQ ID NO: 12909 - protein, 11 aa, Artificial Sequence
  Description of Artificial Sequence: Synthetic peptide
  XENP018220 vhCDR3
YYGNYGGYFDV

SEQ ID NO: 12910 - protein, 214 aa, Artificial Sequence; identical to SEQ ID NO: 11550
  Description of Artificial Sequence: Synthetic polypeptide
  XENP018220 1G6_H1.119_L1_IgG1_PVA_/S267K Light Chain

SEQ ID NO: 12911 - protein, 107 aa, Artificial Sequence; identical to SEQ ID NO: 6247
  Description of Artificial Sequence: Synthetic polypeptide
  VL of XENP018220

SEQ ID NO: 12912 - protein, 11 aa, Artificial Sequence
  Description of Artificial Sequence: Synthetic peptide
  XENP018220 vlCDR1
RASQSVSNDVA

SEQ ID NO: 12913 - protein, 7 aa, Artificial Sequence
  Description of Artificial Sequence: Synthetic peptide
  XENP018220 vlCDR2
YASHRYT

SEQ ID NO: 12914 - protein, 9 aa, Artificial Sequence
  Description of Artificial Sequence: Synthetic peptide
  XENP018220 vlCDR3
QQDYSSPRT

SEQ ID NO: 12915 - protein, 451 aa, Artificial Sequence
  Description of Artificial Sequence: Synthetic polypeptide
  XENP018221 1G6_H1.120_L1_IgG1_PVA_/S267K Heavy Chain
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12916 - protein, 122 aa, Artificial Sequence; identical to SEQ ID NO: 7431
  Description of Artificial Sequence: Synthetic polypeptide
  VH of XENP018221

SEQ ID NO: 12917 - protein, 5 aa, Artificial Sequence
  Description of Artificial Sequence: Synthetic peptide
  XENP018221 vhCDR1
NYWMN

SEQ ID NO: 12918 - protein, 19 aa, Artificial Sequence
  Description of Artificial Sequence: Synthetic peptide
  XENP018221 vhCDR2
EIRLKSNNHATHYAEPVKG

SEQ ID NO: 12919 - protein, 11 aa, Artificial Sequence
  Description of Artificial Sequence: Synthetic peptide
  XENP018221 vhCDR3
YYGNYGGYFDV

SEQ ID NO: 12920 - protein, 214 aa, Artificial Sequence; identical to SEQ ID NO: 11550
  Description of Artificial Sequence: Synthetic polypeptide
  XENP018221 1G6_H1.120_L1_IgG1_PVA_/S267K Light Chain

SEQ ID NO: 12921 - protein, 107 aa, Artificial Sequence; identical to SEQ ID NO: 6247
  Description of Artificial Sequence: Synthetic polypeptide
  VL of XENP018221

SEQ ID NO: 12922 - protein, 11 aa, Artificial Sequence
  Description of Artificial Sequence: Synthetic peptide
  XENP018221 vlCDR1
RASQSVSNDVA

SEQ ID NO: 12923 - protein, 7 aa, Artificial Sequence
  Description of Artificial Sequence: Synthetic peptide
  XENP018221 vlCDR2
YASHRYT

SEQ ID NO: 12924 - protein, 9 aa, Artificial Sequence
  Description of Artificial Sequence: Synthetic peptide
  XENP018221 vlCDR3
QQDYSSPRT

SEQ ID NO: 12925 - protein, 451 aa, Artificial Sequence
  Description of Artificial Sequence: Synthetic polypeptide
  XENP018222 1G6_H1.121_L1_IgG1_PVA_/S267K Heavy Chain
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12926 - protein, 122 aa, Artificial Sequence; identical to SEQ ID NO: 7440
  Description of Artificial Sequence: Synthetic polypeptide
  VH of XENP018222

SEQ ID NO: 12927 - protein, 5 aa, Artificial Sequence
  Description of Artificial Sequence: Synthetic peptide
  XENP018222 vhCDR1
NYWMN

SEQ ID NO: 12928 - protein, 19 aa, Artificial Sequence
  Description of Artificial Sequence: Synthetic peptide
  XENP018222 vhCDR2
EIRLKSNNLATHYAEPVKG

SEQ ID NO: 12929 - protein, 11 aa, Artificial Sequence
  Description of Artificial Sequence: Synthetic peptide
  XENP018222 vhCDR3
YYGNYGGYFDV

SEQ ID NO: 12930 - protein, 214 aa, Artificial Sequence; identical to SEQ ID NO: 11550
  Description of Artificial Sequence: Synthetic polypeptide
  XENP018222 1G6_H1.121_L1_IgG1_PVA_/S267K Light Chain

SEQ ID NO: 12931 - protein, 107 aa, Artificial Sequence; identical to SEQ ID NO: 6247
  Description of Artificial Sequence: Synthetic polypeptide
  VL of XENP018222

SEQ ID NO: 12932 - protein, 11 aa, Artificial Sequence
  Description of Artificial Sequence: Synthetic peptide
  XENP018222 vlCDR1
RASQSVSNDVA

SEQ ID NO: 12933 - protein, 7 aa, Artificial Sequence
  Description of Artificial Sequence: Synthetic peptide
  XENP018222 vlCDR2
YASHRYT

SEQ ID NO: 12934 - protein, 9 aa, Artificial Sequence
  Description of Artificial Sequence: Synthetic peptide
  XENP018222 vlCDR3
QQDYSSPRT

SEQ ID NO: 12935 - protein, 451 aa, Artificial Sequence
  Description of Artificial Sequence: Synthetic polypeptide
  XENP018223 1G6_H1.122_L1_IgG1_PVA_/S267K Heavy Chain
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12936 - protein, 122 aa, Artificial Sequence; identical to SEQ ID NO: 7449
  Description of Artificial Sequence: Synthetic polypeptide
  VH of XENP018223

SEQ ID NO: 12937 - protein, 5 aa, Artificial Sequence
  Description of Artificial Sequence: Synthetic peptide
  XENP018223 vhCDR1
NYWMN

SEQ ID NO: 12938 - protein, 19 aa, Artificial Sequence
  Description of Artificial Sequence: Synthetic peptide
  XENP018223 vhCDR2
EIRLKSNNWATHYAEPVKG

SEQ ID NO: 12939 - protein, 11 aa, Artificial Sequence
  Description of Artificial Sequence: Synthetic peptide
  XENP018223 vhCDR3
YYGNYGGYFDV

SEQ ID NO: 12940 - protein, 214 aa, Artificial Sequence; identical to SEQ ID NO: 11550
  Description of Artificial Sequence: Synthetic polypeptide
  XENP018223 1G6_H1.122_L1_IgG1_PVA_/S267K Light Chain

SEQ ID NO: 12941 - protein, 107 aa, Artificial Sequence; identical to SEQ ID NO: 6247
  Description of Artificial Sequence: Synthetic polypeptide
  VL of XENP018223

SEQ ID NO: 12942 - protein, 11 aa, Artificial Sequence
  Description of Artificial Sequence: Synthetic peptide
  XENP018223 vlCDR1
RASQSVSNDVA

SEQ ID NO: 12943 - protein, 7 aa, Artificial Sequence
  Description of Artificial Sequence: Synthetic peptide
  XENP018223 vlCDR2
YASHRYT

SEQ ID NO: 12944 - protein, 9 aa, Artificial Sequence
  Description of Artificial Sequence: Synthetic peptide
  XENP018223 vlCDR3
QQDYSSPRT

SEQ ID NO: 12945 - protein, 451 aa, Artificial Sequence
  Description of Artificial Sequence: Synthetic polypeptide
  XENP018224 1G6_H1.123_L1_IgG1_PVA_/S267K Heavy Chain
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12946 - protein, 122 aa, Artificial Sequence; identical to SEQ ID NO: 7458
  Description of Artificial Sequence: Synthetic polypeptide
  VH of XENP018224

SEQ ID NO: 12947 - protein, 5 aa, Artificial Sequence
  Description of Artificial Sequence: Synthetic peptide
  XENP018224 vhCDR1
NYWMN

SEQ ID NO: 12948 - protein, 19 aa, Artificial Sequence
  Description of Artificial Sequence: Synthetic peptide
  XENP018224 vhCDR2
EIRLKSNNVATHYAEPVKG

SEQ ID NO: 12949 - protein, 11 aa, Artificial Sequence
  Description of Artificial Sequence: Synthetic peptide
  XENP018224 vhCDR3
YYGNYGGYFDV

SEQ ID NO: 12950 - protein, 214 aa, Artificial Sequence; identical to SEQ ID NO: 11550
  Description of Artificial Sequence: Synthetic polypeptide
  XENP018224 1G6_H1.123_L1_IgG1_PVA_/S267K Light Chain

SEQ ID NO: 12951 - protein, 107 aa, Artificial Sequence; identical to SEQ ID NO: 6247
  Description of Artificial Sequence: Synthetic polypeptide
  VL of XENP018224

SEQ ID NO: 12952 - protein, 11 aa, Artificial Sequence
  Description of Artificial Sequence: Synthetic peptide
  XENP018224 vlCDR1
RASQSVSNDVA

SEQ ID NO: 12953 - protein, 7 aa, Artificial Sequence
  Description of Artificial Sequence: Synthetic peptide
  XENP018224 vlCDR2
YASHRYT

SEQ ID NO: 12954 - protein, 9 aa, Artificial Sequence
  Description of Artificial Sequence: Synthetic peptide
  XENP018224 vlCDR3
QQDYSSPRT

SEQ ID NO: 12955 - protein, 451 aa, Artificial Sequence
  Description of Artificial Sequence: Synthetic polypeptide
  XENP018225 1G6_H1.124_L1_IgG1_PVA_/S267K Heavy Chain
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12956 - protein, 122 aa, Artificial Sequence; identical to SEQ ID NO: 7467
  Description of Artificial Sequence: Synthetic polypeptide
  VH of XENP018225

SEQ ID NO: 12957 - protein, 5 aa, Artificial Sequence
  Description of Artificial Sequence: Synthetic peptide
  XENP018225 vhCDR1
NYWMN

SEQ ID NO: 12958 - protein, 19 aa, Artificial Sequence
  Description of Artificial Sequence: Synthetic peptide
  XENP018225 vhCDR2
EIRLKSNNAATHYAEPVKG

SEQ ID NO: 12959 - protein, 11 aa, Artificial Sequence
  Description of Artificial Sequence: Synthetic peptide
  XENP018225 vhCDR3
YYGNYGGYFDV

SEQ ID NO: 12960 - protein, 214 aa, Artificial Sequence; identical to SEQ ID NO: 11550
  Description of Artificial Sequence: Synthetic polypeptide
  XENP018225 1G6_H1.124_L1_IgG1_PVA_/S267K Light Chain

SEQ ID NO: 12961 - protein, 107 aa, Artificial Sequence; identical to SEQ ID NO: 6247
  Description of Artificial Sequence: Synthetic polypeptide
  VL of XENP018225

SEQ ID NO: 12962 - protein, 11 aa, Artificial Sequence
  Description of Artificial Sequence: Synthetic peptide
  XENP018225 vlCDR1
RASQSVSNDVA

SEQ ID NO: 12963 - protein, 7 aa, Artificial Sequence
  Description of Artificial Sequence: Synthetic peptide
  XENP018225 vlCDR2
YASHRYT

SEQ ID NO: 12964 - protein, 9 aa, Artificial Sequence
  Description of Artificial Sequence: Synthetic peptide
  XENP018225 vlCDR3
QQDYSSPRT

SEQ ID NO: 12965 - protein, 451 aa, Artificial Sequence
  Description of Artificial Sequence: Synthetic polypeptide
  XENP018226 1G6_H1.125_L1_IgG1_PVA_/S267K Heavy Chain
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12966 - protein, 122 aa, Artificial Sequence; identical to SEQ ID NO: 7476
  Description of Artificial Sequence: Synthetic polypeptide
  VH of XENP018226

SEQ ID NO: 12967 - protein, 5 aa, Artificial Sequence
  Description of Artificial Sequence: Synthetic peptide
  XENP018226 vhCDR1
NYWMN

SEQ ID NO: 12968 - protein, 19 aa, Artificial Sequence
  Description of Artificial Sequence: Synthetic peptide
  XENP018226 vhCDR2
EIRLKSNNQATHYAEPVKG

SEQ ID NO: 12969 - protein, 11 aa, Artificial Sequence
  Description of Artificial Sequence: Synthetic peptide
  XENP018226 vhCDR3
YYGNYGGYFDV

SEQ ID NO: 12970 - protein, 214 aa, Artificial Sequence; identical to SEQ ID NO: 11550
  Description of Artificial Sequence: Synthetic polypeptide
  XENP018226 1G6_H1.125_L1_IgG1_PVA_/S267K Light Chain

SEQ ID NO: 12971 - protein, 107 aa, Artificial Sequence; identical to SEQ ID NO: 6247
  Description of Artificial Sequence: Synthetic polypeptide
  VL of XENP018226

SEQ ID NO: 12972 - protein, 11 aa, Artificial Sequence
  Description of Artificial Sequence: Synthetic peptide
  XENP018226 vlCDR1
RASQSVSNDVA

SEQ ID NO: 12973 - protein, 7 aa, Artificial Sequence
  Description of Artificial Sequence: Synthetic peptide
  XENP018226 vlCDR2
YASHRYT

SEQ ID NO: 12974 - protein, 9 aa, Artificial Sequence
  Description of Artificial Sequence: Synthetic peptide
  XENP018226 vlCDR3
QQDYSSPRT

SEQ ID NO: 12975 - protein, 451 aa, Artificial Sequence
  Description of Artificial Sequence: Synthetic polypeptide
  XENP018227 1G6_H1.126_L1_IgG1_PVA_/S267K Heavy Chain
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12976 - protein, 122 aa, Artificial Sequence; identical to SEQ ID NO: 7485
  Description of Artificial Sequence: Synthetic polypeptide
  VH of XENP018227

SEQ ID NO: 12977 - protein, 5 aa, Artificial Sequence
  Description of Artificial Sequence: Synthetic peptide
  XENP018227 vhCDR1
NYWMN

SEQ ID NO: 12978 - protein, 19 aa, Artificial Sequence
  Description of Artificial Sequence: Synthetic peptide
  XENP018227 vhCDR2
EIRLKSNNDATHYAEPVKG

SEQ ID NO: 12979 - protein, 11 aa, Artificial Sequence
  Description of Artificial Sequence: Synthetic peptide
  XENP018227 vhCDR3
YYGNYGGYFDV

SEQ ID NO: 12980 - protein, 214 aa, Artificial Sequence; identical to SEQ ID NO: 11550
  Description of Artificial Sequence: Synthetic polypeptide
  XENP018227 1G6_H1.126_L1_IgG1_PVA_/S267K Light Chain

SEQ ID NO: 12981 - protein, 107 aa, Artificial Sequence; identical to SEQ ID NO: 6247
  Description of Artificial Sequence: Synthetic polypeptide
  VL of XENP018227

SEQ ID NO: 12982 - protein, 11 aa, Artificial Sequence
  Description of Artificial Sequence: Synthetic peptide
  XENP018227 vlCDR1
RASQSVSNDVA

SEQ ID NO: 12983 - protein, 7 aa, Artificial Sequence
  Description of Artificial Sequence: Synthetic peptide
  XENP018227 vlCDR2
YASHRYT

SEQ ID NO: 12984 - protein, 9 aa, Artificial Sequence
  Description of Artificial Sequence: Synthetic peptide
  XENP018227 vlCDR3
QQDYSSPRT

SEQ ID NO: 12985 - protein, 451 aa, Artificial Sequence
  Description of Artificial Sequence: Synthetic polypeptide
  XENP018228 1G6_H1.127_L1_IgG1_PVA_/S267K Heavy Chain
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12986 - protein, 122 aa, Artificial Sequence; identical to SEQ ID NO: 7494
  Description of Artificial Sequence: Synthetic polypeptide
  VH of XENP018228

SEQ ID NO: 12987 - protein, 5 aa, Artificial Sequence
  Description of Artificial Sequence: Synthetic peptide
  XENP018228 vhCDR1
NYWMN

SEQ ID NO: 12988 - protein, 19 aa, Artificial Sequence
  Description of Artificial Sequence: Synthetic peptide
  XENP018228 vhCDR2
EIRLKSNNKATHYAEPVKG

SEQ ID NO: 12989 - protein, 11 aa, Artificial Sequence
  Description of Artificial Sequence: Synthetic peptide
  XENP018228 vhCDR3
YYGNYGGYFDV

SEQ ID NO: 12990 - protein, 214 aa, Artificial Sequence; identical to SEQ ID NO: 11550
  Description of Artificial Sequence: Synthetic polypeptide
  XENP018228 1G6_H1.127_L1_IgG1_PVA_/S267K Light Chain

SEQ ID NO: 12991 - protein, 107 aa, Artificial Sequence; identical to SEQ ID NO: 6247
  Description of Artificial Sequence: Synthetic polypeptide
  VL of XENP018228

SEQ ID NO: 12992 - protein, 11 aa, Artificial Sequence
  Description of Artificial Sequence: Synthetic peptide
  XENP018228 vlCDR1
RASQSVSNDVA

SEQ ID NO: 12993 - protein, 7 aa, Artificial Sequence
  Description of Artificial Sequence: Synthetic peptide
  XENP018228 vlCDR2
YASHRYT

SEQ ID NO: 12994 - protein, 9 aa, Artificial Sequence
  Description of Artificial Sequence: Synthetic peptide
  XENP018228 vlCDR3
QQDYSSPRT

SEQ ID NO: 12995 - protein, 451 aa, Artificial Sequence
  Description of Artificial Sequence: Synthetic polypeptide
  XENP018229 1G6_H1.128_L1_IgG1_PVA_/S267K Heavy Chain
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12996 - protein, 122 aa, Artificial Sequence; identical to SEQ ID NO: 7503
  Description of Artificial Sequence: Synthetic polypeptide
  VH of XENP018229

SEQ ID NO: 12997 - protein, 5 aa, Artificial Sequence
  Description of Artificial Sequence: Synthetic peptide
  XENP018229 vhCDR1
NYWMN

SEQ ID NO: 12998 - protein, 19 aa, Artificial Sequence
  Description of Artificial Sequence: Synthetic peptide
  XENP018229 vhCDR2
EIRLKSNNYGTHYAEPVKG

SEQ ID NO: 12999 - protein, 11 aa, Artificial Sequence
  Description of Artificial Sequence: Synthetic peptide
  XENP018229 vhCDR3
YYGNYGGYFDV

SEQ ID NO: 13000 - protein, 214 aa, Artificial Sequence; identical to SEQ ID NO: 11550
  Description of Artificial Sequence: Synthetic polypeptide
  XENP018229 1G6_H1.128_L1_IgG1_PVA_/S267K Light Chain

SEQ ID NO: 13001 - protein, 107 aa, Artificial Sequence; identical to SEQ ID NO: 6247
  Description of Artificial Sequence: Synthetic polypeptide
  VL of XENP018229

SEQ ID NO: 13002 - protein, 11 aa, Artificial Sequence
  Description of Artificial Sequence: Synthetic peptide
  XENP018229 vlCDR1
RASQSVSNDVA

SEQ ID NO: 13003 - protein, 7 aa, Artificial Sequence
  Description of Artificial Sequence: Synthetic peptide
  XENP018229 vlCDR2
YASHRYT

SEQ ID NO: 13004 - protein, 9 aa, Artificial Sequence
  Description of Artificial Sequence: Synthetic peptide
  XENP018229 vlCDR3
QQDYSSPRT

SEQ ID NO: 13005 - protein, 451 aa, Artificial Sequence
  Description of Artificial Sequence: Synthetic polypeptide
  XENP018230 1G6_H1.129_L1_IgG1_PVA_/S267K Heavy Chain
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13006 - protein, 122 aa, Artificial Sequence; identical to SEQ ID NO: 7512
  Description of Artificial Sequence: Synthetic polypeptide
  VH of XENP018230

SEQ ID NO: 13007 - protein, 5 aa, Artificial Sequence
  Description of Artificial Sequence: Synthetic peptide
  XENP018230 vhCDR1
NYWMN

SEQ ID NO: 13008 - protein, 19 aa, Artificial Sequence
  Description of Artificial Sequence: Synthetic peptide
  XENP018230 vhCDR2
EIRLKSNNYHTHYAEPVKG

SEQ ID NO: 13009 - protein, 11 aa, Artificial Sequence
  Description of Artificial Sequence: Synthetic peptide
  XENP018230 vhCDR3
YYGNYGGYFDV

SEQ ID NO: 13010 - protein, 214 aa, Artificial Sequence; identical to SEQ ID NO: 11550
  Description of Artificial Sequence: Synthetic polypeptide
  XENP018230 1G6_H1.129_L1_IgG1_PVA_/S267K Light Chain

SEQ ID NO: 13011 - protein, 107 aa, Artificial Sequence; identical to SEQ ID NO: 6247
  Description of Artificial Sequence: Synthetic polypeptide
  VL of XENP018230

SEQ ID NO: 13012 - protein, 11 aa, Artificial Sequence
  Description of Artificial Sequence: Synthetic peptide
  XENP018230 vlCDR1
RASQSVSNDVA

SEQ ID NO: 13013 - protein, 7 aa, Artificial Sequence
  Description of Artificial Sequence: Synthetic peptide
  XENP018230 vlCDR2
YASHRYT

SEQ ID NO: 13014 - protein, 9 aa, Artificial Sequence
  Description of Artificial Sequence: Synthetic peptide
  XENP018230 vlCDR3
QQDYSSPRT

SEQ ID NO: 13015 - protein, 451 aa, Artificial Sequence
  Description of Artificial Sequence: Synthetic polypeptide
  XENP018231 1G6_H1.130_L1_IgG1_PVA_/S267K Heavy Chain
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13016 - protein, 122 aa, Artificial Sequence; identical to SEQ ID NO: 7521
  Description of Artificial Sequence: Synthetic polypeptide
  VH of XENP018231

SEQ ID NO: 13017 - protein, 5 aa, Artificial Sequence
  Description of Artificial Sequence: Synthetic peptide
  XENP018231 vhCDR1
NYWMN

SEQ ID NO: 13018 - protein, 19 aa, Artificial Sequence
  Description of Artificial Sequence: Synthetic peptide
  XENP018231 vhCDR2
EIRLKSNNYQTHYAEPVKG

SEQ ID NO: 13019 - protein, 11 aa, Artificial Sequence
  Description of Artificial Sequence: Synthetic peptide
  XENP018231 vhCDR3
YYGNYGGYFDV

SEQ ID NO: 13020 - protein, 214 aa, Artificial Sequence; identical to SEQ ID NO: 11550
  Description of Artificial Sequence: Synthetic polypeptide
  XENP018231 1G6_H1.130_L1_IgG1_PVA_/S267K Light Chain

SEQ ID NO: 13021 - protein, 107 aa, Artificial Sequence; identical to SEQ ID NO: 6247
  Description of Artificial Sequence: Synthetic polypeptide
  VL of XENP018231

SEQ ID NO: 13022 - protein, 11 aa, Artificial Sequence
  Description of Artificial Sequence: Synthetic peptide
  XENP018231 vlCDR1
RASQSVSNDVA

SEQ ID NO: 13023 - protein, 7 aa, Artificial Sequence
  Description of Artificial Sequence: Synthetic peptide
  XENP018231 vlCDR2
YASHRYT

SEQ ID NO: 13024 - protein, 9 aa, Artificial Sequence
  Description of Artificial Sequence: Synthetic peptide
  XENP018231 vlCDR3
QQDYSSPRT

SEQ ID NO: 13025 - protein, 451 aa, Artificial Sequence
  Description of Artificial Sequence: Synthetic polypeptide
  XENP018232 1G6_H1.131_L1_IgG1_PVA_/S267K Heavy Chain
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13026 - protein, 122 aa, Artificial Sequence; identical to SEQ ID NO: 7530
  Description of Artificial Sequence: Synthetic polypeptide
  VH of XENP018232

SEQ ID NO: 13027 - protein, 5 aa, Artificial Sequence
  Description of Artificial Sequence: Synthetic peptide
  XENP018232 vhCDR1
NYWMN

SEQ ID NO: 13028 - protein, 19 aa, Artificial Sequence
  Description of Artificial Sequence: Synthetic peptide
  XENP018232 vhCDR2
EIRLKSNNYDTHYAEPVKG

SEQ ID NO: 13029 - protein, 11 aa, Artificial Sequence
  Description of Artificial Sequence: Synthetic peptide
  XENP018232 vhCDR3
YYGNYGGYFDV

SEQ ID NO: 13030 - protein, 214 aa, Artificial Sequence; identical to SEQ ID NO: 11550
  Description of Artificial Sequence: Synthetic polypeptide
  XENP018232 1G6_H1.131_L1_IgG1_PVA_/S267K Light Chain

SEQ ID NO: 13031 - protein, 107 aa, Artificial Sequence; identical to SEQ ID NO: 6247
  Description of Artificial Sequence: Synthetic polypeptide
  VL of XENP018232

SEQ ID NO: 13032 - protein, 11 aa, Artificial Sequence
  Description of Artificial Sequence: Synthetic peptide
  XENP018232 vlCDR1
RASQSVSNDVA

SEQ ID NO: 13033 - protein, 7 aa, Artificial Sequence
  Description of Artificial Sequence: Synthetic peptide
  XENP018232 vlCDR2
YASHRYT

SEQ ID NO: 13034 - protein, 9 aa, Artificial Sequence
  Description of Artificial Sequence: Synthetic peptide
  XENP018232 vlCDR3
QQDYSSPRT

SEQ ID NO: 13035 - protein, 451 aa, Artificial Sequence
  Description of Artificial Sequence: Synthetic polypeptide
  XENP018233 1G6_H1.132_L1_IgG1_PVA_/S267K Heavy Chain
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13036 - protein, 122 aa, Artificial Sequence; identical to SEQ ID NO: 7539
  Description of Artificial Sequence: Synthetic polypeptide
  VH of XENP018233

SEQ ID NO: 13037 - protein, 5 aa, Artificial Sequence
  Description of Artificial Sequence: Synthetic peptide
  XENP018233 vhCDR1
NYWMN

SEQ ID NO: 13038 - protein, 19 aa, Artificial Sequence
  Description of Artificial Sequence: Synthetic peptide
  XENP018233 vhCDR2
EIRLKSNNYLTHYAEPVKG

SEQ ID NO: 13039 - protein, 11 aa, Artificial Sequence
  Description of Artificial Sequence: Synthetic peptide
  XENP018233 vhCDR3
YYGNYGGYFDV

SEQ ID NO: 13040 - protein, 214 aa, Artificial Sequence; identical to SEQ ID NO: 11550
  Description of Artificial Sequence: Synthetic polypeptide
  XENP018233 1G6_H1.132_L1_IgG1_PVA_/S267K Light Chain

SEQ ID NO: 13041 - protein, 107 aa, Artificial Sequence; identical to SEQ ID NO: 6247
  Description of Artificial Sequence: Synthetic polypeptide
  VL of XENP018233

SEQ ID NO: 13042 - protein, 11 aa, Artificial Sequence
  Description of Artificial Sequence: Synthetic peptide
  XENP018233 vlCDR1
RASQSVSNDVA

SEQ ID NO: 13043 - protein, 7 aa, Artificial Sequence
  Description of Artificial Sequence: Synthetic peptide
  XENP018233 vlCDR2
YASHRYT

SEQ ID NO: 13044 - protein, 9 aa, Artificial Sequence
  Description of Artificial Sequence: Synthetic peptide
  XENP018233 vlCDR3
QQDYSSPRT

SEQ ID NO: 13045 - protein, 451 aa, Artificial Sequence
  Description of Artificial Sequence: Synthetic polypeptide
  XENP018234 1G6_H1.133_L1_IgG1_PVA_/S267K Heavy Chain
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13046 - protein, 122 aa, Artificial Sequence; identical to SEQ ID NO: 7548
  Description of Artificial Sequence: Synthetic polypeptide
  VH of XENP018234

SEQ ID NO: 13047 - protein, 5 aa, Artificial Sequence
  Description of Artificial Sequence: Synthetic peptide
  XENP018234 vhCDR1
NYWMN

SEQ ID NO: 13048 - protein, 19 aa, Artificial Sequence
  Description of Artificial Sequence: Synthetic peptide
  XENP018234 vhCDR2
EIRLKSNNYKTHYAEPVKG

SEQ ID NO: 13049 - protein, 11 aa, Artificial Sequence
  Description of Artificial Sequence: Synthetic peptide
  XENP018234 vhCDR3
YYGNYGGYFDV

SEQ ID NO: 13050 - protein, 214 aa, Artificial Sequence; identical to SEQ ID NO: 11550
  Description of Artificial Sequence: Synthetic polypeptide
  XENP018234 1G6_H1.133_L1_IgG1_PVA_/S267K Light Chain

SEQ ID NO: 13051 - protein, 107 aa, Artificial Sequence; identical to SEQ ID NO: 6247
  Description of Artificial Sequence: Synthetic polypeptide
  VL of XENP018234

SEQ ID NO: 13052 - protein, 11 aa, Artificial Sequence
  Description of Artificial Sequence: Synthetic peptide
  XENP018234 vlCDR1
RASQSVSNDVA

SEQ ID NO: 13053 - protein, 7 aa, Artificial Sequence
  Description of Artificial Sequence: Synthetic peptide
  XENP018234 vlCDR2
YASHRYT

SEQ ID NO: 13054 - protein, 9 aa, Artificial Sequence
  Description of Artificial Sequence: Synthetic peptide
  XENP018234 vlCDR3
QQDYSSPRT

SEQ ID NO: 13055 - protein, 451 aa, Artificial Sequence
  Description of Artificial Sequence: Synthetic polypeptide
  XENP018235 1G6_H1.134_L1_IgG1_PVA_/S267K Heavy Chain
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13056 - protein, 122 aa, Artificial Sequence; identical to SEQ ID NO: 7557
  Description of Artificial Sequence: Synthetic polypeptide
  VH of XENP018235

SEQ ID NO: 13057 - protein, 5 aa, Artificial Sequence
  Description of Artificial Sequence: Synthetic peptide
  XENP018235 vhCDR1
NYWMN

SEQ ID NO: 13058 - protein, 19 aa, Artificial Sequence
  Description of Artificial Sequence: Synthetic peptide
  XENP018235 vhCDR2
EIRLKSNNYYTHYAEPVKG

SEQ ID NO: 13059 - protein, 11 aa, Artificial Sequence
  Description of Artificial Sequence: Synthetic peptide
  XENP018235 vhCDR3
YYGNYGGYFDV

SEQ ID NO: 13060 - protein, 214 aa, Artificial Sequence; identical to SEQ ID NO: 11550
  Description of Artificial Sequence: Synthetic polypeptide
  XENP018235 1G6_H1.134_L1_IgG1_PVA_/S267K Light Chain

SEQ ID NO: 13061 - protein, 107 aa, Artificial Sequence; identical to SEQ ID NO: 6247
  Description of Artificial Sequence: Synthetic polypeptide
  VL of XENP018235

SEQ ID NO: 13062 - protein, 11 aa, Artificial Sequence
  Description of Artificial Sequence: Synthetic peptide
  XENP018235 vlCDR1
RASQSVSNDVA

SEQ ID NO: 13063 - protein, 7 aa, Artificial Sequence
  Description of Artificial Sequence: Synthetic peptide
  XENP018235 vlCDR2
YASHRYT

SEQ ID NO: 13064 - protein, 9 aa, Artificial Sequence
  Description of Artificial Sequence: Synthetic peptide
  XENP018235 vlCDR3
QQDYSSPRT

SEQ ID NO: 13065 - protein, 451 aa, Artificial Sequence
  Description of Artificial Sequence: Synthetic polypeptide
  XENP018236 1G6_H1.135_L1_IgG1_PVA_/S267K Heavy Chain
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13066 - protein, 122 aa, Artificial Sequence; identical to SEQ ID NO: 7566
  Description of Artificial Sequence: Synthetic polypeptide
  VH of XENP018236

SEQ ID NO: 13067 - protein, 5 aa, Artificial Sequence
  Description of Artificial Sequence: Synthetic peptide
  XENP018236 vhCDR1
NYWMN

SEQ ID NO: 13068 - protein, 19 aa, Artificial Sequence
  Description of Artificial Sequence: Synthetic peptide
  XENP018236 vhCDR2
EIRLKSNNYAKHYAEPVKG

SEQ ID NO: 13069 - protein, 11 aa, Artificial Sequence
  Description of Artificial Sequence: Synthetic peptide
  XENP018236 vhCDR3
YYGNYGGYFDV

SEQ ID NO: 13070 - protein, 214 aa, Artificial Sequence; identical to SEQ ID NO: 11550
  Description of Artificial Sequence: Synthetic polypeptide
  XENP018236 1G6_H1.135_L1_IgG1_PVA_/S267K Light Chain

SEQ ID NO: 13071 - protein, 107 aa, Artificial Sequence; identical to SEQ ID NO: 6247
  Description of Artificial Sequence: Synthetic polypeptide
  VL of XENP018236

SEQ ID NO: 13072 - protein, 11 aa, Artificial Sequence
  Description of Artificial Sequence: Synthetic peptide
  XENP018236 vlCDR1
RASQSVSNDVA

SEQ ID NO: 13073 - protein, 7 aa, Artificial Sequence
  Description of Artificial Sequence: Synthetic peptide
  XENP018236 vlCDR2
YASHRYT

SEQ ID NO: 13074 - protein, 9 aa, Artificial Sequence
  Description of Artificial Sequence: Synthetic peptide
  XENP018236 vlCDR3
QQDYSSPRT

SEQ ID NO: 13075 - protein, 451 aa, Artificial Sequence
  Description of Artificial Sequence: Synthetic polypeptide
  XENP018237 1G6_H1.136_L1_IgG1_PVA_/S267K Heavy Chain
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13076 - protein, 122 aa, Artificial Sequence; identical to SEQ ID NO: 7575
  Description of Artificial Sequence: Synthetic polypeptide
  VH of XENP018237

SEQ ID NO: 13077 - protein, 5 aa, Artificial Sequence
  Description of Artificial Sequence: Synthetic peptide
  XENP018237 vhCDR1
NYWMN

SEQ ID NO: 13078 - protein, 19 aa, Artificial Sequence
  Description of Artificial Sequence: Synthetic peptide
  XENP018237 vhCDR2
EIRLKSNNYAIHYAEPVKG

SEQ ID NO: 13079 - protein, 11 aa, Artificial Sequence
  Description of Artificial Sequence: Synthetic peptide
  XENP018237 vhCDR3
YYGNYGGYFDV

SEQ ID NO: 13080 - protein, 214 aa, Artificial Sequence; identical to SEQ ID NO: 11550
  Description of Artificial Sequence: Synthetic polypeptide
  XENP018237 1G6_H1.136_L1_IgG1_PVA_/S267K Light Chain

SEQ ID NO: 13081 - protein, 107 aa, Artificial Sequence; identical to SEQ ID NO: 6247
  Description of Artificial Sequence: Synthetic polypeptide
  VL of XENP018237

SEQ ID NO: 13082 - protein, 11 aa, Artificial Sequence
  Description of Artificial Sequence: Synthetic peptide
  XENP018237 vlCDR1
RASQSVSNDVA

SEQ ID NO: 13083 - protein, 7 aa, Artificial Sequence
  Description of Artificial Sequence: Synthetic peptide
  XENP018237 vlCDR2
YASHRYT

SEQ ID NO: 13084 - protein, 9 aa, Artificial Sequence
  Description of Artificial Sequence: Synthetic peptide
  XENP018237 vlCDR3
QQDYSSPRT

SEQ ID NO: 13085 - protein, 451 aa, Artificial Sequence
  Description of Artificial Sequence: Synthetic polypeptide
  XENP018238 1G6_H1.137_L1_IgG1_PVA_/S267K Heavy Chain
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13086 - protein, 122 aa, Artificial Sequence; identical to SEQ ID NO: 7584
  Description of Artificial Sequence: Synthetic polypeptide
  VH of XENP018238

SEQ ID NO: 13087 - protein, 5 aa, Artificial Sequence
  Description of Artificial Sequence: Synthetic peptide
  XENP018238 vhCDR1
NYWMN

SEQ ID NO: 13088 - protein, 19 aa, Artificial Sequence
  Description of Artificial Sequence: Synthetic peptide
  XENP018238 vhCDR2
EIRLKSNNYATYYAEPVKG

SEQ ID NO: 13089 - protein, 11 aa, Artificial Sequence
  Description of Artificial Sequence: Synthetic peptide
  XENP018238 vhCDR3
YYGNYGGYFDV

SEQ ID NO: 13090 - protein, 214 aa, Artificial Sequence; identical to SEQ ID NO: 11550
  Description of Artificial Sequence: Synthetic polypeptide
  XENP018238 1G6_H1.137_L1_IgG1_PVA_/S267K Light Chain

SEQ ID NO: 13091 - protein, 107 aa, Artificial Sequence; identical to SEQ ID NO: 6247
  Description of Artificial Sequence: Synthetic polypeptide
  VL of XENP018238

SEQ ID NO: 13092 - protein, 11 aa, Artificial Sequence
  Description of Artificial Sequence: Synthetic peptide
  XENP018238 vlCDR1
RASQSVSNDVA

SEQ ID NO: 13093 - protein, 7 aa, Artificial Sequence
  Description of Artificial Sequence: Synthetic peptide
  XENP018238 vlCDR2
YASHRYT

SEQ ID NO: 13094 - protein, 9 aa, Artificial Sequence
  Description of Artificial Sequence: Synthetic peptide
  XENP018238 vlCDR3
QQDYSSPRT

SEQ ID NO: 13095 - protein, 451 aa, Artificial Sequence
  Description of Artificial Sequence: Synthetic polypeptide
  XENP018239 1G6_H1.138_L1_IgG1_PVA_/S267K Heavy Chain
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13096 - protein, 122 aa, Artificial Sequence; identical to SEQ ID NO: 7593
  Description of Artificial Sequence: Synthetic polypeptide
  VH of XENP018239

SEQ ID NO: 13097 - protein, 5 aa, Artificial Sequence
  Description of Artificial Sequence: Synthetic peptide
  XENP018239 vhCDR1
NYWMN

SEQ ID NO: 13098 - protein, 19 aa, Artificial Sequence
  Description of Artificial Sequence: Synthetic peptide
  XENP018239 vhCDR2
EIRLKSNNYATQYAEPVKG

SEQ ID NO: 13099 - protein, 11 aa, Artificial Sequence
  Description of Artificial Sequence: Synthetic peptide
  XENP018239 vhCDR3
YYGNYGGYFDV

SEQ ID NO: 13100 - protein, 214 aa, Artificial Sequence; identical to SEQ ID NO: 11550
  Description of Artificial Sequence: Synthetic polypeptide
  XENP018239 1G6_H1.138_L1_IgG1_PVA_/S267K Light Chain

SEQ ID NO: 13101 - protein, 107 aa, Artificial Sequence; identical to SEQ ID NO: 6247
  Description of Artificial Sequence: Synthetic polypeptide
  VL of XENP018239

SEQ ID NO: 13102 - protein, 11 aa, Artificial Sequence
  Description of Artificial Sequence: Synthetic peptide
  XENP018239 vlCDR1
RASQSVSNDVA

SEQ ID NO: 13103 - protein, 7 aa, Artificial Sequence
  Description of Artificial Sequence: Synthetic peptide
  XENP018239 vlCDR2
YASHRYT

SEQ ID NO: 13104 - protein, 9 aa, Artificial Sequence
  Description of Artificial Sequence: Synthetic peptide
  XENP018239 vlCDR3
QQDYSSPRT

SEQ ID NO: 13105 - protein, 451 aa, Artificial Sequence
  Description of Artificial Sequence: Synthetic polypeptide
  XENP018240 1G6_H1.139_L1_IgG1_PVA_/S267K Heavy Chain
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13106 - protein, 122 aa, Artificial Sequence; identical to SEQ ID NO: 7602
  Description of Artificial Sequence: Synthetic polypeptide
  VH of XENP018240

SEQ ID NO: 13107 - protein, 5 aa, Artificial Sequence
  Description of Artificial Sequence: Synthetic peptide
  XENP018240 vhCDR1
NYWMN

SEQ ID NO: 13108 - protein, 19 aa, Artificial Sequence
  Description of Artificial Sequence: Synthetic peptide
  XENP018240 vhCDR2
EIRLKSNNYATDYAEPVKG

SEQ ID NO: 13109 - protein, 11 aa, Artificial Sequence
  Description of Artificial Sequence: Synthetic peptide
  XENP018240 vhCDR3
YYGNYGGYFDV

SEQ ID NO: 13110 - protein, 214 aa, Artificial Sequence; identical to SEQ ID NO: 11550
  Description of Artificial Sequence: Synthetic polypeptide
  XENP018240 1G6_H1.139_L1_IgG1_PVA_/S267K Light Chain

SEQ ID NO: 13111 - protein, 107 aa, Artificial Sequence; identical to SEQ ID NO: 6247
  Description of Artificial Sequence: Synthetic polypeptide
  VL of XENP018240

SEQ ID NO: 13112 - protein, 11 aa, Artificial Sequence
  Description of Artificial Sequence: Synthetic peptide
  XENP018240 vlCDR1
RASQSVSNDVA

SEQ ID NO: 13113 - protein, 7 aa, Artificial Sequence
  Description of Artificial Sequence: Synthetic peptide
  XENP018240 vlCDR2
YASHRYT

SEQ ID NO: 13114 - protein, 9 aa, Artificial Sequence
  Description of Artificial Sequence: Synthetic peptide
  XENP018240 vlCDR3
QQDYSSPRT

SEQ ID NO: 13115 - protein, 451 aa, Artificial Sequence
  Description of Artificial Sequence: Synthetic polypeptide
  XENP018241 1G6_H1.140_L1_IgG1_PVA_/S267K Heavy Chain
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13116 - protein, 122 aa, Artificial Sequence; identical to SEQ ID NO: 7611
  Description of Artificial Sequence: Synthetic polypeptide
  VH of XENP018241

SEQ ID NO: 13117 - protein, 5 aa, Artificial Sequence
  Description of Artificial Sequence: Synthetic peptide
  XENP018241 vhCDR1
NYWMN

SEQ ID NO: 13118 - protein, 19 aa, Artificial Sequence
  Description of Artificial Sequence: Synthetic peptide
  XENP018241 vhCDR2
EIRLKSNNYATFYAEPVKG

SEQ ID NO: 13119 - protein, 11 aa, Artificial Sequence
  Description of Artificial Sequence: Synthetic peptide
  XENP018241 vhCDR3
YYGNYGGYFDV

SEQ ID NO: 13120 - protein, 214 aa, Artificial Sequence; identical to SEQ ID NO: 11550
  Description of Artificial Sequence: Synthetic polypeptide
  XENP018241 1G6_H1.140_L1_IgG1_PVA_/S267K Light Chain

SEQ ID NO: 13121 - protein, 107 aa, Artificial Sequence; identical to SEQ ID NO: 6247
  Description of Artificial Sequence: Synthetic polypeptide
  VL of XENP018241

SEQ ID NO: 13122 - protein, 11 aa, Artificial Sequence
  Description of Artificial Sequence: Synthetic peptide
  XENP018241 vlCDR1
RASQSVSNDVA

SEQ ID NO: 13123 - protein, 7 aa, Artificial Sequence
  Description of Artificial Sequence: Synthetic peptide
  XENP018241 vlCDR2
YASHRYT

SEQ ID NO: 13124 - protein, 9 aa, Artificial Sequence
  Description of Artificial Sequence: Synthetic peptide
  XENP018241 vlCDR3
QQDYSSPRT

SEQ ID NO: 13125 - protein, 451 aa, Artificial Sequence
  Description of Artificial Sequence: Synthetic polypeptide
  XENP018242 1G6_H1.141_L1_IgG1_PVA_/S267K Heavy Chain
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13126 - protein, 122 aa, Artificial Sequence; identical to SEQ ID NO: 7620
  Description of Artificial Sequence: Synthetic polypeptide
  VH of XENP018242

SEQ ID NO: 13127 - protein, 5 aa, Artificial Sequence
  Description of Artificial Sequence: Synthetic peptide
  XENP018242 vhCDR1
NYWMN

SEQ ID NO: 13128 - protein, 19 aa, Artificial Sequence
  Description of Artificial Sequence: Synthetic peptide
  XENP018242 vhCDR2
EIRLKSNNYATAYAEPVKG

SEQ ID NO: 13129 - protein, 11 aa, Artificial Sequence
  Description of Artificial Sequence: Synthetic peptide
  XENP018242 vhCDR3
YYGNYGGYFDV

SEQ ID NO: 13130 - protein, 214 aa, Artificial Sequence; identical to SEQ ID NO: 11550
  Description of Artificial Sequence: Synthetic polypeptide
  XENP018242 1G6_H1.141_L1_IgG1_PVA_/S267K Light Chain

SEQ ID NO: 13131 - protein, 107 aa, Artificial Sequence; identical to SEQ ID NO: 6247
  Description of Artificial Sequence: Synthetic polypeptide
  VL of XENP018242

SEQ ID NO: 13132 - protein, 11 aa, Artificial Sequence
  Description of Artificial Sequence: Synthetic peptide
  XENP018242 vlCDR1
RASQSVSNDVA

SEQ ID NO: 13133 - protein, 7 aa, Artificial Sequence
  Description of Artificial Sequence: Synthetic peptide
  XENP018242 vlCDR2
YASHRYT

SEQ ID NO: 13134 - protein, 9 aa, Artificial Sequence
  Description of Artificial Sequence: Synthetic peptide
  XENP018242 vlCDR3
QQDYSSPRT

SEQ ID NO: 13135 - protein, 451 aa, Artificial Sequence
  Description of Artificial Sequence: Synthetic polypeptide
  XENP018243 1G6_H1.142_L1_IgG1_PVA_/S267K Heavy Chain
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13136 - protein, 122 aa, Artificial Sequence; identical to SEQ ID NO: 7629
  Description of Artificial Sequence: Synthetic polypeptide
  VH of XENP018243

SEQ ID NO: 13137 - protein, 5 aa, Artificial Sequence
  Description of Artificial Sequence: Synthetic peptide
  XENP018243 vhCDR1
NYWMN

SEQ ID NO: 13138 - protein, 19 aa, Artificial Sequence
  Description of Artificial Sequence: Synthetic peptide
  XENP018243 vhCDR2
EIRLKSNNYATTYAEPVKG

SEQ ID NO: 13139 - protein, 11 aa, Artificial Sequence
  Description of Artificial Sequence: Synthetic peptide
  XENP018243 vhCDR3
YYGNYGGYFDV

SEQ ID NO: 13140 - protein, 214 aa, Artificial Sequence; identical to SEQ ID NO: 11550
  Description of Artificial Sequence: Synthetic polypeptide
  XENP018243 1G6_H1.142_L1_IgG1_PVA_/S267K Light Chain

SEQ ID NO: 13141 - protein, 107 aa, Artificial Sequence; identical to SEQ ID NO: 6247
  Description of Artificial Sequence: Synthetic polypeptide
  VL of XENP018243

SEQ ID NO: 13142 - protein, 11 aa, Artificial Sequence
  Description of Artificial Sequence: Synthetic peptide
  XENP018243 vlCDR1
RASQSVSNDVA

SEQ ID NO: 13143 - protein, 7 aa, Artificial Sequence
  Description of Artificial Sequence: Synthetic peptide
  XENP018243 vlCDR2
YASHRYT

SEQ ID NO: 13144 - protein, 9 aa, Artificial Sequence
  Description of Artificial Sequence: Synthetic peptide
  XENP018243 vlCDR3
QQDYSSPRT

SEQ ID NO: 13145 - protein, 451 aa, Artificial Sequence
  Description of Artificial Sequence: Synthetic polypeptide
  XENP018244 1G6_H1.143_L1_IgG1_PVA_/S267K Heavy Chain
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13146 - protein, 122 aa, Artificial Sequence; identical to SEQ ID NO: 7638
  Description of Artificial Sequence: Synthetic polypeptide
  VH of XENP018244

SEQ ID NO: 13147 - protein, 5 aa, Artificial Sequence
  Description of Artificial Sequence: Synthetic peptide
  XENP018244 vhCDR1
NYWMN

SEQ ID NO: 13148 - protein, 19 aa, Artificial Sequence
  Description of Artificial Sequence: Synthetic peptide
  XENP018244 vhCDR2
EIRLKSNNYATKYAEPVKG

SEQ ID NO: 13149 - protein, 11 aa, Artificial Sequence
  Description of Artificial Sequence: Synthetic peptide
  XENP018244 vhCDR3
YYGNYGGYFDV

SEQ ID NO: 13150 - protein, 214 aa, Artificial Sequence; identical to SEQ ID NO: 11550
  Description of Artificial Sequence: Synthetic polypeptide
  XENP018244 1G6_H1.143_L1_IgG1_PVA_/S267K Light Chain

SEQ ID NO: 13151 - protein, 107 aa, Artificial Sequence; identical to SEQ ID NO: 6247
  Description of Artificial Sequence: Synthetic polypeptide
  VL of XENP018244

SEQ ID NO: 13152 - protein, 11 aa, Artificial Sequence
  Description of Artificial Sequence: Synthetic peptide
  XENP018244 vlCDR1
RASQSVSNDVA

SEQ ID NO: 13153 - protein, 7 aa, Artificial Sequence
  Description of Artificial Sequence: Synthetic peptide
  XENP018244 vlCDR2
YASHRYT

SEQ ID NO: 13154 - protein, 9 aa, Artificial Sequence
  Description of Artificial Sequence: Synthetic peptide
  XENP018244 vlCDR3
QQDYSSPRT

SEQ ID NO: 13155 - protein, 451 aa, Artificial Sequence
  Description of Artificial Sequence: Synthetic polypeptide
  XENP018245 1G6_H1.144_L1_IgG1_PVA_/S267K Heavy Chain
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13156 - protein, 122 aa, Artificial Sequence; identical to SEQ ID NO: 7647
  Description of Artificial Sequence: Synthetic polypeptide
  VH of XENP018245

SEQ ID NO: 13157 - protein, 5 aa, Artificial Sequence
  Description of Artificial Sequence: Synthetic peptide
  XENP018245 vhCDR1
NYWMN

SEQ ID NO: 13158 - protein, 19 aa, Artificial Sequence
  Description of Artificial Sequence: Synthetic peptide
  XENP018245 vhCDR2
EIRLKSNNYATGYAEPVKG

SEQ ID NO: 13159 - protein, 11 aa, Artificial Sequence
  Description of Artificial Sequence: Synthetic peptide
  XENP018245 vhCDR3
YYGNYGGYFDV

SEQ ID NO: 13160 - protein, 214 aa, Artificial Sequence; identical to SEQ ID NO: 11550
  Description of Artificial Sequence: Synthetic polypeptide
  XENP018245 1G6_H1.144_L1_IgG1_PVA_/S267K Light Chain

SEQ ID NO: 13161 - protein, 107 aa, Artificial Sequence; identical to SEQ ID NO: 6247
  Description of Artificial Sequence: Synthetic polypeptide
  VL of XENP018245

SEQ ID NO: 13162 - protein, 11 aa, Artificial Sequence
  Description of Artificial Sequence: Synthetic peptide
  XENP018245 vlCDR1
RASQSVSNDVA

SEQ ID NO: 13163 - protein, 7 aa, Artificial Sequence
  Description of Artificial Sequence: Synthetic peptide
  XENP018245 vlCDR2
YASHRYT

SEQ ID NO: 13164 - protein, 9 aa, Artificial Sequence
  Description of Artificial Sequence: Synthetic peptide
  XENP018245 vlCDR3
QQDYSSPRT

SEQ ID NO: 13165 - protein, 451 aa, Artificial Sequence
  Description of Artificial Sequence: Synthetic polypeptide
  XENP018246 1G6_H1.145_L1_IgG1_PVA_/S267K Heavy Chain
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13166 - protein, 122 aa, Artificial Sequence; identical to SEQ ID NO: 7656
  Description of Artificial Sequence: Synthetic polypeptide
  VH of XENP018246

SEQ ID NO: 13167 - protein, 5 aa, Artificial Sequence
  Description of Artificial Sequence: Synthetic peptide
  XENP018246 vhCDR1
NYWMN

SEQ ID NO: 13168 - protein, 19 aa, Artificial Sequence
  Description of Artificial Sequence: Synthetic peptide
  XENP018246 vhCDR2
EIRLKSNNYATLYAEPVKG

SEQ ID NO: 13169 - protein, 11 aa, Artificial Sequence
  Description of Artificial Sequence: Synthetic peptide
  XENP018246 vhCDR3
YYGNYGGYFDV

SEQ ID NO: 13170 - protein, 214 aa, Artificial Sequence; identical to SEQ ID NO: 11550
  Description of Artificial Sequence: Synthetic polypeptide
  XENP018246 1G6_H1.145_L1_IgG1_PVA_/S267K Light Chain

SEQ ID NO: 13171 - protein, 107 aa, Artificial Sequence; identical to SEQ ID NO: 6247
  Description of Artificial Sequence: Synthetic polypeptide
  VL of XENP018246

SEQ ID NO: 13172 - protein, 11 aa, Artificial Sequence
  Description of Artificial Sequence: Synthetic peptide
  XENP018246 vlCDR1
RASQSVSNDVA

SEQ ID NO: 13173 - protein, 7 aa, Artificial Sequence
  Description of Artificial Sequence: Synthetic peptide
  XENP018246 vlCDR2
YASHRYT

SEQ ID NO: 13174 - protein, 9 aa, Artificial Sequence
  Description of Artificial Sequence: Synthetic peptide
  XENP018246 vlCDR3
QQDYSSPRT

SEQ ID NO: 13175 - protein, 451 aa, Artificial Sequence
  Description of Artificial Sequence: Synthetic polypeptide
  XENP018247 1G6_H1.146_L1_IgG1_PVA_/S267K Heavy Chain
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13176 - protein, 122 aa, Artificial Sequence; identical to SEQ ID NO: 7665
  Description of Artificial Sequence: Synthetic polypeptide
  VH of XENP018247

SEQ ID NO: 13177 - protein, 5 aa, Artificial Sequence
  Description of Artificial Sequence: Synthetic peptide
  XENP018247 vhCDR1
NYWMN

SEQ ID NO: 13178 - protein, 19 aa, Artificial Sequence
  Description of Artificial Sequence: Synthetic peptide
  XENP018247 vhCDR2
EIRLKSNNYATHYPEPVKG

SEQ ID NO: 13179 - protein, 11 aa, Artificial Sequence
  Description of Artificial Sequence: Synthetic peptide
  XENP018247 vhCDR3
YYGNYGGYFDV

SEQ ID NO: 13180 - protein, 214 aa, Artificial Sequence; identical to SEQ ID NO: 11550
  Description of Artificial Sequence: Synthetic polypeptide
  XENP018247 1G6_H1.146_L1_IgG1_PVA_/S267K Light Chain

SEQ ID NO: 13181 - protein, 107 aa, Artificial Sequence; identical to SEQ ID NO: 6247
  Description of Artificial Sequence: Synthetic polypeptide
  VL of XENP018247

SEQ ID NO: 13182 - protein, 11 aa, Artificial Sequence
  Description of Artificial Sequence: Synthetic peptide
  XENP018247 vlCDR1
RASQSVSNDVA

SEQ ID NO: 13183 - protein, 7 aa, Artificial Sequence
  Description of Artificial Sequence: Synthetic peptide
  XENP018247 vlCDR2
YASHRYT

SEQ ID NO: 13184 - protein, 9 aa, Artificial Sequence
  Description of Artificial Sequence: Synthetic peptide
  XENP018247 vlCDR3
QQDYSSPRT

SEQ ID NO: 13185 - protein, 451 aa, Artificial Sequence
  Description of Artificial Sequence: Synthetic polypeptide
  XENP018248 1G6_H1.147_L1_IgG1_PVA_/S267K Heavy Chain
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13186 - protein, 122 aa, Artificial Sequence; identical to SEQ ID NO: 7674
  Description of Artificial Sequence: Synthetic polypeptide
  VH of XENP018248

SEQ ID NO: 13187 - protein, 5 aa, Artificial Sequence
  Description of Artificial Sequence: Synthetic peptide
  XENP018248 vhCDR1
NYWMN

SEQ ID NO: 13188 - protein, 19 aa, Artificial Sequence
  Description of Artificial Sequence: Synthetic peptide
  XENP018248 vhCDR2
EIRLKSNNYATHYVEPVKG

SEQ ID NO: 13189 - protein, 11 aa, Artificial Sequence
  Description of Artificial Sequence: Synthetic peptide
  XENP018248 vhCDR3
YYGNYGGYFDV

SEQ ID NO: 13190 - protein, 214 aa, Artificial Sequence; identical to SEQ ID NO: 11550
  Description of Artificial Sequence: Synthetic polypeptide
  XENP018248 1G6_H1.147_L1_IgG1_PVA_/S267K Light Chain

SEQ ID NO: 13191 - protein, 107 aa, Artificial Sequence; identical to SEQ ID NO: 6247
  Description of Artificial Sequence: Synthetic polypeptide
  VL of XENP018248

SEQ ID NO: 13192 - protein, 11 aa, Artificial Sequence
  Description of Artificial Sequence: Synthetic peptide
  XENP018248 vlCDR1
RASQSVSNDVA

SEQ ID NO: 13193 - protein, 7 aa, Artificial Sequence
  Description of Artificial Sequence: Synthetic peptide
  XENP018248 vlCDR2
YASHRYT

SEQ ID NO: 13194 - protein, 9 aa, Artificial Sequence
  Description of Artificial Sequence: Synthetic peptide
  XENP018248 vlCDR3
QQDYSSPRT

SEQ ID NO: 13195 - protein, 451 aa, Artificial Sequence
  Description of Artificial Sequence: Synthetic polypeptide
  XENP018249 1G6_H1.148_L1_IgG1_PVA_/S267K Heavy Chain
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13196 - protein, 122 aa, Artificial Sequence; identical to SEQ ID NO: 7683
  Description of Artificial Sequence: Synthetic polypeptide
  VH of XENP018249

SEQ ID NO: 13197 - protein, 5 aa, Artificial Sequence
  Description of Artificial Sequence: Synthetic peptide
  XENP018249 vhCDR1
NYWMN

SEQ ID NO: 13198 - protein, 19 aa, Artificial Sequence
  Description of Artificial Sequence: Synthetic peptide
  XENP018249 vhCDR2
EIRLKSNNYATHYADPVKG

SEQ ID NO: 13199 - protein, 11 aa, Artificial Sequence
  Description of Artificial Sequence: Synthetic peptide
  XENP018249 vhCDR3
YYGNYGGYFDV

SEQ ID NO: 13200 - protein, 214 aa, Artificial Sequence; identical to SEQ ID NO: 11550
  Description of Artificial Sequence: Synthetic polypeptide
  XENP018249 1G6_H1.148_L1_IgG1_PVA_/S267K Light Chain

SEQ ID NO: 13201 - protein, 107 aa, Artificial Sequence; identical to SEQ ID NO: 6247
  Description of Artificial Sequence: Synthetic polypeptide
  VL of XENP018249

SEQ ID NO: 13202 - protein, 11 aa, Artificial Sequence
  Description of Artificial Sequence: Synthetic peptide
  XENP018249 vlCDR1
RASQSVSNDVA

SEQ ID NO: 13203 - protein, 7 aa, Artificial Sequence
  Description of Artificial Sequence: Synthetic peptide
  XENP018249 vlCDR2
YASHRYT

SEQ ID NO: 13204 - protein, 9 aa, Artificial Sequence
  Description of Artificial Sequence: Synthetic peptide
  XENP018249 vlCDR3
QQDYSSPRT

SEQ ID NO: 13205 - protein, 451 aa, Artificial Sequence
  Description of Artificial Sequence: Synthetic polypeptide
  XENP018250 1G6_H1.149_L1_IgG1_PVA_/S267K Heavy Chain
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13206 - protein, 122 aa, Artificial Sequence; identical to SEQ ID NO: 7692
  Description of Artificial Sequence: Synthetic polypeptide
  VH of XENP018250

SEQ ID NO: 13207 - protein, 5 aa, Artificial Sequence
  Description of Artificial Sequence: Synthetic peptide
  XENP018250 vhCDR1
NYWMN

SEQ ID NO: 13208 - protein, 19 aa, Artificial Sequence
  Description of Artificial Sequence: Synthetic peptide
  XENP018250 vhCDR2
EIRLKSNNYATHYAGPVKG

SEQ ID NO: 13209 - protein, 11 aa, Artificial Sequence
  Description of Artificial Sequence: Synthetic peptide
  XENP018250 vhCDR3
YYGNYGGYFDV

SEQ ID NO: 13210 - protein, 214 aa, Artificial Sequence; identical to SEQ ID NO: 11550
  Description of Artificial Sequence: Synthetic polypeptide
  XENP018250 1G6_H1.149_L1_IgG1_PVA_/S267K Light Chain

SEQ ID NO: 13211 - protein, 107 aa, Artificial Sequence; identical to SEQ ID NO: 6247
  Description of Artificial Sequence: Synthetic polypeptide
  VL of XENP018250

SEQ ID NO: 13212 - protein, 11 aa, Artificial Sequence
  Description of Artificial Sequence: Synthetic peptide
  XENP018250 vlCDR1
RASQSVSNDVA

SEQ ID NO: 13213 - protein, 7 aa, Artificial Sequence
  Description of Artificial Sequence: Synthetic peptide
  XENP018250 vlCDR2
YASHRYT

SEQ ID NO: 13214 - protein, 9 aa, Artificial Sequence
  Description of Artificial Sequence: Synthetic peptide
  XENP018250 vlCDR3
QQDYSSPRT

SEQ ID NO: 13215 - protein, 451 aa, Artificial Sequence
  Description of Artificial Sequence: Synthetic polypeptide
  XENP018251 1G6_H1.150_L1_IgG1_PVA_/S267K Heavy Chain
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13216 - protein, 122 aa, Artificial Sequence; identical to SEQ ID NO: 7701
  Description of Artificial Sequence: Synthetic polypeptide
  VH of XENP018251

SEQ ID NO: 13217 - protein, 5 aa, Artificial Sequence
  Description of Artificial Sequence: Synthetic peptide
  XENP018251 vhCDR1
NYWMN

SEQ ID NO: 13218 - protein, 19 aa, Artificial Sequence
  Description of Artificial Sequence: Synthetic peptide
  XENP018251 vhCDR2
EIRLKSNNYATHYAAPVKG

SEQ ID NO: 13219 - protein, 11 aa, Artificial Sequence
  Description of Artificial Sequence: Synthetic peptide
  XENP018251 vhCDR3
YYGNYGGYFDV

SEQ ID NO: 13220 - protein, 214 aa, Artificial Sequence; identical to SEQ ID NO: 11550
  Description of Artificial Sequence: Synthetic polypeptide
  XENP018251 1G6_H1.150_L1_IgG1_PVA_/S267K Light Chain

SEQ ID NO: 13221 - protein, 107 aa, Artificial Sequence; identical to SEQ ID NO: 6247
  Description of Artificial Sequence: Synthetic polypeptide
  VL of XENP018251

SEQ ID NO: 13222 - protein, 11 aa, Artificial Sequence
  Description of Artificial Sequence: Synthetic peptide
  XENP018251 vlCDR1
RASQSVSNDVA

SEQ ID NO: 13223 - protein, 7 aa, Artificial Sequence
  Description of Artificial Sequence: Synthetic peptide
  XENP018251 vlCDR2
YASHRYT

SEQ ID NO: 13224 - protein, 9 aa, Artificial Sequence
  Description of Artificial Sequence: Synthetic peptide
  XENP018251 vlCDR3
QQDYSSPRT

SEQ ID NO: 13225 - protein, 451 aa, Artificial Sequence
  Description of Artificial Sequence: Synthetic polypeptide
  XENP018252 1G6_H1.151_L1_IgG1_PVA_/S267K Heavy Chain
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13226 - protein, 122 aa, Artificial Sequence; identical to SEQ ID NO: 7710
  Description of Artificial Sequence: Synthetic polypeptide
  VH of XENP018252

SEQ ID NO: 13227 - protein, 5 aa, Artificial Sequence
  Description of Artificial Sequence: Synthetic peptide
  XENP018252 vhCDR1
NYWMN

SEQ ID NO: 13228 - protein, 19 aa, Artificial Sequence
  Description of Artificial Sequence: Synthetic peptide
  XENP018252 vhCDR2
EIRLKSNNYATHYAESVKG

SEQ ID NO: 13229 - protein, 11 aa, Artificial Sequence
  Description of Artificial Sequence: Synthetic peptide
  XENP018252 vhCDR3
YYGNYGGYFDV

SEQ ID NO: 13230 - protein, 214 aa, Artificial Sequence; identical to SEQ ID NO: 11550
  Description of Artificial Sequence: Synthetic polypeptide
  XENP018252 1G6_H1.151_L1_IgG1_PVA_/S267K Light Chain

SEQ ID NO: 13231 - protein, 107 aa, Artificial Sequence; identical to SEQ ID NO: 6247
  Description of Artificial Sequence: Synthetic polypeptide
  VL of XENP018252

SEQ ID NO: 13232 - protein, 11 aa, Artificial Sequence
  Description of Artificial Sequence: Synthetic peptide
  XENP018252 vlCDR1
RASQSVSNDVA

SEQ ID NO: 13233 - protein, 7 aa, Artificial Sequence
  Description of Artificial Sequence: Synthetic peptide
  XENP018252 vlCDR2
YASHRYT

SEQ ID NO: 13234 - protein, 9 aa, Artificial Sequence
  Description of Artificial Sequence: Synthetic peptide
  XENP018252 vlCDR3
QQDYSSPRT

SEQ ID NO: 13235 - protein, 451 aa, Artificial Sequence
  Description of Artificial Sequence: Synthetic polypeptide
  XENP018253 1G6_H1.152_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13236 - protein, 122 aa, Artificial Sequence; identical to SEQ ID NO: 7719
  Description of Artificial Sequence: Synthetic polypeptide
  VH of XENP018253

SEQ ID NO: 13237 - protein, 5 aa, Artificial Sequence
  Description of Artificial Sequence: Synthetic peptide
  XENP018253 vhCDR1
NYWMN

SEQ ID NO: 13238 - protein, 19 aa, Artificial Sequence
  Description of Artificial Sequence: Synthetic peptide
  XENP018253 vhCDR2
EIRLKSNNYATHYAEPVKG

SEQ ID NO: 13239 - protein, 11 aa, Artificial Sequence
  Description of Artificial Sequence: Synthetic peptide
  XENP018253 vhCDR3
YYGNYGGYFDV

SEQ ID NO: 13240 - protein, 214 aa, Artificial Sequence; identical to SEQ ID NO: 11550
  Description of Artificial Sequence: Synthetic polypeptide
  XENP018253 1G6_H1.152_L1_IgG1_PVA_/S267K Light Chain

SEQ ID NO: 13241 - protein, 107 aa, Artificial Sequence; identical to SEQ ID NO: 6247
  Description of Artificial Sequence: Synthetic polypeptide
  VL of XENP018253

SEQ ID NO: 13242 - protein, 11 aa, Artificial Sequence
  Description of Artificial Sequence: Synthetic peptide
  XENP018253 vlCDR1
RASQSVSNDVA

SEQ ID NO: 13243 - protein, 7 aa, Artificial Sequence
  Description of Artificial Sequence: Synthetic peptide
  XENP018253 vlCDR2
YASHRYT

SEQ ID NO: 13244 - protein, 9 aa, Artificial Sequence
  Description of Artificial Sequence: Synthetic peptide
  XENP018253 vlCDR3
QQDYSSPRT

SEQ ID NO: 13245 - protein, 451 aa, Artificial Sequence
  Description of Artificial Sequence: Synthetic polypeptide
  XENP018254 1G6_H1.153_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13246 - protein, 122 aa, Artificial Sequence; identical to SEQ ID NO: 7728
  Description of Artificial Sequence: Synthetic polypeptide
  VH of XENP018254

SEQ ID NO: 13247 - protein, 5 aa, Artificial Sequence
  Description of Artificial Sequence: Synthetic peptide
  XENP018254 vhCDR1
NYWMN

SEQ ID NO: 13248 - protein, 19 aa, Artificial Sequence
  Description of Artificial Sequence: Synthetic peptide
  XENP018254 vhCDR2
EIRLKSNNYATHYAEPVKG

SEQ ID NO: 13249 - protein, 11 aa, Artificial Sequence
  Description of Artificial Sequence: Synthetic peptide
  XENP018254 vhCDR3
YYGNYGGYFDV

SEQ ID NO: 13250 - protein, 214 aa, Artificial Sequence; identical to SEQ ID NO: 11550
  Description of Artificial Sequence: Synthetic polypeptide
  XENP018254 1G6_H1.153_L1_IgG1_PVA_/S267K Light Chain

SEQ ID NO: 13251 - protein, 107 aa, Artificial Sequence; identical to SEQ ID NO: 6247
  Description of Artificial Sequence: Synthetic polypeptide
  VL of XENP018254

SEQ ID NO: 13252 - protein, 11 aa, Artificial Sequence
  Description of Artificial Sequence: Synthetic peptide
  XENP018254 vlCDR1
RASQSVSNDVA

SEQ ID NO: 13253 - protein, 7 aa, Artificial Sequence
  Description of Artificial Sequence: Synthetic peptide
  XENP018254 vlCDR2
YASHRYT

SEQ ID NO: 13254 - protein, 9 aa, Artificial Sequence
  Description of Artificial Sequence: Synthetic peptide
  XENP018254 vlCDR3
QQDYSSPRT

SEQ ID NO: 13255 - protein, 451 aa, Artificial Sequence
  Description of Artificial Sequence: Synthetic polypeptide
  XENP018255 1G6_H1.154_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13256 - protein, 122 aa, Artificial Sequence; identical to SEQ ID NO: 7737
  Description of Artificial Sequence: Synthetic polypeptide
  VH of XENP018255

SEQ ID NO: 13257 - protein, 5 aa, Artificial Sequence
  Description of Artificial Sequence: Synthetic peptide
  XENP018255 vhCDR1
NYWMN

SEQ ID NO: 13258 - protein, 19 aa, Artificial Sequence
  Description of Artificial Sequence: Synthetic peptide
  XENP018255 vhCDR2
EIRLKSNNYATHYAEPVKG

SEQ ID NO: 13259 - protein, 11 aa, Artificial Sequence
  Description of Artificial Sequence: Synthetic peptide
  XENP018255 vhCDR3
YYGNYGGYFDV

SEQ ID NO: 13260 - protein, 214 aa, Artificial Sequence; identical to SEQ ID NO: 11550
  Description of Artificial Sequence: Synthetic polypeptide
  XENP018255 1G6_H1.154_L1_IgG1_PVA_/S267K Light Chain

SEQ ID NO: 13261 - protein, 107 aa, Artificial Sequence; identical to SEQ ID NO: 6247
  Description of Artificial Sequence: Synthetic polypeptide
  VL of XENP018255

SEQ ID NO: 13262 - protein, 11 aa, Artificial Sequence
  Description of Artificial Sequence: Synthetic peptide
  XENP018255 vlCDR1
RASQSVSNDVA

SEQ ID NO: 13263 - protein, 7 aa, Artificial Sequence
  Description of Artificial Sequence: Synthetic peptide
  XENP018255 vlCDR2
YASHRYT

SEQ ID NO: 13264 - protein, 9 aa, Artificial Sequence
  Description of Artificial Sequence: Synthetic peptide
  XENP018255 vlCDR3
QQDYSSPRT

SEQ ID NO: 13265 - protein, 451 aa, Artificial Sequence
  Description of Artificial Sequence: Synthetic polypeptide
  XENP018256 1G6_H1.155_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13266 - protein, 122 aa, Artificial Sequence; identical to SEQ ID NO: 7746
  Description of Artificial Sequence: Synthetic polypeptide
  VH of XENP018256

SEQ ID NO: 13267 - protein, 5 aa, Artificial Sequence
  Description of Artificial Sequence: Synthetic peptide
  XENP018256 vhCDR1
NYWMN

SEQ ID NO: 13268 - protein, 19 aa, Artificial Sequence
  Description of Artificial Sequence: Synthetic peptide
  XENP018256 vhCDR2
EIRLKSNNYATHYAEPVKG

SEQ ID NO: 13269 - protein, 11 aa, Artificial Sequence
  Description of Artificial Sequence: Synthetic peptide
  XENP018256 vhCDR3
YYGNYGGYFDV

SEQ ID NO: 13270 - protein, 214 aa, Artificial Sequence; identical to SEQ ID NO: 11550
  Description of Artificial Sequence: Synthetic polypeptide
  XENP018256 1G6_H1.155_L1_IgG1_PVA_/S267K Light Chain

SEQ ID NO: 13271 - protein, 107 aa, Artificial Sequence; identical to SEQ ID NO: 6247
  Description of Artificial Sequence: Synthetic polypeptide
  VL of XENP018256

SEQ ID NO: 13272 - protein, 11 aa, Artificial Sequence
  Description of Artificial Sequence: Synthetic peptide
  XENP018256 vlCDR1
RASQSVSNDVA

SEQ ID NO: 13273 - protein, 7 aa, Artificial Sequence
  Description of Artificial Sequence: Synthetic peptide
  XENP018256 vlCDR2
YASHRYT

SEQ ID NO: 13274 - protein, 9 aa, Artificial Sequence
  Description of Artificial Sequence: Synthetic peptide
  XENP018256 vlCDR3
QQDYSSPRT

SEQ ID NO: 13275 - protein, 451 aa, Artificial Sequence
  Description of Artificial Sequence: Synthetic polypeptide
  XENP018257 1G6_H1.156_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13276 - protein, 122 aa, Artificial Sequence; identical to SEQ ID NO: 7755
  Description of Artificial Sequence: Synthetic polypeptide
  VH of XENP018257

SEQ ID NO: 13277 - protein, 5 aa, Artificial Sequence
  Description of Artificial Sequence: Synthetic peptide
  XENP018257 vhCDR1
NYWMN

SEQ ID NO: 13278 - protein, 19 aa, Artificial Sequence
  Description of Artificial Sequence: Synthetic peptide
  XENP018257 vhCDR2
EIRLKSNNYATHYAEPVKG

SEQ ID NO: 13279 - protein, 11 aa, Artificial Sequence
  Description of Artificial Sequence: Synthetic peptide
  XENP018257 vhCDR3
YYGNYGGYFDV

SEQ ID NO: 13280 - protein, 214 aa, Artificial Sequence; identical to SEQ ID NO: 11550
  Description of Artificial Sequence: Synthetic polypeptide
  XENP018257 1G6_H1.156_L1_IgG1_PVA_/S267K Light Chain

SEQ ID NO: 13281 - protein, 107 aa, Artificial Sequence; identical to SEQ ID NO: 6247
  Description of Artificial Sequence: Synthetic polypeptide
  VL of XENP018257

SEQ ID NO: 13282 - protein, 11 aa, Artificial Sequence
  Description of Artificial Sequence: Synthetic peptide
  XENP018257 vlCDR1
RASQSVSNDVA

SEQ ID NO: 13283 - protein, 7 aa, Artificial Sequence
  Description of Artificial Sequence: Synthetic peptide
  XENP018257 vlCDR2
YASHRYT

SEQ ID NO: 13284 - protein, 9 aa, Artificial Sequence
  Description of Artificial Sequence: Synthetic peptide
  XENP018257 vlCDR3
QQDYSSPRT

SEQ ID NO: 13285 - protein, 451 aa, Artificial Sequence
  Description of Artificial Sequence: Synthetic polypeptide
  XENP018258 1G6_H1.157_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13286 - protein, 122 aa, Artificial Sequence; identical to SEQ ID NO: 7764
  Description of Artificial Sequence: Synthetic polypeptide
  VH of XENP018258

SEQ ID NO: 13287 - protein, 5 aa, Artificial Sequence
  Description of Artificial Sequence: Synthetic peptide
  XENP018258 vhCDR1
NYWMN

SEQ ID NO: 13288 - protein, 19 aa, Artificial Sequence
  Description of Artificial Sequence: Synthetic peptide
  XENP018258 vhCDR2
EIRLKSNNYATHYAEPVKG

SEQ ID NO: 13289 - protein, 11 aa, Artificial Sequence
  Description of Artificial Sequence: Synthetic peptide
  XENP018258 vhCDR3
YYGNYGGYFDV

SEQ ID NO: 13290 - protein, 214 aa, Artificial Sequence; identical to SEQ ID NO: 11550
  Description of Artificial Sequence: Synthetic polypeptide
  XENP018258 1G6_H1.157_L1_IgG1_PVA_/S267K Light Chain

SEQ ID NO: 13291 - protein, 107 aa, Artificial Sequence; identical to SEQ ID NO: 6247
  Description of Artificial Sequence: Synthetic polypeptide
  VL of XENP018258

SEQ ID NO: 13292 - protein, 11 aa, Artificial Sequence
  Description of Artificial Sequence: Synthetic peptide
  XENP018258 vlCDR1
RASQSVSNDVA

SEQ ID NO: 13293 - protein, 7 aa, Artificial Sequence
  Description of Artificial Sequence: Synthetic peptide
  XENP018258 vlCDR2
YASHRYT

SEQ ID NO: 13294 - protein, 9 aa, Artificial Sequence
  Description of Artificial Sequence: Synthetic peptide
  XENP018258 vlCDR3
QQDYSSPRT

SEQ ID NO: 13295 - protein, 451 aa, Artificial Sequence
  Description of Artificial Sequence: Synthetic polypeptide
  XENP018259 1G6_H1.158_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13296 - protein, 122 aa, Artificial Sequence; identical to SEQ ID NO: 7773
  Description of Artificial Sequence: Synthetic polypeptide
  VH of XENP018259

SEQ ID NO: 13297 - protein, 5 aa, Artificial Sequence
  Description of Artificial Sequence: Synthetic peptide
  XENP018259 vhCDR1
NYWMN

SEQ ID NO: 13298 - protein, 19 aa, Artificial Sequence
  Description of Artificial Sequence: Synthetic peptide
  XENP018259 vhCDR2
EIRLKSNNYATHYAEPVKG

SEQ ID NO: 13299 - protein, 11 aa, Artificial Sequence
  Description of Artificial Sequence: Synthetic peptide
  XENP018259 vhCDR3
YYGNYGGYFDV

SEQ ID NO: 13300 - protein, 214 aa, Artificial Sequence; identical to SEQ ID NO: 11550
  Description of Artificial Sequence: Synthetic polypeptide
  XENP018259 1G6_H1.158_L1_IgG1_PVA_/S267K Light Chain

SEQ ID NO: 13301 - protein, 107 aa, Artificial Sequence; identical to SEQ ID NO: 6247
  Description of Artificial Sequence: Synthetic polypeptide
  VL of XENP018259

SEQ ID NO: 13302 - protein, 11 aa, Artificial Sequence
  Description of Artificial Sequence: Synthetic peptide
  XENP018259 vlCDR1
RASQSVSNDVA

SEQ ID NO: 13303 - protein, 7 aa, Artificial Sequence
  Description of Artificial Sequence: Synthetic peptide
  XENP018259 vlCDR2
YASHRYT

SEQ ID NO: 13304 - protein, 9 aa, Artificial Sequence
  Description of Artificial Sequence: Synthetic peptide
  XENP018259 vlCDR3
QQDYSSPRT

SEQ ID NO: 13305 - protein, 451 aa, Artificial Sequence
  Description of Artificial Sequence: Synthetic polypeptide
  XENP018260 1G6_H1.159_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13306 - protein, 122 aa, Artificial Sequence; identical to SEQ ID NO: 7782
  Description of Artificial Sequence: Synthetic polypeptide
  VH of XENP018260

SEQ ID NO: 13307 - protein, 5 aa, Artificial Sequence
  Description of Artificial Sequence: Synthetic peptide
  XENP018260 vhCDR1
NYWMN

SEQ ID NO: 13308 - protein, 19 aa, Artificial Sequence
  Description of Artificial Sequence: Synthetic peptide
  XENP018260 vhCDR2
EIRLKSNNYATHYAEPVKG

SEQ ID NO: 13309 - protein, 11 aa, Artificial Sequence
  Description of Artificial Sequence: Synthetic peptide
  XENP018260 vhCDR3
YYGNYGGYFDV

SEQ ID NO: 13310 - protein, 214 aa, Artificial Sequence; identical to SEQ ID NO: 11550
  Description of Artificial Sequence: Synthetic polypeptide
  XENP018260 1G6_H1.159_L1_IgG1_PVA_/S267K Light Chain

SEQ ID NO: 13311 - protein, 107 aa, Artificial Sequence; identical to SEQ ID NO: 6247
  Description of Artificial Sequence: Synthetic polypeptide
  VL of XENP018260

SEQ ID NO: 13312 - protein, 11 aa, Artificial Sequence
  Description of Artificial Sequence: Synthetic peptide
  XENP018260 vlCDR1
RASQSVSNDVA

SEQ ID NO: 13313 - protein, 7 aa, Artificial Sequence
  Description of Artificial Sequence: Synthetic peptide
  XENP018260 vlCDR2
YASHRYT

SEQ ID NO: 13314 - protein, 9 aa, Artificial Sequence
  Description of Artificial Sequence: Synthetic peptide
  XENP018260 vlCDR3
QQDYSSPRT

SEQ ID NO: 13315 - protein, 451 aa, Artificial Sequence
  Description of Artificial Sequence: Synthetic polypeptide
  XENP018261 1G6_H1.160_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13316 - protein, 122 aa, Artificial Sequence; identical to SEQ ID NO: 7791
  Description of Artificial Sequence: Synthetic polypeptide
  VH of XENP018261

SEQ ID NO: 13317 - protein, 5 aa, Artificial Sequence
  Description of Artificial Sequence: Synthetic peptide
  XENP018261 vhCDR1
NYWMN

SEQ ID NO: 13318 - protein, 19 aa, Artificial Sequence
  Description of Artificial Sequence: Synthetic peptide
  XENP018261 vhCDR2
EIRLKSNNYATHYAEPVKG

SEQ ID NO: 13319 - protein, 11 aa, Artificial Sequence
  Description of Artificial Sequence: Synthetic peptide
  XENP018261 vhCDR3
YYGNYGGYFDV

SEQ ID NO: 13320 - protein, 214 aa, Artificial Sequence; identical to SEQ ID NO: 11550
  Description of Artificial Sequence: Synthetic polypeptide
  XENP018261 1G6_H1.160_L1_IgG1_PVA_/S267K Light Chain

SEQ ID NO: 13321 - protein, 107 aa, Artificial Sequence; identical to SEQ ID NO: 6247
  Description of Artificial Sequence: Synthetic polypeptide
  VL of XENP018261

SEQ ID NO: 13322 - protein, 11 aa, Artificial Sequence
  Description of Artificial Sequence: Synthetic peptide
  XENP018261 vlCDR1
RASQSVSNDVA

SEQ ID NO: 13323 - protein, 7 aa, Artificial Sequence
  Description of Artificial Sequence: Synthetic peptide
  XENP018261 vlCDR2
YASHRYT

SEQ ID NO: 13324 - protein, 9 aa, Artificial Sequence
  Description of Artificial Sequence: Synthetic peptide
  XENP018261 vlCDR3
QQDYSSPRT

SEQ ID NO: 13325 - protein, 451 aa, Artificial Sequence
  Description of Artificial Sequence: Synthetic polypeptide
  XENP018262 1G6_H1.161_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13326 - protein, 122 aa, Artificial Sequence; identical to SEQ ID NO: 7800
  Description of Artificial Sequence: Synthetic polypeptide
  VH of XENP018262

SEQ ID NO: 13327 - protein, 5 aa, Artificial Sequence
  Description of Artificial Sequence: Synthetic peptide
  XENP018262 vhCDR1
NYWMN

SEQ ID NO: 13328 - protein, 19 aa, Artificial Sequence
  Description of Artificial Sequence: Synthetic peptide
  XENP018262 vhCDR2
EIRLKSNNYATHYAEPVKG

SEQ ID NO: 13329 - protein, 11 aa, Artificial Sequence
  Description of Artificial Sequence: Synthetic peptide
  XENP018262 vhCDR3
YYGNYGGYFDV

SEQ ID NO: 13330 - protein, 214 aa, Artificial Sequence; identical to SEQ ID NO: 11550
  Description of Artificial Sequence: Synthetic polypeptide
  XENP018262 1G6_H1.161_L1_IgG1_PVA_/S267K Light Chain

SEQ ID NO: 13331 - protein, 107 aa, Artificial Sequence; identical to SEQ ID NO: 6247
  Description of Artificial Sequence: Synthetic polypeptide
  VL of XENP018262

SEQ ID NO: 13332 - protein, 11 aa, Artificial Sequence
  Description of Artificial Sequence: Synthetic peptide
  XENP018262 vlCDR1
RASQSVSNDVA

SEQ ID NO: 13333 - protein, 7 aa, Artificial Sequence
  Description of Artificial Sequence: Synthetic peptide
  XENP018262 vlCDR2
YASHRYT

SEQ ID NO: 13334 - protein, 9 aa, Artificial Sequence
  Description of Artificial Sequence: Synthetic peptide
  XENP018262 vlCDR3
QQDYSSPRT

SEQ ID NO: 13335 - protein, 451 aa, Artificial Sequence
  Description of Artificial Sequence: Synthetic polypeptide
  XENP018263 1G6_H1.162_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13336 - protein, 122 aa, Artificial Sequence; identical to SEQ ID NO: 7809
  Description of Artificial Sequence: Synthetic polypeptide
  VH of XENP018263

SEQ ID NO: 13337 - protein, 5 aa, Artificial Sequence
  Description of Artificial Sequence: Synthetic peptide
  XENP018263 vhCDR1
NYWMN

SEQ ID NO: 13338 - protein, 19 aa, Artificial Sequence
  Description of Artificial Sequence: Synthetic peptide
  XENP018263 vhCDR2
EIRLKSNNYATHYAEPVKG

SEQ ID NO: 13339 - protein, 11 aa, Artificial Sequence
  Description of Artificial Sequence: Synthetic peptide
  XENP018263 vhCDR3
YYGNYGGYFDV

SEQ ID NO: 13340 - protein, 214 aa, Artificial Sequence; identical to SEQ ID NO: 11550
  Description of Artificial Sequence: Synthetic polypeptide
  XENP018263 1G6_H1.162_L1_IgG1_PVA_/S267K Light Chain

SEQ ID NO: 13341 - protein, 107 aa, Artificial Sequence; identical to SEQ ID NO: 6247
  Description of Artificial Sequence: Synthetic polypeptide
  VL of XENP018263

SEQ ID NO: 13342 - protein, 11 aa, Artificial Sequence
  Description of Artificial Sequence: Synthetic peptide
  XENP018263 vlCDR1
RASQSVSNDVA

SEQ ID NO: 13343 - protein, 7 aa, Artificial Sequence
  Description of Artificial Sequence: Synthetic peptide
  XENP018263 vlCDR2
YASHRYT

SEQ ID NO: 13344 - protein, 9 aa, Artificial Sequence
  Description of Artificial Sequence: Synthetic peptide
  XENP018263 vlCDR3
QQDYSSPRT

SEQ ID NO: 13345 - protein, 451 aa, Artificial Sequence
  Description of Artificial Sequence: Synthetic polypeptide
  XENP018264 1G6_H1.163_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13346 - protein, 122 aa, Artificial Sequence; identical to SEQ ID NO: 7818
  Description of Artificial Sequence: Synthetic polypeptide
  VH of XENP018264

SEQ ID NO: 13347 - protein, 5 aa, Artificial Sequence
  Description of Artificial Sequence: Synthetic peptide
  XENP018264 vhCDR1
NYWMN

SEQ ID NO: 13348 - protein, 19 aa, Artificial Sequence
  Description of Artificial Sequence: Synthetic peptide
  XENP018264 vhCDR2
EIRLKSNNYATHYAEPVKG

SEQ ID NO: 13349 - protein, 11 aa, Artificial Sequence
  Description of Artificial Sequence: Synthetic peptide
  XENP018264 vhCDR3
YYGNYGGYFDV

SEQ ID NO: 13350 - protein, 214 aa, Artificial Sequence; identical to SEQ ID NO: 11550
  Description of Artificial Sequence: Synthetic polypeptide
  XENP018264 1G6_H1.163_L1_IgG1_PVA_/S267K Light Chain

SEQ ID NO: 13351 - protein, 107 aa, Artificial Sequence; identical to SEQ ID NO: 6247
  Description of Artificial Sequence: Synthetic polypeptide
  VL of XENP018264

SEQ ID NO: 13352 - protein, 11 aa, Artificial Sequence
  Description of Artificial Sequence: Synthetic peptide
  XENP018264 vlCDR1
RASQSVSNDVA

SEQ ID NO: 13353 - protein, 7 aa, Artificial Sequence
  Description of Artificial Sequence: Synthetic peptide
  XENP018264 vlCDR2
YASHRYT

SEQ ID NO: 13354 - protein, 9 aa, Artificial Sequence
  Description of Artificial Sequence: Synthetic peptide
  XENP018264 vlCDR3
QQDYSSPRT

SEQ ID NO: 13355 - protein, 451 aa, Artificial Sequence
  Description of Artificial Sequence: Synthetic polypeptide
  XENP018265 1G6_H1.164_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13356 - protein, 122 aa, Artificial Sequence; identical to SEQ ID NO: 7827
  Description of Artificial Sequence: Synthetic polypeptide
  VH of XENP018265

SEQ ID NO: 13357 - protein, 5 aa, Artificial Sequence
  Description of Artificial Sequence: Synthetic peptide
  XENP018265 vhCDR1
NYWMN

SEQ ID NO: 13358 - protein, 19 aa, Artificial Sequence
  Description of Artificial Sequence: Synthetic peptide
  XENP018265 vhCDR2
EIRLKSNNYATHYAEPVKG

SEQ ID NO: 13359 - protein, 11 aa, Artificial Sequence
  Description of Artificial Sequence: Synthetic peptide
  XENP018265 vhCDR3
YYGNYGGYFDV

SEQ ID NO: 13360 - protein, 214 aa, Artificial Sequence; identical to SEQ ID NO: 11550
  Description of Artificial Sequence: Synthetic polypeptide
  XENP018265 1G6_H1.164_L1_IgG1_PVA_/S267K Light Chain

SEQ ID NO: 13361 - protein, 107 aa, Artificial Sequence; identical to SEQ ID NO: 6247
  Description of Artificial Sequence: Synthetic polypeptide
  VL of XENP018265

SEQ ID NO: 13362 - protein, 11 aa, Artificial Sequence
  Description of Artificial Sequence: Synthetic peptide
  XENP018265 vlCDR1
RASQSVSNDVA

SEQ ID NO: 13363 - protein, 7 aa, Artificial Sequence
  Description of Artificial Sequence: Synthetic peptide
  XENP018265 vlCDR2
YASHRYT

SEQ ID NO: 13364 - protein, 9 aa, Artificial Sequence
  Description of Artificial Sequence: Synthetic peptide
  XENP018265 vlCDR3
QQDYSSPRT

SEQ ID NO: 13365 - protein, 451 aa, Artificial Sequence
  Description of Artificial Sequence: Synthetic polypeptide
  XENP018266 1G6_H1.165_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13366 - protein, 122 aa, Artificial Sequence; identical to SEQ ID NO: 7836
  Description of Artificial Sequence: Synthetic polypeptide
  VH of XENP018266

SEQ ID NO: 13367 - protein, 5 aa, Artificial Sequence
  Description of Artificial Sequence: Synthetic peptide
  XENP018266 vhCDR1
NYWMN

SEQ ID NO: 13368 - protein, 19 aa, Artificial Sequence
  Description of Artificial Sequence: Synthetic peptide
  XENP018266 vhCDR2
EIRLKSNNYATHYAEPVKG

SEQ ID NO: 13369 - protein, 11 aa, Artificial Sequence
  Description of Artificial Sequence: Synthetic peptide
  XENP018266 vhCDR3
YYGNYGGYFDV

SEQ ID NO: 13370 - protein, 214 aa, Artificial Sequence; identical to SEQ ID NO: 11550
  Description of Artificial Sequence: Synthetic polypeptide
  XENP018266 1G6_H1.165_L1_IgG1_PVA_/S267K Light Chain

SEQ ID NO: 13371 - protein, 107 aa, Artificial Sequence; identical to SEQ ID NO: 6247
  Description of Artificial Sequence: Synthetic polypeptide
  VL of XENP018266

SEQ ID NO: 13372 - protein, 11 aa, Artificial Sequence
  Description of Artificial Sequence: Synthetic peptide
  XENP018266 vlCDR1
RASQSVSNDVA

SEQ ID NO: 13373 - protein, 7 aa, Artificial Sequence
  Description of Artificial Sequence: Synthetic peptide
  XENP018266 vlCDR2
YASHRYT

SEQ ID NO: 13374 - protein, 9 aa, Artificial Sequence
  Description of Artificial Sequence: Synthetic peptide
  XENP018266 vlCDR3
QQDYSSPRT

SEQ ID NO: 13375 - protein, 451 aa, Artificial Sequence
  Description of Artificial Sequence: Synthetic polypeptide
  XENP018267 1G6_H1.166_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13376 - protein, 122 aa, Artificial Sequence; identical to SEQ ID NO: 7845
  Description of Artificial Sequence: Synthetic polypeptide
  VH of XENP018267

SEQ ID NO: 13377 - protein, 5 aa, Artificial Sequence
  Description of Artificial Sequence: Synthetic peptide
  XENP018267 vhCDR1
NYWMN

SEQ ID NO: 13378 - protein, 19 aa, Artificial Sequence
  Description of Artificial Sequence: Synthetic peptide
  XENP018267 vhCDR2
EIRLKSNNYATHYAEPVKG

SEQ ID NO: 13379 - protein, 11 aa, Artificial Sequence
  Description of Artificial Sequence: Synthetic peptide
  XENP018267 vhCDR3
YYGNYGGYFDV

SEQ ID NO: 13380 - protein, 214 aa, Artificial Sequence; identical to SEQ ID NO: 11550
  Description of Artificial Sequence: Synthetic polypeptide
  XENP018267 1G6_H1.166_L1_IgG1_PVA_/S267K Light Chain

SEQ ID NO: 13381 - protein, 107 aa, Artificial Sequence; identical to SEQ ID NO: 6247
  Description of Artificial Sequence: Synthetic polypeptide
  VL of XENP018267

SEQ ID NO: 13382 - protein, 11 aa, Artificial Sequence
  Description of Artificial Sequence: Synthetic peptide
  XENP018267 vlCDR1
RASQSVSNDVA

SEQ ID NO: 13383 - protein, 7 aa, Artificial Sequence
  Description of Artificial Sequence: Synthetic peptide
  XENP018267 vlCDR2
YASHRYT

SEQ ID NO: 13384 - protein, 9 aa, Artificial Sequence
  Description of Artificial Sequence: Synthetic peptide
  XENP018267 vlCDR3
QQDYSSPRT

SEQ ID NO: 13385 - protein, 451 aa, Artificial Sequence
  Description of Artificial Sequence: Synthetic polypeptide
  XENP018268 1G6_H1.167_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13386 - protein, 122 aa, Artificial Sequence; identical to SEQ ID NO: 7854
  Description of Artificial Sequence: Synthetic polypeptide
  VH of XENP018268

SEQ ID NO: 13387 - protein, 5 aa, Artificial Sequence
  Description of Artificial Sequence: Synthetic peptide
  XENP018268 vhCDR1
NYWMN

SEQ ID NO: 13388 - protein, 19 aa, Artificial Sequence
  Description of Artificial Sequence: Synthetic peptide
  XENP018268 vhCDR2
EIRLKSNNYATHYAEPVKG

SEQ ID NO: 13389 - protein, 11 aa, Artificial Sequence
  Description of Artificial Sequence: Synthetic peptide
  XENP018268 vhCDR3
FYGNYGGYFDV

SEQ ID NO: 13390 - protein, 214 aa, Artificial Sequence; identical to SEQ ID NO: 11550
  Description of Artificial Sequence: Synthetic polypeptide
  XENP018268 1G6_H1.167_L1_IgG1_PVA_/S267K Light Chain

SEQ ID NO: 13391 - protein, 107 aa, Artificial Sequence; identical to SEQ ID NO: 6247
  Description of Artificial Sequence: Synthetic polypeptide
  VL of XENP018268

SEQ ID NO: 13392 - protein, 11 aa, Artificial Sequence
  Description of Artificial Sequence: Synthetic peptide
  XENP018268 vlCDR1
RASQSVSNDVA

SEQ ID NO: 13393 - protein, 7 aa, Artificial Sequence
  Description of Artificial Sequence: Synthetic peptide
  XENP018268 vlCDR2
YASHRYT

SEQ ID NO: 13394 - protein, 9 aa, Artificial Sequence
  Description of Artificial Sequence: Synthetic peptide
  XENP018268 vlCDR3
QQDYSSPRT

SEQ ID NO: 13395 - protein, 451 aa, Artificial Sequence
  Description of Artificial Sequence: Synthetic polypeptide
  XENP018269 1G6_H1.168_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13396 - protein, 122 aa, Artificial Sequence; identical to SEQ ID NO: 7863
  Description of Artificial Sequence: Synthetic polypeptide
  VH of XENP018269

SEQ ID NO: 13397 - protein, 5 aa, Artificial Sequence
  Description of Artificial Sequence: Synthetic peptide
  XENP018269 vhCDR1
NYWMN

SEQ ID NO: 13398 - protein, 19 aa, Artificial Sequence
  Description of Artificial Sequence: Synthetic peptide
  XENP018269 vhCDR2
EIRLKSNNYATHYAEPVKG

SEQ ID NO: 13399 - protein, 11 aa, Artificial Sequence
  Description of Artificial Sequence: Synthetic peptide
  XENP018269 vhCDR3
HYGNYGGYFDV

SEQ ID NO: 13400 - protein, 214 aa, Artificial Sequence; identical to SEQ ID NO: 11550
  Description of Artificial Sequence: Synthetic polypeptide
  XENP018269 1G6_H1.168_L1_IgG1_PVA_/S267K Light Chain

SEQ ID NO: 13401 - protein, 107 aa, Artificial Sequence; identical to SEQ ID NO: 6247
  Description of Artificial Sequence: Synthetic polypeptide
  VL of XENP018269

SEQ ID NO: 13402 - protein, 11 aa, Artificial Sequence
  Description of Artificial Sequence: Synthetic peptide
  XENP018269 vlCDR1
RASQSVSNDVA

SEQ ID NO: 13403 - protein, 7 aa, Artificial Sequence
  Description of Artificial Sequence: Synthetic peptide
  XENP018269 vlCDR2
YASHRYT

SEQ ID NO: 13404 - protein, 9 aa, Artificial Sequence
  Description of Artificial Sequence: Synthetic peptide
  XENP018269 vlCDR3
QQDYSSPRT

SEQ ID NO: 13405 - protein, 451 aa, Artificial Sequence
  Description of Artificial Sequence: Synthetic polypeptide
  XENP018270 1G6_H1.169_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13406 - protein, 122 aa, Artificial Sequence; identical to SEQ ID NO: 7872
  Description of Artificial Sequence: Synthetic polypeptide
  VH of XENP018270

SEQ ID NO: 13407 - protein, 5 aa, Artificial Sequence
  Description of Artificial Sequence: Synthetic peptide
  XENP018270 vhCDR1
NYWMN

SEQ ID NO: 13408 - protein, 19 aa, Artificial Sequence
  Description of Artificial Sequence: Synthetic peptide
  XENP018270 vhCDR2
EIRLKSNNYATHYAEPVKG

SEQ ID NO: 13409 - protein, 11 aa, Artificial Sequence
  Description of Artificial Sequence: Synthetic peptide
  XENP018270 vhCDR3
LYGNYGGYFDV

SEQ ID NO: 13410 - protein, 214 aa, Artificial Sequence; identical to SEQ ID NO: 11550
  Description of Artificial Sequence: Synthetic polypeptide
  XENP018270 1G6_H1.169_L1_IgG1_PVA_/S267K Light Chain

SEQ ID NO: 13411 - protein, 107 aa, Artificial Sequence; identical to SEQ ID NO: 6247
  Description of Artificial Sequence: Synthetic polypeptide
  VL of XENP018270

SEQ ID NO: 13412 - protein, 11 aa, Artificial Sequence
  Description of Artificial Sequence: Synthetic peptide
  XENP018270 vlCDR1
RASQSVSNDVA

SEQ ID NO: 13413 - protein, 7 aa, Artificial Sequence
  Description of Artificial Sequence: Synthetic peptide
  XENP018270 vlCDR2
YASHRYT

SEQ ID NO: 13414 - protein, 9 aa, Artificial Sequence
  Description of Artificial Sequence: Synthetic peptide
  XENP018270 vlCDR3
QQDYSSPRT

SEQ ID NO: 13415 - protein, 451 aa, Artificial Sequence
  Description of Artificial Sequence: Synthetic polypeptide
  XENP018271 1G6_H1.170_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13416 - protein, 122 aa, Artificial Sequence; identical to SEQ ID NO: 7881
  Description of Artificial Sequence: Synthetic polypeptide
  VH of XENP018271

SEQ ID NO: 13417 - protein, 5 aa, Artificial Sequence
  Description of Artificial Sequence: Synthetic peptide
  XENP018271 vhCDR1
NYWMN

SEQ ID NO: 13418 - protein, 19 aa, Artificial Sequence
  Description of Artificial Sequence: Synthetic peptide
  XENP018271 vhCDR2
EIRLKSNNYATHYAEPVKG

SEQ ID NO: 13419 - protein, 11 aa, Artificial Sequence
  Description of Artificial Sequence: Synthetic peptide
  XENP018271 vhCDR3
WYGNYGGYFDV

SEQ ID NO: 13420 - protein, 214 aa, Artificial Sequence; identical to SEQ ID NO: 11550
  Description of Artificial Sequence: Synthetic polypeptide
  XENP018271 1G6_H1.170_L1_IgG1_PVA_/S267K Light Chain

SEQ ID NO: 13421 - protein, 107 aa, Artificial Sequence; identical to SEQ ID NO: 6247
  Description of Artificial Sequence: Synthetic polypeptide
  VL of XENP018271

SEQ ID NO: 13422 - protein, 11 aa, Artificial Sequence
  Description of Artificial Sequence: Synthetic peptide
  XENP018271 vlCDR1
RASQSVSNDVA

SEQ ID NO: 13423 - protein, 7 aa, Artificial Sequence
  Description of Artificial Sequence: Synthetic peptide
  XENP018271 vlCDR2
YASHRYT

SEQ ID NO: 13424 - protein, 9 aa, Artificial Sequence
  Description of Artificial Sequence: Synthetic peptide
  XENP018271 vlCDR3
QQDYSSPRT

SEQ ID NO: 13425 - protein, 451 aa, Artificial Sequence
  Description of Artificial Sequence: Synthetic polypeptide
  XENP018272 1G6_H1.171_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13426 - protein, 122 aa, Artificial Sequence; identical to SEQ ID NO: 7890
  Description of Artificial Sequence: Synthetic polypeptide
  VH of XENP018272

SEQ ID NO: 13427 - protein, 5 aa, Artificial Sequence
  Description of Artificial Sequence: Synthetic peptide
  XENP018272 vhCDR1
NYWMN

SEQ ID NO: 13428 - protein, 19 aa, Artificial Sequence
  Description of Artificial Sequence: Synthetic peptide
  XENP018272 vhCDR2
EIRLKSNNYATHYAEPVKG

SEQ ID NO: 13429 - protein, 11 aa, Artificial Sequence
  Description of Artificial Sequence: Synthetic peptide
  XENP018272 vhCDR3
VYGNYGGYFDV

SEQ ID NO: 13430 - protein, 214 aa, Artificial Sequence; identical to SEQ ID NO: 11550
  Description of Artificial Sequence: Synthetic polypeptide
  XENP018272 1G6_H1.171_L1_IgG1_PVA_/S267K Light Chain

SEQ ID NO: 13431 - protein, 107 aa, Artificial Sequence; identical to SEQ ID NO: 6247
  Description of Artificial Sequence: Synthetic polypeptide
  VL of XENP018272

SEQ ID NO: 13432 - protein, 11 aa, Artificial Sequence
  Description of Artificial Sequence: Synthetic peptide
  XENP018272 vlCDR1
RASQSVSNDVA

SEQ ID NO: 13433 - protein, 7 aa, Artificial Sequence
  Description of Artificial Sequence: Synthetic peptide
  XENP018272 vlCDR2
YASHRYT

SEQ ID NO: 13434 - protein, 9 aa, Artificial Sequence
  Description of Artificial Sequence: Synthetic peptide
  XENP018272 vlCDR3
QQDYSSPRT

SEQ ID NO: 13435 - protein, 451 aa, Artificial Sequence
  Description of Artificial Sequence: Synthetic polypeptide
  XENP018273 1G6_H1.172_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13436 - protein, 122 aa, Artificial Sequence; identical to SEQ ID NO: 7899
  Description of Artificial Sequence: Synthetic polypeptide
  VH of XENP018273

SEQ ID NO: 13437 - protein, 5 aa, Artificial Sequence
  Description of Artificial Sequence: Synthetic peptide
  XENP018273 vhCDR1
NYWMN

SEQ ID NO: 13438 - protein, 19 aa, Artificial Sequence
  Description of Artificial Sequence: Synthetic peptide
  XENP018273 vhCDR2
EIRLKSNNYATHYAEPVKG

SEQ ID NO: 13439 - protein, 11 aa, Artificial Sequence
  Description of Artificial Sequence: Synthetic peptide
  XENP018273 vhCDR3
AYGNYGGYFDV

SEQ ID NO: 13440 - protein, 214 aa, Artificial Sequence; identical to SEQ ID NO: 11550
  Description of Artificial Sequence: Synthetic polypeptide
  XENP018273 1G6_H1.172_L1_IgG1_PVA_/S267K Light Chain

SEQ ID NO: 13441 - protein, 107 aa, Artificial Sequence; identical to SEQ ID NO: 6247
  Description of Artificial Sequence: Synthetic polypeptide
  VL of XENP018273

SEQ ID NO: 13442 - protein, 11 aa, Artificial Sequence
  Description of Artificial Sequence: Synthetic peptide
  XENP018273 vlCDR1
RASQSVSNDVA

SEQ ID NO: 13443 - protein, 7 aa, Artificial Sequence
  Description of Artificial Sequence: Synthetic peptide
  XENP018273 vlCDR2
YASHRYT

SEQ ID NO: 13444 - protein, 9 aa, Artificial Sequence
  Description of Artificial Sequence: Synthetic peptide
  XENP018273 vlCDR3
QQDYSSPRT

SEQ ID NO: 13445 - protein, 451 aa, Artificial Sequence
  Description of Artificial Sequence: Synthetic polypeptide
  XENP018274 1G6_H1.173_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13446 - protein, 122 aa, Artificial Sequence; identical to SEQ ID NO: 7908
  Description of Artificial Sequence: Synthetic polypeptide
  VH of XENP018274

SEQ ID NO: 13447 - protein, 5 aa, Artificial Sequence
  Description of Artificial Sequence: Synthetic peptide
  XENP018274 vhCDR1
NYWMN

SEQ ID NO: 13448 - protein, 19 aa, Artificial Sequence
  Description of Artificial Sequence: Synthetic peptide
  XENP018274 vhCDR2
EIRLKSNNYATHYAEPVKG

SEQ ID NO: 13449 - protein, 11 aa, Artificial Sequence
  Description of Artificial Sequence: Synthetic peptide
  XENP018274 vhCDR3
QYGNYGGYFDV

SEQ ID NO: 13450 - protein, 214 aa, Artificial Sequence; identical to SEQ ID NO: 11550
  Description of Artificial Sequence: Synthetic polypeptide
  XENP018274 1G6_H1.173_L1_IgG1_PVA_/S267K Light Chain

SEQ ID NO: 13451 - protein, 107 aa, Artificial Sequence; identical to SEQ ID NO: 6247
  Description of Artificial Sequence: Synthetic polypeptide
  VL of XENP018274

SEQ ID NO: 13452 - protein, 11 aa, Artificial Sequence
  Description of Artificial Sequence: Synthetic peptide
  XENP018274 vlCDR1
RASQSVSNDVA

SEQ ID NO: 13453 - protein, 7 aa, Artificial Sequence
  Description of Artificial Sequence: Synthetic peptide
  XENP018274 vlCDR2
YASHRYT

SEQ ID NO: 13454 - protein, 9 aa, Artificial Sequence
  Description of Artificial Sequence: Synthetic peptide
  XENP018274 vlCDR3
QQDYSSPRT

SEQ ID NO: 13455 - protein, 451 aa, Artificial Sequence
  Description of Artificial Sequence: Synthetic polypeptide
  XENP018275 1G6_H1.174_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13456 - protein, 122 aa, Artificial Sequence; identical to SEQ ID NO: 7917
  Description of Artificial Sequence: Synthetic polypeptide
  VH of XENP018275

SEQ ID NO: 13457 - protein, 5 aa, Artificial Sequence
  Description of Artificial Sequence: Synthetic peptide
  XENP018275 vhCDR1
NYWMN

SEQ ID NO: 13458 - protein, 19 aa, Artificial Sequence
  Description of Artificial Sequence: Synthetic peptide
  XENP018275 vhCDR2
EIRLKSNNYATHYAEPVKG

SEQ ID NO: 13459 - protein, 11 aa, Artificial Sequence
  Description of Artificial Sequence: Synthetic peptide
  XENP018275 vhCDR3
DYGNYGGYFDV

SEQ ID NO: 13460 - protein, 214 aa, Artificial Sequence; identical to SEQ ID NO: 11550
  Description of Artificial Sequence: Synthetic polypeptide
  XENP018275 1G6_H1.174_L1_IgG1_PVA_/S267K Light Chain

SEQ ID NO: 13461 - protein, 107 aa, Artificial Sequence; identical to SEQ ID NO: 6247
  Description of Artificial Sequence: Synthetic polypeptide
  VL of XENP018275

SEQ ID NO: 13462 - protein, 11 aa, Artificial Sequence
  Description of Artificial Sequence: Synthetic peptide
  XENP018275 vlCDR1
RASQSVSNDVA

SEQ ID NO: 13463 - protein, 7 aa, Artificial Sequence
  Description of Artificial Sequence: Synthetic peptide
  XENP018275 vlCDR2
YASHRYT

SEQ ID NO: 13464 - protein, 9 aa, Artificial Sequence
  Description of Artificial Sequence: Synthetic peptide
  XENP018275 vlCDR3
QQDYSSPRT

SEQ ID NO: 13465 - protein, 451 aa, Artificial Sequence
  Description of Artificial Sequence: Synthetic polypeptide
  XENP018276 1G6_H1.175_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13466 - protein, 122 aa, Artificial Sequence; identical to SEQ ID NO: 7926
  Description of Artificial Sequence: Synthetic polypeptide
  VH of XENP018276

SEQ ID NO: 13467 - protein, 5 aa, Artificial Sequence
  Description of Artificial Sequence: Synthetic peptide
  XENP018276 vhCDR1
NYWMN

SEQ ID NO: 13468 - protein, 19 aa, Artificial Sequence
  Description of Artificial Sequence: Synthetic peptide
  XENP018276 vhCDR2
EIRLKSNNYATHYAEPVKG

SEQ ID NO: 13469 - protein, 11 aa, Artificial Sequence
  Description of Artificial Sequence: Synthetic peptide
  XENP018276 vhCDR3
KYGNYGGYFDV

SEQ ID NO: 13470 - protein, 214 aa, Artificial Sequence; identical to SEQ ID NO: 11550
  Description of Artificial Sequence: Synthetic polypeptide
  XENP018276 1G6_H1.175_L1_IgG1_PVA_/S267K Light Chain

SEQ ID NO: 13471 - protein, 107 aa, Artificial Sequence; identical to SEQ ID NO: 6247
  Description of Artificial Sequence: Synthetic polypeptide
  VL of XENP018276

SEQ ID NO: 13472 - protein, 11 aa, Artificial Sequence
  Description of Artificial Sequence: Synthetic peptide
  XENP018276 vlCDR1
RASQSVSNDVA

SEQ ID NO: 13473 - protein, 7 aa, Artificial Sequence
  Description of Artificial Sequence: Synthetic peptide
  XENP018276 vlCDR2
YASHRYT

SEQ ID NO: 13474 - protein, 9 aa, Artificial Sequence
  Description of Artificial Sequence: Synthetic peptide
  XENP018276 vlCDR3
QQDYSSPRT

SEQ ID NO: 13475 - protein, 451 aa, Artificial Sequence
  Description of Artificial Sequence: Synthetic polypeptide
  XENP018277 1G6_H1.176_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13476 - protein, 122 aa, Artificial Sequence; identical to SEQ ID NO: 7935
  Description of Artificial Sequence: Synthetic polypeptide
  VH of XENP018277

SEQ ID NO: 13477 - protein, 5 aa, Artificial Sequence
  Description of Artificial Sequence: Synthetic peptide
  XENP018277 vhCDR1
NYWMN

SEQ ID NO: 13478 - protein, 19 aa, Artificial Sequence
  Description of Artificial Sequence: Synthetic peptide
  XENP018277 vhCDR2
EIRLKSNNYATHYAEPVKG

SEQ ID NO: 13479 - protein, 11 aa, Artificial Sequence
  Description of Artificial Sequence: Synthetic peptide
  XENP018277 vhCDR3
YFGNYGGYFDV

SEQ ID NO: 13480 - protein, 214 aa, Artificial Sequence; identical to SEQ ID NO: 11550
  Description of Artificial Sequence: Synthetic polypeptide
  XENP018277 1G6_H1.176_L1_IgG1_PVA_/S267K Light Chain

SEQ ID NO: 13481 - protein, 107 aa, Artificial Sequence; identical to SEQ ID NO: 6247
  Description of Artificial Sequence: Synthetic polypeptide
  VL of XENP018277

SEQ ID NO: 13482 - protein, 11 aa, Artificial Sequence
  Description of Artificial Sequence: Synthetic peptide
  XENP018277 vlCDR1
RASQSVSNDVA

SEQ ID NO: 13483 - protein, 7 aa, Artificial Sequence
  Description of Artificial Sequence: Synthetic peptide
  XENP018277 vlCDR2
YASHRYT

SEQ ID NO: 13484 - protein, 9 aa, Artificial Sequence
  Description of Artificial Sequence: Synthetic peptide
  XENP018277 vlCDR3
QQDYSSPRT

SEQ ID NO: 13485 - protein, 451 aa, Artificial Sequence
  Description of Artificial Sequence: Synthetic polypeptide
  XENP018278 1G6_H1.177_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13486 - protein, 122 aa, Artificial Sequence; identical to SEQ ID NO: 7944
  Description of Artificial Sequence: Synthetic polypeptide
  VH of XENP018278

SEQ ID NO: 13487 - protein, 5 aa, Artificial Sequence
  Description of Artificial Sequence: Synthetic peptide
  XENP018278 vhCDR1
NYWMN

SEQ ID NO: 13488 - protein, 19 aa, Artificial Sequence
  Description of Artificial Sequence: Synthetic peptide
  XENP018278 vhCDR2
EIRLKSNNYATHYAEPVKG

SEQ ID NO: 13489 - protein, 11 aa, Artificial Sequence
  Description of Artificial Sequence: Synthetic peptide
  XENP018278 vhCDR3
YHGNYGGYFDV

SEQ ID NO: 13490 - protein, 214 aa, Artificial Sequence; identical to SEQ ID NO: 11550
  Description of Artificial Sequence: Synthetic polypeptide
  XENP018278 1G6_H1.177_L1_IgG1_PVA_/S267K Light Chain

SEQ ID NO: 13491 - protein, 107 aa, Artificial Sequence; identical to SEQ ID NO: 6247
  Description of Artificial Sequence: Synthetic polypeptide
  VL of XENP018278

SEQ ID NO: 13492 - protein, 11 aa, Artificial Sequence
  Description of Artificial Sequence: Synthetic peptide
  XENP018278 vlCDR1
RASQSVSNDVA

SEQ ID NO: 13493 - protein, 7 aa, Artificial Sequence
  Description of Artificial Sequence: Synthetic peptide
  XENP018278 vlCDR2
YASHRYT

SEQ ID NO: 13494 - protein, 9 aa, Artificial Sequence
  Description of Artificial Sequence: Synthetic peptide
  XENP018278 vlCDR3
QQDYSSPRT

SEQ ID NO: 13495 - protein, 451 aa, Artificial Sequence
  Description of Artificial Sequence: Synthetic polypeptide
  XENP018279 1G6_H1.178_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13496 - protein, 122 aa, Artificial Sequence; identical to SEQ ID NO: 7953
  Description of Artificial Sequence: Synthetic polypeptide
  VH of XENP018279

SEQ ID NO: 13497 - protein, 5 aa, Artificial Sequence
  Description of Artificial Sequence: Synthetic peptide
  XENP018279 vhCDR1
NYWMN

SEQ ID NO: 13498 - protein, 19 aa, Artificial Sequence
  Description of Artificial Sequence: Synthetic peptide
  XENP018279 vhCDR2
EIRLKSNNYATHYAEPVKG

SEQ ID NO: 13499 - protein, 11 aa, Artificial Sequence
  Description of Artificial Sequence: Synthetic peptide
  XENP018279 vhCDR3
YLGNYGGYFDV

SEQ ID NO: 13500 - protein, 214 aa, Artificial Sequence; identical to SEQ ID NO: 11550
  Description of Artificial Sequence: Synthetic polypeptide
  XENP018279 1G6_H1.178_L1_IgG1_PVA_/S267K Light Chain

SEQ ID NO: 13501 - protein, 107 aa, Artificial Sequence; identical to SEQ ID NO: 6247
  Description of Artificial Sequence: Synthetic polypeptide
  VL of XENP018279

SEQ ID NO: 13502 - protein, 11 aa, Artificial Sequence
  Description of Artificial Sequence: Synthetic peptide
  XENP018279 vlCDR1
RASQSVSNDVA

SEQ ID NO: 13503 - protein, 7 aa, Artificial Sequence
  Description of Artificial Sequence: Synthetic peptide
  XENP018279 vlCDR2
YASHRYT

SEQ ID NO: 13504 - protein, 9 aa, Artificial Sequence
  Description of Artificial Sequence: Synthetic peptide
  XENP018279 vlCDR3
QQDYSSPRT

SEQ ID NO: 13505 - protein, 451 aa, Artificial Sequence
  Description of Artificial Sequence: Synthetic polypeptide
  XENP018280 1G6_H1.179_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13506 - protein, 122 aa, Artificial Sequence; identical to SEQ ID NO: 7962
  Description of Artificial Sequence: Synthetic polypeptide
  VH of XENP018280

SEQ ID NO: 13507 - protein, 5 aa, Artificial Sequence
  Description of Artificial Sequence: Synthetic peptide
  XENP018280 vhCDR1
NYWMN

SEQ ID NO: 13508 - protein, 19 aa, Artificial Sequence
  Description of Artificial Sequence: Synthetic peptide
  XENP018280 vhCDR2
EIRLKSNNYATHYAEPVKG

SEQ ID NO: 13509 - protein, 11 aa, Artificial Sequence
  Description of Artificial Sequence: Synthetic peptide
  XENP018280 vhCDR3
YWGNYGGYFDV

SEQ ID NO: 13510 - protein, 214 aa, Artificial Sequence; identical to SEQ ID NO: 11550
  Description of Artificial Sequence: Synthetic polypeptide
  XENP018280 1G6_H1.179_L1_IgG1_PVA_/S267K Light Chain

SEQ ID NO: 13511 - protein, 107 aa, Artificial Sequence; identical to SEQ ID NO: 6247
  Description of Artificial Sequence: Synthetic polypeptide
  VL of XENP018280

SEQ ID NO: 13512 - protein, 11 aa, Artificial Sequence
  Description of Artificial Sequence: Synthetic peptide
  XENP018280 vlCDR1
RASQSVSNDVA

SEQ ID NO: 13513 - protein, 7 aa, Artificial Sequence
  Description of Artificial Sequence: Synthetic peptide
  XENP018280 vlCDR2
YASHRYT

SEQ ID NO: 13514 - protein, 9 aa, Artificial Sequence
  Description of Artificial Sequence: Synthetic peptide
  XENP018280 vlCDR3
QQDYSSPRT

SEQ ID NO: 13515 - protein, 451 aa, Artificial Sequence
  Description of Artificial Sequence: Synthetic polypeptide
  XENP018281 1G6_H1.180_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13516 - protein, 122 aa, Artificial Sequence; identical to SEQ ID NO: 7971
  Description of Artificial Sequence: Synthetic polypeptide
  VH of XENP018281

SEQ ID NO: 13517 - protein, 5 aa, Artificial Sequence
  Description of Artificial Sequence: Synthetic peptide
  XENP018281 vhCDR1
NYWMN

SEQ ID NO: 13518 - protein, 19 aa, Artificial Sequence
  Description of Artificial Sequence: Synthetic peptide
  XENP018281 vhCDR2
EIRLKSNNYATHYAEPVKG

SEQ ID NO: 13519 - protein, 11 aa, Artificial Sequence
  Description of Artificial Sequence: Synthetic peptide
  XENP018281 vhCDR3
YVGNYGGYFDV

SEQ ID NO: 13520 - protein, 214 aa, Artificial Sequence; identical to SEQ ID NO: 11550
  Description of Artificial Sequence: Synthetic polypeptide
  XENP018281 1G6_H1.180_L1_IgG1_PVA_/S267K Light Chain

SEQ ID NO: 13521 - protein, 107 aa, Artificial Sequence; identical to SEQ ID NO: 6247
  Description of Artificial Sequence: Synthetic polypeptide
  VL of XENP018281

SEQ ID NO: 13522 - protein, 11 aa, Artificial Sequence
  Description of Artificial Sequence: Synthetic peptide
  XENP018281 vlCDR1
RASQSVSNDVA

SEQ ID NO: 13523 - protein, 7 aa, Artificial Sequence
  Description of Artificial Sequence: Synthetic peptide
  XENP018281 vlCDR2
YASHRYT

SEQ ID NO: 13524 - protein, 9 aa, Artificial Sequence
  Description of Artificial Sequence: Synthetic peptide
  XENP018281 vlCDR3
QQDYSSPRT

SEQ ID NO: 13525 - protein, 451 aa, Artificial Sequence
  Description of Artificial Sequence: Synthetic polypeptide
  XENP018282 1G6_H1.181_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13526 - protein, 122 aa, Artificial Sequence; identical to SEQ ID NO: 7980
  Description of Artificial Sequence: Synthetic polypeptide
  VH of XENP018282

SEQ ID NO: 13527 - protein, 5 aa, Artificial Sequence
  Description of Artificial Sequence: Synthetic peptide
  XENP018282 vhCDR1
NYWMN

SEQ ID NO: 13528 - protein, 19 aa, Artificial Sequence
  Description of Artificial Sequence: Synthetic peptide
  XENP018282 vhCDR2
EIRLKSNNYATHYAEPVKG

SEQ ID NO: 13529 - protein, 11 aa, Artificial Sequence
  Description of Artificial Sequence: Synthetic peptide
  XENP018282 vhCDR3
YAGNYGGYFDV

SEQ ID NO: 13530 - protein, 214 aa, Artificial Sequence; identical to SEQ ID NO: 11550
  Description of Artificial Sequence: Synthetic polypeptide
  XENP018282 1G6_H1.181_L1_IgG1_PVA_/S267K Light Chain

SEQ ID NO: 13531 - protein, 107 aa, Artificial Sequence; identical to SEQ ID NO: 6247
  Description of Artificial Sequence: Synthetic polypeptide
  VL of XENP018282

SEQ ID NO: 13532 - protein, 11 aa, Artificial Sequence
  Description of Artificial Sequence: Synthetic peptide
  XENP018282 vlCDR1
RASQSVSNDVA

SEQ ID NO: 13533 - protein, 7 aa, Artificial Sequence
  Description of Artificial Sequence: Synthetic peptide
  XENP018282 vlCDR2
YASHRYT

SEQ ID NO: 13534 - protein, 9 aa, Artificial Sequence
  Description of Artificial Sequence: Synthetic peptide
  XENP018282 vlCDR3
QQDYSSPRT

SEQ ID NO: 13535 - protein, 451 aa, Artificial Sequence
  Description of Artificial Sequence: Synthetic polypeptide
  XENP018283 1G6_H1.182_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13536 - protein, 122 aa, Artificial Sequence; identical to SEQ ID NO: 7989
  Description of Artificial Sequence: Synthetic polypeptide
  VH of XENP018283

SEQ ID NO: 13537 - protein, 5 aa, Artificial Sequence
  Description of Artificial Sequence: Synthetic peptide
  XENP018283 vhCDR1
NYWMN

SEQ ID NO: 13538 - protein, 19 aa, Artificial Sequence
  Description of Artificial Sequence: Synthetic peptide
  XENP018283 vhCDR2
EIRLKSNNYATHYAEPVKG

SEQ ID NO: 13539 - protein, 11 aa, Artificial Sequence
  Description of Artificial Sequence: Synthetic peptide
  XENP018283 vhCDR3
YQGNYGGYFDV

SEQ ID NO: 13540 - protein, 214 aa, Artificial Sequence; identical to SEQ ID NO: 11550
  Description of Artificial Sequence: Synthetic polypeptide
  XENP018283 1G6_H1.182_L1_IgG1_PVA_/S267K Light Chain

SEQ ID NO: 13541 - protein, 107 aa, Artificial Sequence; identical to SEQ ID NO: 6247
  Description of Artificial Sequence: Synthetic polypeptide
  VL of XENP018283

SEQ ID NO: 13542 - protein, 11 aa, Artificial Sequence
  Description of Artificial Sequence: Synthetic peptide
  XENP018283 vlCDR1
RASQSVSNDVA

SEQ ID NO: 13543 - protein, 7 aa, Artificial Sequence
  Description of Artificial Sequence: Synthetic peptide
  XENP018283 vlCDR2
YASHRYT

SEQ ID NO: 13544 - protein, 9 aa, Artificial Sequence
  Description of Artificial Sequence: Synthetic peptide
  XENP018283 vlCDR3
QQDYSSPRT

SEQ ID NO: 13545 - protein, 451 aa, Artificial Sequence
  Description of Artificial Sequence: Synthetic polypeptide
  XENP018284 1G6_H1.183_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13546 - protein, 122 aa, Artificial Sequence; identical to SEQ ID NO: 7998
  Description of Artificial Sequence: Synthetic polypeptide
  VH of XENP018284

SEQ ID NO: 13547 - protein, 5 aa, Artificial Sequence
  Description of Artificial Sequence: Synthetic peptide
  XENP018284 vhCDR1
NYWMN

SEQ ID NO: 13548 - protein, 19 aa, Artificial Sequence
  Description of Artificial Sequence: Synthetic peptide
  XENP018284 vhCDR2
EIRLKSNNYATHYAEPVKG

SEQ ID NO: 13549 - protein, 11 aa, Artificial Sequence
  Description of Artificial Sequence: Synthetic peptide
  XENP018284 vhCDR3
YDGNYGGYFDV

SEQ ID NO: 13550 - protein, 214 aa, Artificial Sequence; identical to SEQ ID NO: 11550
  Description of Artificial Sequence: Synthetic polypeptide
  XENP018284 1G6_H1.183_L1_IgG1_PVA_/S267K Light Chain

SEQ ID NO: 13551 - protein, 107 aa, Artificial Sequence; identical to SEQ ID NO: 6247
  Description of Artificial Sequence: Synthetic polypeptide
  VL of XENP018284

SEQ ID NO: 13552 - protein, 11 aa, Artificial Sequence
  Description of Artificial Sequence: Synthetic peptide
  XENP018284 vlCDR1
RASQSVSNDVA

SEQ ID NO: 13553 - protein, 7 aa, Artificial Sequence
  Description of Artificial Sequence: Synthetic peptide
  XENP018284 vlCDR2
YASHRYT

SEQ ID NO: 13554 - protein, 9 aa, Artificial Sequence
  Description of Artificial Sequence: Synthetic peptide
  XENP018284 vlCDR3
QQDYSSPRT

SEQ ID NO: 13555 - protein, 451 aa, Artificial Sequence
  Description of Artificial Sequence: Synthetic polypeptide
  XENP018285 1G6_H1.184_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13556 - protein, 122 aa, Artificial Sequence; identical to SEQ ID NO: 8007
  Description of Artificial Sequence: Synthetic polypeptide
  VH of XENP018285

SEQ ID NO: 13557 - protein, 5 aa, Artificial Sequence
  Description of Artificial Sequence: Synthetic peptide
  XENP018285 vhCDR1
NYWMN

SEQ ID NO: 13558 - protein, 19 aa, Artificial Sequence
  Description of Artificial Sequence: Synthetic peptide
  XENP018285 vhCDR2
EIRLKSNNYATHYAEPVKG

SEQ ID NO: 13559 - protein, 11 aa, Artificial Sequence
  Description of Artificial Sequence: Synthetic peptide
  XENP018285 vhCDR3
YKGNYGGYFDV

SEQ ID NO: 13560 - protein, 214 aa, Artificial Sequence; identical to SEQ ID NO: 11550
  Description of Artificial Sequence: Synthetic polypeptide
  XENP018285 1G6_H1.184_L1_IgG1_PVA_/S267K Light Chain

SEQ ID NO: 13561 - protein, 107 aa, Artificial Sequence; identical to SEQ ID NO: 6247
  Description of Artificial Sequence: Synthetic polypeptide
  VL of XENP018285

SEQ ID NO: 13562 - protein, 11 aa, Artificial Sequence
  Description of Artificial Sequence: Synthetic peptide
  XENP018285 vlCDR1
RASQSVSNDVA

SEQ ID NO: 13563 - protein, 7 aa, Artificial Sequence
  Description of Artificial Sequence: Synthetic peptide
  XENP018285 vlCDR2
YASHRYT

SEQ ID NO: 13564 - protein, 9 aa, Artificial Sequence
  Description of Artificial Sequence: Synthetic peptide
  XENP018285 vlCDR3
QQDYSSPRT

SEQ ID NO: 13565 - protein, 451 aa, Artificial Sequence
  Description of Artificial Sequence: Synthetic polypeptide
  XENP018286 1G6_H1.185_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13566 - protein, 122 aa, Artificial Sequence; identical to SEQ ID NO: 8016
  Description of Artificial Sequence: Synthetic polypeptide
  VH of XENP018286

SEQ ID NO: 13567 - protein, 5 aa, Artificial Sequence
  Description of Artificial Sequence: Synthetic peptide
  XENP018286 vhCDR1
NYWMN

SEQ ID NO: 13568 - protein, 19 aa, Artificial Sequence
  Description of Artificial Sequence: Synthetic peptide
  XENP018286 vhCDR2
EIRLKSNNYATHYAEPVKG

SEQ ID NO: 13569 - protein, 11 aa, Artificial Sequence
  Description of Artificial Sequence: Synthetic peptide
  XENP018286 vhCDR3
YYANYGGYFDV

SEQ ID NO: 13570 - protein, 214 aa, Artificial Sequence; identical to SEQ ID NO: 11550
  Description of Artificial Sequence: Synthetic polypeptide
  XENP018286 1G6_H1.185_L1_IgG1_PVA_/S267K Light Chain

SEQ ID NO: 13571 - protein, 107 aa, Artificial Sequence; identical to SEQ ID NO: 6247
  Description of Artificial Sequence: Synthetic polypeptide
  VL of XENP018286

SEQ ID NO: 13572 - protein, 11 aa, Artificial Sequence
  Description of Artificial Sequence: Synthetic peptide
  XENP018286 vlCDR1
RASQSVSNDVA

SEQ ID NO: 13573 - protein, 7 aa, Artificial Sequence
  Description of Artificial Sequence: Synthetic peptide
  XENP018286 vlCDR2
YASHRYT

SEQ ID NO: 13574 - protein, 9 aa, Artificial Sequence
  Description of Artificial Sequence: Synthetic peptide
  XENP018286 vlCDR3
QQDYSSPRT

SEQ ID NO: 13575 - protein, 451 aa, Artificial Sequence
  Description of Artificial Sequence: Synthetic polypeptide
  XENP018287 1G6_H1.186_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13576 - protein, 122 aa, Artificial Sequence; identical to SEQ ID NO: 8025
  Description of Artificial Sequence: Synthetic polypeptide
  VH of XENP018287

SEQ ID NO: 13577 - protein, 5 aa, Artificial Sequence
  Description of Artificial Sequence: Synthetic peptide
  XENP018287 vhCDR1
NYWMN

SEQ ID NO: 13578 - protein, 19 aa, Artificial Sequence
  Description of Artificial Sequence: Synthetic peptide
  XENP018287 vhCDR2
EIRLKSNNYATHYAEPVKG

SEQ ID NO: 13579 - protein, 11 aa, Artificial Sequence
  Description of Artificial Sequence: Synthetic peptide
  XENP018287 vhCDR3
YYSNYGGYFDV

SEQ ID NO: 13580 - protein, 214 aa, Artificial Sequence; identical to SEQ ID NO: 11550
  Description of Artificial Sequence: Synthetic polypeptide
  XENP018287 1G6_H1.186_L1_IgG1_PVA_/S267K Light Chain

SEQ ID NO: 13581 - protein, 107 aa, Artificial Sequence; identical to SEQ ID NO: 6247
  Description of Artificial Sequence: Synthetic polypeptide
  VL of XENP018287

SEQ ID NO: 13582 - protein, 11 aa, Artificial Sequence
  Description of Artificial Sequence: Synthetic peptide
  XENP018287 vlCDR1
RASQSVSNDVA

SEQ ID NO: 13583 - protein, 7 aa, Artificial Sequence
  Description of Artificial Sequence: Synthetic peptide
  XENP018287 vlCDR2
YASHRYT

SEQ ID NO: 13584 - protein, 9 aa, Artificial Sequence
  Description of Artificial Sequence: Synthetic peptide
  XENP018287 vlCDR3
QQDYSSPRT

SEQ ID NO: 13585 - protein, 451 aa, Artificial Sequence
  Description of Artificial Sequence: Synthetic polypeptide
  XENP018288 1G6_H1.187_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13586 - protein, 122 aa, Artificial Sequence; identical to SEQ ID NO: 8034
  Description of Artificial Sequence: Synthetic polypeptide
  VH of XENP018288

SEQ ID NO: 13587 - protein, 5 aa, Artificial Sequence
  Description of Artificial Sequence: Synthetic peptide
  XENP018288 vhCDR1
NYWMN

SEQ ID NO: 13588 - protein, 19 aa, Artificial Sequence
  Description of Artificial Sequence: Synthetic peptide
  XENP018288 vhCDR2
EIRLKSNNYATHYAEPVKG

SEQ ID NO: 13589 - protein, 11 aa, Artificial Sequence
  Description of Artificial Sequence: Synthetic peptide
  XENP018288 vhCDR3
YYTNYGGYFDV

SEQ ID NO: 13590 - protein, 214 aa, Artificial Sequence; identical to SEQ ID NO: 11550
  Description of Artificial Sequence: Synthetic polypeptide
  XENP018288 1G6_H1.187_L1_IgG1_PVA_/S267K Light Chain

SEQ ID NO: 13591 - protein, 107 aa, Artificial Sequence; identical to SEQ ID NO: 6247
  Description of Artificial Sequence: Synthetic polypeptide
  VL of XENP018288

SEQ ID NO: 13592 - protein, 11 aa, Artificial Sequence
  Description of Artificial Sequence: Synthetic peptide
  XENP018288 vlCDR1
RASQSVSNDVA

SEQ ID NO: 13593 - protein, 7 aa, Artificial Sequence
  Description of Artificial Sequence: Synthetic peptide
  XENP018288 vlCDR2
YASHRYT

SEQ ID NO: 13594 - protein, 9 aa, Artificial Sequence
  Description of Artificial Sequence: Synthetic peptide
  XENP018288 vlCDR3
QQDYSSPRT

SEQ ID NO: 13595 - protein, 451 aa, Artificial Sequence
  Description of Artificial Sequence: Synthetic polypeptide
  XENP018289 1G6_H1.188_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13596 - protein, 122 aa, Artificial Sequence; identical to SEQ ID NO: 8043
  Description of Artificial Sequence: Synthetic polypeptide
  VH of XENP018289

SEQ ID NO: 13597 - protein, 5 aa, Artificial Sequence
  Description of Artificial Sequence: Synthetic peptide
  XENP018289 vhCDR1
NYWMN

SEQ ID NO: 13598 - protein, 19 aa, Artificial Sequence
  Description of Artificial Sequence: Synthetic peptide
  XENP018289 vhCDR2
EIRLKSNNYATHYAEPVKG

SEQ ID NO: 13599 - protein, 11 aa, Artificial Sequence
  Description of Artificial Sequence: Synthetic peptide
  XENP018289 vhCDR3
YYQNYGGYFDV

SEQ ID NO: 13600 - protein, 214 aa, Artificial Sequence; identical to SEQ ID NO: 11550
  Description of Artificial Sequence: Synthetic polypeptide
  XENP018289 1G6_H1.188_L1_IgG1_PVA_/S267K Light Chain

SEQ ID NO: 13601 - protein, 107 aa, Artificial Sequence; identical to SEQ ID NO: 6247
  Description of Artificial Sequence: Synthetic polypeptide
  VL of XENP018289

SEQ ID NO: 13602 - protein, 11 aa, Artificial Sequence
  Description of Artificial Sequence: Synthetic peptide
  XENP018289 vlCDR1
RASQSVSNDVA

SEQ ID NO: 13603 - protein, 7 aa, Artificial Sequence
  Description of Artificial Sequence: Synthetic peptide
  XENP018289 vlCDR2
YASHRYT

SEQ ID NO: 13604 - protein, 9 aa, Artificial Sequence
  Description of Artificial Sequence: Synthetic peptide
  XENP018289 vlCDR3
QQDYSSPRT

SEQ ID NO: 13605 - protein, 451 aa, Artificial Sequence
  Description of Artificial Sequence: Synthetic polypeptide
  XENP018290 1G6_H1.189_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13606 - protein, 122 aa, Artificial Sequence; identical to SEQ ID NO: 8052
  Description of Artificial Sequence: Synthetic polypeptide
  VH of XENP018290

SEQ ID NO: 13607 - protein, 5 aa, Artificial Sequence
  Description of Artificial Sequence: Synthetic peptide
  XENP018290 vhCDR1
NYWMN

SEQ ID NO: 13608 - protein, 19 aa, Artificial Sequence
  Description of Artificial Sequence: Synthetic peptide
  XENP018290 vhCDR2
EIRLKSNNYATHYAEPVKG

SEQ ID NO: 13609 - protein, 11 aa, Artificial Sequence
  Description of Artificial Sequence: Synthetic peptide
  XENP018290 vhCDR3
YYHNYGGYFDV

SEQ ID NO: 13610 - protein, 214 aa, Artificial Sequence; identical to SEQ ID NO: 11550
  Description of Artificial Sequence: Synthetic polypeptide
  XENP018290 1G6_H1.189_L1_IgG1_PVA_/S267K Light Chain

SEQ ID NO: 13611 - protein, 107 aa, Artificial Sequence; identical to SEQ ID NO: 6247
  Description of Artificial Sequence: Synthetic polypeptide
  VL of XENP018290

SEQ ID NO: 13612 - protein, 11 aa, Artificial Sequence
  Description of Artificial Sequence: Synthetic peptide
  XENP018290 vlCDR1
RASQSVSNDVA

SEQ ID NO: 13613 - protein, 7 aa, Artificial Sequence
  Description of Artificial Sequence: Synthetic peptide
  XENP018290 vlCDR2
YASHRYT

SEQ ID NO: 13614 - protein, 9 aa, Artificial Sequence
  Description of Artificial Sequence: Synthetic peptide
  XENP018290 vlCDR3
QQDYSSPRT

SEQ ID NO: 13615 - protein, 451 aa, Artificial Sequence
  Description of Artificial Sequence: Synthetic polypeptide
  XENP018291 1G6_H1.190_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13616 - protein, 122 aa, Artificial Sequence; identical to SEQ ID NO: 8061
  Description of Artificial Sequence: Synthetic polypeptide
  VH of XENP018291

SEQ ID NO: 13617 - protein, 5 aa, Artificial Sequence
  Description of Artificial Sequence: Synthetic peptide
  XENP018291 vhCDR1
NYWMN

SEQ ID NO: 13618 - protein, 19 aa, Artificial Sequence
  Description of Artificial Sequence: Synthetic peptide
  XENP018291 vhCDR2
EIRLKSNNYATHYAEPVKG

SEQ ID NO: 13619 - protein, 11 aa, Artificial Sequence
  Description of Artificial Sequence: Synthetic peptide
  XENP018291 vhCDR3
YYDNYGGYFDV

SEQ ID NO: 13620 - protein, 214 aa, Artificial Sequence; identical to SEQ ID NO: 11550
  Description of Artificial Sequence: Synthetic polypeptide
  XENP018291 1G6_H1.190_L1_IgG1_PVA_/S267K Light Chain

SEQ ID NO: 13621 - protein, 107 aa, Artificial Sequence; identical to SEQ ID NO: 6247
  Description of Artificial Sequence: Synthetic polypeptide
  VL of XENP018291

SEQ ID NO: 13622 - protein, 11 aa, Artificial Sequence
  Description of Artificial Sequence: Synthetic peptide
  XENP018291 vlCDR1
RASQSVSNDVA

SEQ ID NO: 13623 - protein, 7 aa, Artificial Sequence
  Description of Artificial Sequence: Synthetic peptide
  XENP018291 vlCDR2
YASHRYT

SEQ ID NO: 13624 - protein, 9 aa, Artificial Sequence
  Description of Artificial Sequence: Synthetic peptide
  XENP018291 vlCDR3
QQDYSSPRT

SEQ ID NO: 13625 - protein, 451 aa, Artificial Sequence
  Description of Artificial Sequence: Synthetic polypeptide
  XENP018292 1G6_H1.191_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13626 - protein, 122 aa, Artificial Sequence; identical to SEQ ID NO: 8070
  Description of Artificial Sequence: Synthetic polypeptide
  VH of XENP018292

SEQ ID NO: 13627 - protein, 5 aa, Artificial Sequence
  Description of Artificial Sequence: Synthetic peptide
  XENP018292 vhCDR1
NYWMN

SEQ ID NO: 13628 - protein, 19 aa, Artificial Sequence
  Description of Artificial Sequence: Synthetic peptide
  XENP018292 vhCDR2
EIRLKSNNYATHYAEPVKG

SEQ ID NO: 13629 - protein, 11 aa, Artificial Sequence
  Description of Artificial Sequence: Synthetic peptide
  XENP018292 vhCDR3
YYKNYGGYFDV

SEQ ID NO: 13630 - protein, 214 aa, Artificial Sequence; identical to SEQ ID NO: 11550
  Description of Artificial Sequence: Synthetic polypeptide
  XENP018292 1G6_H1.191_L1_IgG1_PVA_/S267K Light Chain

SEQ ID NO: 13631 - protein, 107 aa, Artificial Sequence; identical to SEQ ID NO: 6247
  Description of Artificial Sequence: Synthetic polypeptide
  VL of XENP018292

SEQ ID NO: 13632 - protein, 11 aa, Artificial Sequence
  Description of Artificial Sequence: Synthetic peptide
  XENP018292 vlCDR1
RASQSVSNDVA

SEQ ID NO: 13633 - protein, 7 aa, Artificial Sequence
  Description of Artificial Sequence: Synthetic peptide
  XENP018292 vlCDR2
YASHRYT

SEQ ID NO: 13634 - protein, 9 aa, Artificial Sequence
  Description of Artificial Sequence: Synthetic peptide
  XENP018292 vlCDR3
QQDYSSPRT

SEQ ID NO: 13635 - protein, 451 aa, Artificial Sequence
  Description of Artificial Sequence: Synthetic polypeptide
  XENP018293 1G6_H1.192_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13636 - protein, 122 aa, Artificial Sequence; identical to SEQ ID NO: 8079
  Description of Artificial Sequence: Synthetic polypeptide
  VH of XENP018293

SEQ ID NO: 13637 - protein, 5 aa, Artificial Sequence
  Description of Artificial Sequence: Synthetic peptide
  XENP018293 vhCDR1
NYWMN

SEQ ID NO: 13638 - protein, 19 aa, Artificial Sequence
  Description of Artificial Sequence: Synthetic peptide
  XENP018293 vhCDR2
EIRLKSNNYATHYAEPVKG

SEQ ID NO: 13639 - protein, 11 aa, Artificial Sequence
  Description of Artificial Sequence: Synthetic peptide
  XENP018293 vhCDR3
YYLNYGGYFDV

SEQ ID NO: 13640 - protein, 214 aa, Artificial Sequence; identical to SEQ ID NO: 11550
  Description of Artificial Sequence: Synthetic polypeptide
  XENP018293 1G6_H1.192_L1_IgG1_PVA_/S267K Light Chain

SEQ ID NO: 13641 - protein, 107 aa, Artificial Sequence; identical to SEQ ID NO: 6247
  Description of Artificial Sequence: Synthetic polypeptide
  VL of XENP018293

SEQ ID NO: 13642 - protein, 11 aa, Artificial Sequence
  Description of Artificial Sequence: Synthetic peptide
  XENP018293 vlCDR1
RASQSVSNDVA

SEQ ID NO: 13643 - protein, 7 aa, Artificial Sequence
  Description of Artificial Sequence: Synthetic peptide
  XENP018293 vlCDR2
YASHRYT

SEQ ID NO: 13644 - protein, 9 aa, Artificial Sequence
  Description of Artificial Sequence: Synthetic peptide
  XENP018293 vlCDR3
QQDYSSPRT

SEQ ID NO: 13645 - protein, 451 aa, Artificial Sequence
  Description of Artificial Sequence: Synthetic polypeptide
  XENP018294 1G6_H1.193_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13646 - protein, 122 aa, Artificial Sequence; identical to SEQ ID NO: 8088
  Description of Artificial Sequence: Synthetic polypeptide
  VH of XENP018294

SEQ ID NO: 13647 - protein, 5 aa, Artificial Sequence
  Description of Artificial Sequence: Synthetic peptide
  XENP018294 vhCDR1
NYWMN

SEQ ID NO: 13648 - protein, 19 aa, Artificial Sequence
  Description of Artificial Sequence: Synthetic peptide
  XENP018294 vhCDR2
EIRLKSNNYATHYAEPVKG

SEQ ID NO: 13649 - protein, 11 aa, Artificial Sequence
  Description of Artificial Sequence: Synthetic peptide
  XENP018294 vhCDR3
YYFNYGGYFDV

SEQ ID NO: 13650 - protein, 214 aa, Artificial Sequence; identical to SEQ ID NO: 11550
  Description of Artificial Sequence: Synthetic polypeptide
  XENP018294 1G6_H1.193_L1_IgG1_PVA_/S267K Light Chain

SEQ ID NO: 13651 - protein, 107 aa, Artificial Sequence; identical to SEQ ID NO: 6247
  Description of Artificial Sequence: Synthetic polypeptide
  VL of XENP018294

SEQ ID NO: 13652 - protein, 11 aa, Artificial Sequence
  Description of Artificial Sequence: Synthetic peptide
  XENP018294 vlCDR1
RASQSVSNDVA

SEQ ID NO: 13653 - protein, 7 aa, Artificial Sequence
  Description of Artificial Sequence: Synthetic peptide
  XENP018294 vlCDR2
YASHRYT

SEQ ID NO: 13654 - protein, 9 aa, Artificial Sequence
  Description of Artificial Sequence: Synthetic peptide
  XENP018294 vlCDR3
QQDYSSPRT

SEQ ID NO: 13655 - protein, 451 aa, Artificial Sequence
  Description of Artificial Sequence: Synthetic polypeptide
  XENP018295 1G6_H1.194_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13656 - protein, 122 aa, Artificial Sequence; identical to SEQ ID NO: 8097
  Description of Artificial Sequence: Synthetic polypeptide
  VH of XENP018295

SEQ ID NO: 13657 - protein, 5 aa, Artificial Sequence
  Description of Artificial Sequence: Synthetic peptide
  XENP018295 vhCDR1
NYWMN

SEQ ID NO: 13658 - protein, 19 aa, Artificial Sequence
  Description of Artificial Sequence: Synthetic peptide
  XENP018295 vhCDR2
EIRLKSNNYATHYAEPVKG

SEQ ID NO: 13659 - protein, 11 aa, Artificial Sequence
  Description of Artificial Sequence: Synthetic peptide
  XENP018295 vhCDR3
YYGDYGGYFDV

SEQ ID NO: 13660 - protein, 214 aa, Artificial Sequence; identical to SEQ ID NO: 11550
  Description of Artificial Sequence: Synthetic polypeptide
  XENP018295 1G6_H1.194_L1_IgG1_PVA_/S267K Light Chain

SEQ ID NO: 13661 - protein, 107 aa, Artificial Sequence; identical to SEQ ID NO: 6247
  Description of Artificial Sequence: Synthetic polypeptide
  VL of XENP018295

SEQ ID NO: 13662 - protein, 11 aa, Artificial Sequence
  Description of Artificial Sequence: Synthetic peptide
  XENP018295 vlCDR1
RASQSVSNDVA

SEQ ID NO: 13663 - protein, 7 aa, Artificial Sequence
  Description of Artificial Sequence: Synthetic peptide
  XENP018295 vlCDR2
YASHRYT

SEQ ID NO: 13664 - protein, 9 aa, Artificial Sequence
  Description of Artificial Sequence: Synthetic peptide
  XENP018295 vlCDR3
QQDYSSPRT

SEQ ID NO: 13665 - protein, 451 aa, Artificial Sequence
  Description of Artificial Sequence: Synthetic polypeptide
  XENP018296 1G6_H1.195_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13666 - protein, 122 aa, Artificial Sequence; identical to SEQ ID NO: 8106
  Description of Artificial Sequence: Synthetic polypeptide
  VH of XENP018296

SEQ ID NO: 13667 - protein, 5 aa, Artificial Sequence
  Description of Artificial Sequence: Synthetic peptide
  XENP018296 vhCDR1
NYWMN

SEQ ID NO: 13668 - protein, 19 aa, Artificial Sequence
  Description of Artificial Sequence: Synthetic peptide
  XENP018296 vhCDR2
EIRLKSNNYATHYAEPVKG

SEQ ID NO: 13669 - protein, 11 aa, Artificial Sequence
  Description of Artificial Sequence: Synthetic peptide
  XENP018296 vhCDR3
YYGHYGGYFDV

SEQ ID NO: 13670 - protein, 214 aa, Artificial Sequence; identical to SEQ ID NO: 11550
  Description of Artificial Sequence: Synthetic polypeptide
  XENP018296 1G6_H1.195_L1_IgG1_PVA_/S267K Light Chain

SEQ ID NO: 13671 - protein, 107 aa, Artificial Sequence; identical to SEQ ID NO: 6247
  Description of Artificial Sequence: Synthetic polypeptide
  VL of XENP018296

SEQ ID NO: 13672 - protein, 11 aa, Artificial Sequence
  Description of Artificial Sequence: Synthetic peptide
  XENP018296 vlCDR1
RASQSVSNDVA

SEQ ID NO: 13673 - protein, 7 aa, Artificial Sequence
  Description of Artificial Sequence: Synthetic peptide
  XENP018296 vlCDR2
YASHRYT

SEQ ID NO: 13674 - protein, 9 aa, Artificial Sequence
  Description of Artificial Sequence: Synthetic peptide
  XENP018296 vlCDR3
QQDYSSPRT

SEQ ID NO: 13675 - protein, 451 aa, Artificial Sequence
  Description of Artificial Sequence: Synthetic polypeptide
  XENP018301 1G6_H1.196_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13676 - protein, 122 aa, Artificial Sequence; identical to SEQ ID NO: 8115
  Description of Artificial Sequence: Synthetic polypeptide
  VH of XENP018301

SEQ ID NO: 13677 - protein, 5 aa, Artificial Sequence
  Description of Artificial Sequence: Synthetic peptide
  XENP018301 vhCDR1
NYWMN

SEQ ID NO: 13678 - protein, 19 aa, Artificial Sequence
  Description of Artificial Sequence: Synthetic peptide
  XENP018301 vhCDR2
EIRLKSNNYATHYAEPVKG

SEQ ID NO: 13679 - protein, 11 aa, Artificial Sequence
  Description of Artificial Sequence: Synthetic peptide
  XENP018301 vhCDR3
YYGEYGGYFDV

SEQ ID NO: 13680 - protein, 214 aa, Artificial Sequence; identical to SEQ ID NO: 11550
  Description of Artificial Sequence: Synthetic polypeptide
  XENP018301 1G6_H1.196_L1_IgG1_PVA_/S267K Light Chain

SEQ ID NO: 13681 - protein, 107 aa, Artificial Sequence; identical to SEQ ID NO: 6247
  Description of Artificial Sequence: Synthetic polypeptide
  VL of XENP018301

SEQ ID NO: 13682 - protein, 11 aa, Artificial Sequence
  Description of Artificial Sequence: Synthetic peptide
  XENP018301 vlCDR1
RASQSVSNDVA

SEQ ID NO: 13683 - protein, 7 aa, Artificial Sequence
  Description of Artificial Sequence: Synthetic peptide
  XENP018301 vlCDR2
YASHRYT

SEQ ID NO: 13684 - protein, 9 aa, Artificial Sequence
  Description of Artificial Sequence: Synthetic peptide
  XENP018301 vlCDR3
QQDYSSPRT

SEQ ID NO: 13685 - protein, 451 aa, Artificial Sequence
  Description of Artificial Sequence: Synthetic polypeptide
  XENP018302 1G6_H1.197_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13686 - protein, 122 aa, Artificial Sequence; identical to SEQ ID NO: 8124
  Description of Artificial Sequence: Synthetic polypeptide
  VH of XENP018302

SEQ ID NO: 13687 - protein, 5 aa, Artificial Sequence
  Description of Artificial Sequence: Synthetic peptide
  XENP018302 vhCDR1
NYWMN

SEQ ID NO: 13688 - protein, 19 aa, Artificial Sequence
  Description of Artificial Sequence: Synthetic peptide
  XENP018302 vhCDR2
EIRLKSNNYATHYAEPVKG

SEQ ID NO: 13689 - protein, 11 aa, Artificial Sequence
  Description of Artificial Sequence: Synthetic peptide
  XENP018302 vhCDR3
YYGSYGGYFDV

SEQ ID NO: 13690 - protein, 214 aa, Artificial Sequence; identical to SEQ ID NO: 11550
  Description of Artificial Sequence: Synthetic polypeptide
  XENP018302 1G6_H1.197_L1_IgG1_PVA_/S267K Light Chain

SEQ ID NO: 13691 - protein, 107 aa, Artificial Sequence; identical to SEQ ID NO: 6247
  Description of Artificial Sequence: Synthetic polypeptide
  VL of XENP018302

SEQ ID NO: 13692 - protein, 11 aa, Artificial Sequence
  Description of Artificial Sequence: Synthetic peptide
  XENP018302 vlCDR1
RASQSVSNDVA

SEQ ID NO: 13693 - protein, 7 aa, Artificial Sequence
  Description of Artificial Sequence: Synthetic peptide
  XENP018302 vlCDR2
YASHRYT

SEQ ID NO: 13694 - protein, 9 aa, Artificial Sequence
  Description of Artificial Sequence: Synthetic peptide
  XENP018302 vlCDR3
QQDYSSPRT

SEQ ID NO: 13695 - protein, 451 aa, Artificial Sequence
  Description of Artificial Sequence: Synthetic polypeptide
  XENP018303 1G6_H1.198_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13696 - protein, 122 aa, Artificial Sequence; identical to SEQ ID NO: 8133
  Description of Artificial Sequence: Synthetic polypeptide
  VH of XENP018303

SEQ ID NO: 13697 - protein, 5 aa, Artificial Sequence
  Description of Artificial Sequence: Synthetic peptide
  XENP018303 vhCDR1
NYWMN

SEQ ID NO: 13698 - protein, 19 aa, Artificial Sequence
  Description of Artificial Sequence: Synthetic peptide
  XENP018303 vhCDR2
EIRLKSNNYATHYAEPVKG

SEQ ID NO: 13699 - protein, 11 aa, Artificial Sequence
  Description of Artificial Sequence: Synthetic peptide
  XENP018303 vhCDR3
YYGRYGGYFDV

SEQ ID NO: 13700 - protein, 214 aa, Artificial Sequence; identical to SEQ ID NO: 11550
  Description of Artificial Sequence: Synthetic polypeptide
  XENP018303 1G6_H1.198_L1_IgG1_PVA_/S267K Light Chain

SEQ ID NO: 13701 - protein, 107 aa, Artificial Sequence; identical to SEQ ID NO: 6247
  Description of Artificial Sequence: Synthetic polypeptide
  VL of XENP018303

SEQ ID NO: 13702 - protein, 11 aa, Artificial Sequence
  Description of Artificial Sequence: Synthetic peptide
  XENP018303 vlCDR1
RASQSVSNDVA

SEQ ID NO: 13703 - protein, 7 aa, Artificial Sequence
  Description of Artificial Sequence: Synthetic peptide
  XENP018303 vlCDR2
YASHRYT

SEQ ID NO: 13704 - protein, 9 aa, Artificial Sequence
  Description of Artificial Sequence: Synthetic peptide
  XENP018303 vlCDR3
QQDYSSPRT

SEQ ID NO: 13705 - protein, 451 aa, Artificial Sequence
  Description of Artificial Sequence: Synthetic polypeptide
  XENP018304 1G6_H1.199_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13706 - protein, 122 aa, Artificial Sequence; identical to SEQ ID NO: 8142
  Description of Artificial Sequence: Synthetic polypeptide
  VH of XENP018304

SEQ ID NO: 13707 - protein, 5 aa, Artificial Sequence
  Description of Artificial Sequence: Synthetic peptide
  XENP018304 vhCDR1
NYWMN

SEQ ID NO: 13708 - protein, 19 aa, Artificial Sequence
  Description of Artificial Sequence: Synthetic peptide
  XENP018304 vhCDR2
EIRLKSNNYATHYAEPVKG

SEQ ID NO: 13709 - protein, 11 aa, Artificial Sequence
  Description of Artificial Sequence: Synthetic peptide
  XENP018304 vhCDR3
YYGLYGGYFDV

SEQ ID NO: 13710 - protein, 214 aa, Artificial Sequence; identical to SEQ ID NO: 11550
  Description of Artificial Sequence: Synthetic polypeptide
  XENP018304 1G6_H1.199_L1_IgG1_PVA_/S267K Light Chain

SEQ ID NO: 13711 - protein, 107 aa, Artificial Sequence; identical to SEQ ID NO: 6247
  Description of Artificial Sequence: Synthetic polypeptide
  VL of XENP018304

SEQ ID NO: 13712 - protein, 11 aa, Artificial Sequence
  Description of Artificial Sequence: Synthetic peptide
  XENP018304 vlCDR1
RASQSVSNDVA

SEQ ID NO: 13713 - protein, 7 aa, Artificial Sequence
  Description of Artificial Sequence: Synthetic peptide
  XENP018304 vlCDR2
YASHRYT

SEQ ID NO: 13714 - protein, 9 aa, Artificial Sequence
  Description of Artificial Sequence: Synthetic peptide
  XENP018304 vlCDR3
QQDYSSPRT

SEQ ID NO: 13715 - protein, 451 aa, Artificial Sequence
  Description of Artificial Sequence: Synthetic polypeptide
  XENP018305 1G6_H1.200_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13716 - protein, 122 aa, Artificial Sequence; identical to SEQ ID NO: 8151
  Description of Artificial Sequence: Synthetic polypeptide
  VH of XENP018305

SEQ ID NO: 13717 - protein, 5 aa, Artificial Sequence
  Description of Artificial Sequence: Synthetic peptide
  XENP018305 vhCDR1
NYWMN

SEQ ID NO: 13718 - protein, 19 aa, Artificial Sequence
  Description of Artificial Sequence: Synthetic peptide
  XENP018305 vhCDR2
EIRLKSNNYATHYAEPVKG

SEQ ID NO: 13719 - protein, 11 aa, Artificial Sequence
  Description of Artificial Sequence: Synthetic peptide
  XENP018305 vhCDR3
YYGTYGGYFDV

SEQ ID NO: 13720 - protein, 214 aa, Artificial Sequence; identical to SEQ ID NO: 11550
  Description of Artificial Sequence: Synthetic polypeptide
  XENP018305 1G6_H1.200_L1_IgG1_PVA_/S267K Light Chain

SEQ ID NO: 13721 - protein, 107 aa, Artificial Sequence; identical to SEQ ID NO: 6247
  Description of Artificial Sequence: Synthetic polypeptide
  VL of XENP018305

SEQ ID NO: 13722 - protein, 11 aa, Artificial Sequence
  Description of Artificial Sequence: Synthetic peptide
  XENP018305 vlCDR1
RASQSVSNDVA

SEQ ID NO: 13723 - protein, 7 aa, Artificial Sequence
  Description of Artificial Sequence: Synthetic peptide
  XENP018305 vlCDR2
YASHRYT

SEQ ID NO: 13724 - protein, 9 aa, Artificial Sequence
  Description of Artificial Sequence: Synthetic peptide
  XENP018305 vlCDR3
QQDYSSPRT

SEQ ID NO: 13725 - protein, 451 aa, Artificial Sequence
  Description of Artificial Sequence: Synthetic polypeptide
  XENP018306 1G6_H1.201_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13726 - protein, 122 aa, Artificial Sequence; identical to SEQ ID NO: 8160
  Description of Artificial Sequence: Synthetic polypeptide
  VH of XENP018306

SEQ ID NO: 13727 - protein, 5 aa, Artificial Sequence
  Description of Artificial Sequence: Synthetic peptide
  XENP018306 vhCDR1
NYWMN

SEQ ID NO: 13728 - protein, 19 aa, Artificial Sequence
  Description of Artificial Sequence: Synthetic peptide
  XENP018306 vhCDR2
EIRLKSNNYATHYAEPVKG

SEQ ID NO: 13729 - protein, 11 aa, Artificial Sequence
  Description of Artificial Sequence: Synthetic peptide
  XENP018306 vhCDR3
YYGGYGGYFDV

SEQ ID NO: 13730 - protein, 214 aa, Artificial Sequence; identical to SEQ ID NO: 11550
  Description of Artificial Sequence: Synthetic polypeptide
  XENP018306 1G6_H1.201_L1_IgG1_PVA_/S267K Light Chain

SEQ ID NO: 13731 - protein, 107 aa, Artificial Sequence; identical to SEQ ID NO: 6247
  Description of Artificial Sequence: Synthetic polypeptide
  VL of XENP018306

SEQ ID NO: 13732 - protein, 11 aa, Artificial Sequence
  Description of Artificial Sequence: Synthetic peptide
  XENP018306 vlCDR1
RASQSVSNDVA

SEQ ID NO: 13733 - protein, 7 aa, Artificial Sequence
  Description of Artificial Sequence: Synthetic peptide
  XENP018306 vlCDR2
YASHRYT

SEQ ID NO: 13734 - protein, 9 aa, Artificial Sequence
  Description of Artificial Sequence: Synthetic peptide
  XENP018306 vlCDR3
QQDYSSPRT

SEQ ID NO: 13735 - protein, 451 aa, Artificial Sequence
  Description of Artificial Sequence: Synthetic polypeptide
  XENP018307 1G6_H1.202_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13736 - protein, 122 aa, Artificial Sequence; identical to SEQ ID NO: 8169
  Description of Artificial Sequence: Synthetic polypeptide
  VH of XENP018307

SEQ ID NO: 13737 - protein, 5 aa, Artificial Sequence
  Description of Artificial Sequence: Synthetic peptide
  XENP018307 vhCDR1
NYWMN

SEQ ID NO: 13738 - protein, 19 aa, Artificial Sequence
  Description of Artificial Sequence: Synthetic peptide
  XENP018307 vhCDR2
EIRLKSNNYATHYAEPVKG

SEQ ID NO: 13739 - protein, 11 aa, Artificial Sequence
  Description of Artificial Sequence: Synthetic peptide
  XENP018307 vhCDR3
YYGFYGGYFDV

SEQ ID NO: 13740 - protein, 214 aa, Artificial Sequence; identical to SEQ ID NO: 11550
  Description of Artificial Sequence: Synthetic polypeptide
  XENP018307 1G6_H1.202_L1_IgG1_PVA_/S267K Light Chain

SEQ ID NO: 13741 - protein, 107 aa, Artificial Sequence; identical to SEQ ID NO: 6247
  Description of Artificial Sequence: Synthetic polypeptide
  VL of XENP018307

SEQ ID NO: 13742 - protein, 11 aa, Artificial Sequence
  Description of Artificial Sequence: Synthetic peptide
  XENP018307 vlCDR1
RASQSVSNDVA

SEQ ID NO: 13743 - protein, 7 aa, Artificial Sequence
  Description of Artificial Sequence: Synthetic peptide
  XENP018307 vlCDR2
YASHRYT

SEQ ID NO: 13744 - protein, 9 aa, Artificial Sequence
  Description of Artificial Sequence: Synthetic peptide
  XENP018307 vlCDR3
QQDYSSPRT

SEQ ID NO: 13745 - protein, 451 aa, Artificial Sequence
  Description of Artificial Sequence: Synthetic polypeptide
  XENP018308 1G6_H1.203_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13746 - protein, 122 aa, Artificial Sequence; identical to SEQ ID NO: 8178
  Description of Artificial Sequence: Synthetic polypeptide
  VH of XENP018308

SEQ ID NO: 13747 - protein, 5 aa, Artificial Sequence
  Description of Artificial Sequence: Synthetic peptide
  XENP018308 vhCDR1
NYWMN

SEQ ID NO: 13748 - protein, 19 aa, Artificial Sequence
  Description of Artificial Sequence: Synthetic peptide
  XENP018308 vhCDR2
EIRLKSNNYATHYAEPVKG

SEQ ID NO: 13749 - protein, 11 aa, Artificial Sequence
  Description of Artificial Sequence: Synthetic peptide
  XENP018308 vhCDR3
YYGNFGGYFDV

SEQ ID NO: 13750 - protein, 214 aa, Artificial Sequence; identical to SEQ ID NO: 11550
  Description of Artificial Sequence: Synthetic polypeptide
  XENP018308 1G6_H1.203_L1_IgG1_PVA_/S267K Light Chain

SEQ ID NO: 13751 - protein, 107 aa, Artificial Sequence; identical to SEQ ID NO: 6247
  Description of Artificial Sequence: Synthetic polypeptide
  VL of XENP018308

SEQ ID NO: 13752 - protein, 11 aa, Artificial Sequence
  Description of Artificial Sequence: Synthetic peptide
  XENP018308 vlCDR1
RASQSVSNDVA

SEQ ID NO: 13753 - protein, 7 aa, Artificial Sequence
  Description of Artificial Sequence: Synthetic peptide
  XENP018308 vlCDR2
YASHRYT

SEQ ID NO: 13754 - protein, 9 aa, Artificial Sequence
  Description of Artificial Sequence: Synthetic peptide
  XENP018308 vlCDR3
QQDYSSPRT

SEQ ID NO: 13755 - protein, 451 aa, Artificial Sequence
  Description of Artificial Sequence: Synthetic polypeptide
  XENP018309 1G6_H1.204_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13756 - protein, 122 aa, Artificial Sequence; identical to SEQ ID NO: 8187
  Description of Artificial Sequence: Synthetic polypeptide
  VH of XENP018309

SEQ ID NO: 13757 - protein, 5 aa, Artificial Sequence
  Description of Artificial Sequence: Synthetic peptide
  XENP018309 vhCDR1
NYWMN

SEQ ID NO: 13758 - protein, 19 aa, Artificial Sequence
  Description of Artificial Sequence: Synthetic peptide
  XENP018309 vhCDR2
EIRLKSNNYATHYAEPVKG

SEQ ID NO: 13759 - protein, 11 aa, Artificial Sequence
  Description of Artificial Sequence: Synthetic peptide
  XENP018309 vhCDR3
YYGNHGGYFDV

SEQ ID NO: 13760 - protein, 214 aa, Artificial Sequence; identical to SEQ ID NO: 11550
  Description of Artificial Sequence: Synthetic polypeptide
  XENP018309 1G6_H1.204_L1_IgG1_PVA_/S267K Light Chain

SEQ ID NO: 13761 - protein, 107 aa, Artificial Sequence; identical to SEQ ID NO: 6247
  Description of Artificial Sequence: Synthetic polypeptide
  VL of XENP018309

SEQ ID NO: 13762 - protein, 11 aa, Artificial Sequence
  Description of Artificial Sequence: Synthetic peptide
  XENP018309 vlCDR1
RASQSVSNDVA

SEQ ID NO: 13763 - protein, 7 aa, Artificial Sequence
  Description of Artificial Sequence: Synthetic peptide
  XENP018309 vlCDR2
YASHRYT

SEQ ID NO: 13764 - protein, 9 aa, Artificial Sequence
  Description of Artificial Sequence: Synthetic peptide
  XENP018309 vlCDR3
QQDYSSPRT

SEQ ID NO: 13765 - protein, 451 aa, Artificial Sequence
  Description of Artificial Sequence: Synthetic polypeptide
  XENP018310 1G6_H1.205_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13766 - protein, 122 aa, Artificial Sequence; identical to SEQ ID NO: 8196
  Description of Artificial Sequence: Synthetic polypeptide
  VH of XENP018310

SEQ ID NO: 13767 - protein, 5 aa, Artificial Sequence
  Description of Artificial Sequence: Synthetic peptide
  XENP018310 vhCDR1
NYWMN

SEQ ID NO: 13768 - protein, 19 aa, Artificial Sequence
  Description of Artificial Sequence: Synthetic peptide
  XENP018310 vhCDR2
EIRLKSNNYATHYAEPVKG

SEQ ID NO: 13769 - protein, 11 aa, Artificial Sequence
  Description of Artificial Sequence: Synthetic peptide
  XENP018310 vhCDR3
YYGNLGGYFDV

SEQ ID NO: 13770 - protein, 214 aa, Artificial Sequence; identical to SEQ ID NO: 11550
  Description of Artificial Sequence: Synthetic polypeptide
  XENP018310 1G6_H1.205_L1_IgG1_PVA_/S267K Light Chain

SEQ ID NO: 13771 - protein, 107 aa, Artificial Sequence; identical to SEQ ID NO: 6247
  Description of Artificial Sequence: Synthetic polypeptide
  VL of XENP018310

SEQ ID NO: 13772 - protein, 11 aa, Artificial Sequence
  Description of Artificial Sequence: Synthetic peptide
  XENP018310 vlCDR1
RASQSVSNDVA

SEQ ID NO: 13773 - protein, 7 aa, Artificial Sequence
  Description of Artificial Sequence: Synthetic peptide
  XENP018310 vlCDR2
YASHRYT

SEQ ID NO: 13774 - protein, 9 aa, Artificial Sequence
  Description of Artificial Sequence: Synthetic peptide
  XENP018310 vlCDR3
QQDYSSPRT

SEQ ID NO: 13775 - protein, 451 aa, Artificial Sequence
  Description of Artificial Sequence: Synthetic polypeptide
  XENP018311 1G6_H1.206_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13776 - protein, 122 aa, Artificial Sequence; identical to SEQ ID NO: 8205
  Description of Artificial Sequence: Synthetic polypeptide
  VH of XENP018311

SEQ ID NO: 13777 - protein, 5 aa, Artificial Sequence
  Description of Artificial Sequence: Synthetic peptide
  XENP018311 vhCDR1
NYWMN

SEQ ID NO: 13778 - protein, 19 aa, Artificial Sequence
  Description of Artificial Sequence: Synthetic peptide
  XENP018311 vhCDR2
EIRLKSNNYATHYAEPVKG

SEQ ID NO: 13779 - protein, 11 aa, Artificial Sequence
  Description of Artificial Sequence: Synthetic peptide
  XENP018311 vhCDR3
YYGNWGGYFDV

SEQ ID NO: 13780 - protein, 214 aa, Artificial Sequence; identical to SEQ ID NO: 11550
  Description of Artificial Sequence: Synthetic polypeptide
  XENP018311 1G6_H1.206_L1_IgG1_PVA_/S267K Light Chain

SEQ ID NO: 13781 - protein, 107 aa, Artificial Sequence; identical to SEQ ID NO: 6247
  Description of Artificial Sequence: Synthetic polypeptide
  VL of XENP018311

SEQ ID NO: 13782 - protein, 11 aa, Artificial Sequence
  Description of Artificial Sequence: Synthetic peptide
  XENP018311 vlCDR1
RASQSVSNDVA

SEQ ID NO: 13783 - protein, 7 aa, Artificial Sequence
  Description of Artificial Sequence: Synthetic peptide
  XENP018311 vlCDR2
YASHRYT

SEQ ID NO: 13784 - protein, 9 aa, Artificial Sequence
  Description of Artificial Sequence: Synthetic peptide
  XENP018311 vlCDR3
QQDYSSPRT

SEQ ID NO: 13785 - protein, 451 aa, Artificial Sequence
  Description of Artificial Sequence: Synthetic polypeptide
  XENP018312 1G6_H1.207_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13786 - protein, 122 aa, Artificial Sequence; identical to SEQ ID NO: 8214
  Description of Artificial Sequence: Synthetic polypeptide
  VH of XENP018312

SEQ ID NO: 13787 - protein, 5 aa, Artificial Sequence
  Description of Artificial Sequence: Synthetic peptide
  XENP018312 vhCDR1
NYWMN

SEQ ID NO: 13788 - protein, 19 aa, Artificial Sequence
  Description of Artificial Sequence: Synthetic peptide
  XENP018312 vhCDR2
EIRLKSNNYATHYAEPVKG

SEQ ID NO: 13789 - protein, 11 aa, Artificial Sequence
  Description of Artificial Sequence: Synthetic peptide
  XENP018312 vhCDR3
YYGNVGGYFDV

SEQ ID NO: 13790 - protein, 214 aa, Artificial Sequence; identical to SEQ ID NO: 11550
  Description of Artificial Sequence: Synthetic polypeptide
  XENP018312 1G6_H1.207_L1_IgG1_PVA_/S267K Light Chain

SEQ ID NO: 13791 - protein, 107 aa, Artificial Sequence; identical to SEQ ID NO: 6247
  Description of Artificial Sequence: Synthetic polypeptide
  VL of XENP018312

SEQ ID NO: 13792 - protein, 11 aa, Artificial Sequence
  Description of Artificial Sequence: Synthetic peptide
  XENP018312 vlCDR1
RASQSVSNDVA

SEQ ID NO: 13793 - protein, 7 aa, Artificial Sequence
  Description of Artificial Sequence: Synthetic peptide
  XENP018312 vlCDR2
YASHRYT

SEQ ID NO: 13794 - protein, 9 aa, Artificial Sequence
  Description of Artificial Sequence: Synthetic peptide
  XENP018312 vlCDR3
QQDYSSPRT

SEQ ID NO: 13795 - protein, 451 aa, Artificial Sequence
  Description of Artificial Sequence: Synthetic polypeptide
  XENP018313 1G6_H1.208_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13796 - protein, 122 aa, Artificial Sequence; identical to SEQ ID NO: 8223
  Description of Artificial Sequence: Synthetic polypeptide
  VH of XENP018313

SEQ ID NO: 13797 - protein, 5 aa, Artificial Sequence
  Description of Artificial Sequence: Synthetic peptide
  XENP018313 vhCDR1
NYWMN

SEQ ID NO: 13798 - protein, 19 aa, Artificial Sequence
  Description of Artificial Sequence: Synthetic peptide
  XENP018313 vhCDR2
EIRLKSNNYATHYAEPVKG

SEQ ID NO: 13799 - protein, 11 aa, Artificial Sequence
  Description of Artificial Sequence: Synthetic peptide
  XENP018313 vhCDR3
YYGNAGGYFDV

SEQ ID NO: 13800 - protein, 214 aa, Artificial Sequence; identical to SEQ ID NO: 11550
  Description of Artificial Sequence: Synthetic polypeptide
  XENP018313 1G6_H1.208_L1_IgG1_PVA_/S267K Light Chain

SEQ ID NO: 13801 - protein, 107 aa, Artificial Sequence; identical to SEQ ID NO: 6247
  Description of Artificial Sequence: Synthetic polypeptide
  VL of XENP018313

SEQ ID NO: 13802 - protein, 11 aa, Artificial Sequence
  Description of Artificial Sequence: Synthetic peptide
  XENP018313 vlCDR1
RASQSVSNDVA

SEQ ID NO: 13803 - protein, 7 aa, Artificial Sequence
  Description of Artificial Sequence: Synthetic peptide
  XENP018313 vlCDR2
YASHRYT

SEQ ID NO: 13804 - protein, 9 aa, Artificial Sequence
  Description of Artificial Sequence: Synthetic peptide
  XENP018313 vlCDR3
QQDYSSPRT

SEQ ID NO: 13805 - protein, 451 aa, Artificial Sequence
  Description of Artificial Sequence: Synthetic polypeptide
  XENP018314 1G6_H1.209_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13806 - protein, 122 aa, Artificial Sequence; identical to SEQ ID NO: 8232
  Description of Artificial Sequence: Synthetic polypeptide
  VH of XENP018314

SEQ ID NO: 13807 - protein, 5 aa, Artificial Sequence
  Description of Artificial Sequence: Synthetic peptide
  XENP018314 vhCDR1
NYWMN

SEQ ID NO: 13808 - protein, 19 aa, Artificial Sequence
  Description of Artificial Sequence: Synthetic peptide
  XENP018314 vhCDR2
EIRLKSNNYATHYAEPVKG

SEQ ID NO: 13809 - protein, 11 aa, Artificial Sequence
  Description of Artificial Sequence: Synthetic peptide
  XENP018314 vhCDR3
YYGNQGGYFDV

SEQ ID NO: 13810 - protein, 214 aa, Artificial Sequence; identical to SEQ ID NO: 11550
  Description of Artificial Sequence: Synthetic polypeptide
  XENP018314 1G6_H1.209_L1_IgG1_PVA_/S267K Light Chain

SEQ ID NO: 13811 - protein, 107 aa, Artificial Sequence; identical to SEQ ID NO: 6247
  Description of Artificial Sequence: Synthetic polypeptide
  VL of XENP018314

SEQ ID NO: 13812 - protein, 11 aa, Artificial Sequence
  Description of Artificial Sequence: Synthetic peptide
  XENP018314 vlCDR1
RASQSVSNDVA

SEQ ID NO: 13813 - protein, 7 aa, Artificial Sequence
  Description of Artificial Sequence: Synthetic peptide
  XENP018314 vlCDR2
YASHRYT

SEQ ID NO: 13814 - protein, 9 aa, Artificial Sequence
  Description of Artificial Sequence: Synthetic peptide
  XENP018314 vlCDR3
QQDYSSPRT

SEQ ID NO: 13815 - protein, 451 aa, Artificial Sequence
  Description of Artificial Sequence: Synthetic polypeptide
  XENP018315 1G6_H1.210_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13816 - protein, 122 aa, Artificial Sequence; identical to SEQ ID NO: 8241
  Description of Artificial Sequence: Synthetic polypeptide
  VH of XENP018315

SEQ ID NO: 13817 - protein, 5 aa, Artificial Sequence
  Description of Artificial Sequence: Synthetic peptide
  XENP018315 vhCDR1
NYWMN

SEQ ID NO: 13818 - protein, 19 aa, Artificial Sequence
  Description of Artificial Sequence: Synthetic peptide
  XENP018315 vhCDR2
EIRLKSNNYATHYAEPVKG

SEQ ID NO: 13819 - protein, 11 aa, Artificial Sequence
  Description of Artificial Sequence: Synthetic peptide
  XENP018315 vhCDR3
YYGNEGGYFDV

SEQ ID NO: 13820 - protein, 214 aa, Artificial Sequence; identical to SEQ ID NO: 11550
  Description of Artificial Sequence: Synthetic polypeptide
  XENP018315 1G6_H1.210_L1_IgG1_PVA_/S267K Light Chain

SEQ ID NO: 13821 - protein, 107 aa, Artificial Sequence; identical to SEQ ID NO: 6247
  Description of Artificial Sequence: Synthetic polypeptide
  VL of XENP018315

SEQ ID NO: 13822 - protein, 11 aa, Artificial Sequence
  Description of Artificial Sequence: Synthetic peptide
  XENP018315 vlCDR1
RASQSVSNDVA

SEQ ID NO: 13823 - protein, 7 aa, Artificial Sequence
  Description of Artificial Sequence: Synthetic peptide
  XENP018315 vlCDR2
YASHRYT

SEQ ID NO: 13824 - protein, 9 aa, Artificial Sequence
  Description of Artificial Sequence: Synthetic peptide
  XENP018315 vlCDR3
QQDYSSPRT

SEQ ID NO: 13825 - protein, 451 aa, Artificial Sequence
  Description of Artificial Sequence: Synthetic polypeptide
  XENP018316 1G6_H1.211_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13826 - protein, 122 aa, Artificial Sequence; identical to SEQ ID NO: 8250
  Description of Artificial Sequence: Synthetic polypeptide
  VH of XENP018316

SEQ ID NO: 13827 - protein, 5 aa, Artificial Sequence
  Description of Artificial Sequence: Synthetic peptide
  XENP018316 vhCDR1
NYWMN

SEQ ID NO: 13828 - protein, 19 aa, Artificial Sequence
  Description of Artificial Sequence: Synthetic peptide
  XENP018316 vhCDR2
EIRLKSNNYATHYAEPVKG

SEQ ID NO: 13829 - protein, 11 aa, Artificial Sequence
  Description of Artificial Sequence: Synthetic peptide
  XENP018316 vhCDR3
YYGNKGGYFDV

SEQ ID NO: 13830 - protein, 214 aa, Artificial Sequence; identical to SEQ ID NO: 11550
  Description of Artificial Sequence: Synthetic polypeptide
  XENP018316 1G6_H1.211_L1_IgG1_PVA_/S267K Light Chain

SEQ ID NO: 13831 - protein, 107 aa, Artificial Sequence; identical to SEQ ID NO: 6247
  Description of Artificial Sequence: Synthetic polypeptide
  VL of XENP018316

SEQ ID NO: 13832 - protein, 11 aa, Artificial Sequence
  Description of Artificial Sequence: Synthetic peptide
  XENP018316 vlCDR1
RASQSVSNDVA

SEQ ID NO: 13833 - protein, 7 aa, Artificial Sequence
  Description of Artificial Sequence: Synthetic peptide
  XENP018316 vlCDR2
YASHRYT

SEQ ID NO: 13834 - protein, 9 aa, Artificial Sequence
  Description of Artificial Sequence: Synthetic peptide
  XENP018316 vlCDR3
QQDYSSPRT

SEQ ID NO: 13835 - protein, 451 aa, Artificial Sequence
  Description of Artificial Sequence: Synthetic polypeptide
  XENP018317 1G6_H1.212_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13836 - protein, 122 aa, Artificial Sequence; identical to SEQ ID NO: 8259
  Description of Artificial Sequence: Synthetic polypeptide
  VH of XENP018317

SEQ ID NO: 13837 - protein, 5 aa, Artificial Sequence
  Description of Artificial Sequence: Synthetic peptide
  XENP018317 vhCDR1
NYWMN

SEQ ID NO: 13838 - protein, 19 aa, Artificial Sequence
  Description of Artificial Sequence: Synthetic peptide
  XENP018317 vhCDR2
EIRLKSNNYATHYAEPVKG

SEQ ID NO: 13839 - protein, 11 aa, Artificial Sequence
  Description of Artificial Sequence: Synthetic peptide
  XENP018317 vhCDR3
YYGNYAGYFDV

SEQ ID NO: 13840 - protein, 214 aa, Artificial Sequence; identical to SEQ ID NO: 11550
  Description of Artificial Sequence: Synthetic polypeptide
  XENP018317 1G6_H1.212_L1_IgG1_PVA_/S267K Light Chain

SEQ ID NO: 13841 - protein, 107 aa, Artificial Sequence; identical to SEQ ID NO: 6247
  Description of Artificial Sequence: Synthetic polypeptide
  VL of XENP018317

SEQ ID NO: 13842 - protein, 11 aa, Artificial Sequence
  Description of Artificial Sequence: Synthetic peptide
  XENP018317 vlCDR1
RASQSVSNDVA

SEQ ID NO: 13843 - protein, 7 aa, Artificial Sequence
  Description of Artificial Sequence: Synthetic peptide
  XENP018317 vlCDR2
YASHRYT

SEQ ID NO: 13844 - protein, 9 aa, Artificial Sequence
  Description of Artificial Sequence: Synthetic peptide
  XENP018317 vlCDR3
QQDYSSPRT

SEQ ID NO: 13845 - protein, 451 aa, Artificial Sequence
  Description of Artificial Sequence: Synthetic polypeptide
  XENP018318 1G6_H1.213_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13846 - protein, 122 aa, Artificial Sequence; identical to SEQ ID NO: 8268
  Description of Artificial Sequence: Synthetic polypeptide
  VH of XENP018318

SEQ ID NO: 13847 - protein, 5 aa, Artificial Sequence
  Description of Artificial Sequence: Synthetic peptide
  XENP018318 vhCDR1
NYWMN

SEQ ID NO: 13848 - protein, 19 aa, Artificial Sequence
  Description of Artificial Sequence: Synthetic peptide
  XENP018318 vhCDR2
EIRLKSNNYATHYAEPVKG

SEQ ID NO: 13849 - protein, 11 aa, Artificial Sequence
  Description of Artificial Sequence: Synthetic peptide
  XENP018318 vhCDR3
YYGNYQGYFDV

SEQ ID NO: 13850 - protein, 214 aa, Artificial Sequence; identical to SEQ ID NO: 11550
  Description of Artificial Sequence: Synthetic polypeptide
  XENP018318 1G6_H1.213_L1_IgG1_PVA_/S267K Light Chain

SEQ ID NO: 13851 - protein, 107 aa, Artificial Sequence; identical to SEQ ID NO: 6247
  Description of Artificial Sequence: Synthetic polypeptide
  VL of XENP018318

SEQ ID NO: 13852 - protein, 11 aa, Artificial Sequence
  Description of Artificial Sequence: Synthetic peptide
  XENP018318 vlCDR1
RASQSVSNDVA

SEQ ID NO: 13853 - protein, 7 aa, Artificial Sequence
  Description of Artificial Sequence: Synthetic peptide
  XENP018318 vlCDR2
YASHRYT

SEQ ID NO: 13854 - protein, 9 aa, Artificial Sequence
  Description of Artificial Sequence: Synthetic peptide
  XENP018318 vlCDR3
QQDYSSPRT

SEQ ID NO: 13855 - protein, 451 aa, Artificial Sequence
  Description of Artificial Sequence: Synthetic polypeptide
  XENP018319 1G6_H1.214_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13856 - protein, 122 aa, Artificial Sequence; identical to SEQ ID NO: 8277
  Description of Artificial Sequence: Synthetic polypeptide
  VH of XENP018319

SEQ ID NO: 13857 - protein, 5 aa, Artificial Sequence
  Description of Artificial Sequence: Synthetic peptide
  XENP018319 vhCDR1
NYWMN

SEQ ID NO: 13858 - protein, 19 aa, Artificial Sequence
  Description of Artificial Sequence: Synthetic peptide
  XENP018319 vhCDR2
EIRLKSNNYATHYAEPVKG

SEQ ID NO: 13859 - protein, 11 aa, Artificial Sequence
  Description of Artificial Sequence: Synthetic peptide
  XENP018319 vhCDR3
YYGNYHGYFDV

SEQ ID NO: 13860 - protein, 214 aa, Artificial Sequence; identical to SEQ ID NO: 11550
  Description of Artificial Sequence: Synthetic polypeptide
  XENP018319 1G6_H1.214_L1_IgG1_PVA_/S267K Light Chain

SEQ ID NO: 13861 - protein, 107 aa, Artificial Sequence; identical to SEQ ID NO: 6247
  Description of Artificial Sequence: Synthetic polypeptide
  VL of XENP018319

SEQ ID NO: 13862 - protein, 11 aa, Artificial Sequence
  Description of Artificial Sequence: Synthetic peptide
  XENP018319 vlCDR1
RASQSVSNDVA

SEQ ID NO: 13863 - protein, 7 aa, Artificial Sequence
  Description of Artificial Sequence: Synthetic peptide
  XENP018319 vlCDR2
YASHRYT

SEQ ID NO: 13864 - protein, 9 aa, Artificial Sequence
  Description of Artificial Sequence: Synthetic peptide
  XENP018319 vlCDR3
QQDYSSPRT

SEQ ID NO: 13865 - protein, 451 aa, Artificial Sequence
  Description of Artificial Sequence: Synthetic polypeptide
  XENP018320 1G6_H1.215_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13866 - protein, 122 aa, Artificial Sequence; identical to SEQ ID NO: 8286
  Description of Artificial Sequence: Synthetic polypeptide
  VH of XENP018320

SEQ ID NO: 13867 - protein, 5 aa, Artificial Sequence
  Description of Artificial Sequence: Synthetic peptide
  XENP018320 vhCDR1
NYWMN

SEQ ID NO: 13868 - protein, 19 aa, Artificial Sequence
  Description of Artificial Sequence: Synthetic peptide
  XENP018320 vhCDR2
EIRLKSNNYATHYAEPVKG

SEQ ID NO: 13869 - protein, 11 aa, Artificial Sequence
  Description of Artificial Sequence: Synthetic peptide
  XENP018320 vhCDR3
YYGNYDGYFDV

SEQ ID NO: 13870 - protein, 214 aa, Artificial Sequence; identical to SEQ ID NO: 11550
  Description of Artificial Sequence: Synthetic polypeptide
  XENP018320 1G6_H1.215_L1_IgG1_PVA_/S267K Light Chain

SEQ ID NO: 13871 - protein, 107 aa, Artificial Sequence; identical to SEQ ID NO: 6247
  Description of Artificial Sequence: Synthetic polypeptide
  VL of XENP018320

SEQ ID NO: 13872 - protein, 11 aa, Artificial Sequence
  Description of Artificial Sequence: Synthetic peptide
  XENP018320 vlCDR1
RASQSVSNDVA

SEQ ID NO: 13873 - protein, 7 aa, Artificial Sequence
  Description of Artificial Sequence: Synthetic peptide
  XENP018320 vlCDR2
YASHRYT

SEQ ID NO: 13874 - protein, 9 aa, Artificial Sequence
  Description of Artificial Sequence: Synthetic peptide
  XENP018320 vlCDR3
QQDYSSPRT

SEQ ID NO: 13875 - protein, 451 aa, Artificial Sequence
  Description of Artificial Sequence: Synthetic polypeptide
  XENP018321 1G6_H1.216_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13876 - protein, 122 aa, Artificial Sequence; identical to SEQ ID NO: 8295
  Description of Artificial Sequence: Synthetic polypeptide
  VH of XENP018321

SEQ ID NO: 13877 - protein, 5 aa, Artificial Sequence
  Description of Artificial Sequence: Synthetic peptide
  XENP018321 vhCDR1
NYWMN

SEQ ID NO: 13878 - protein, 19 aa, Artificial Sequence
  Description of Artificial Sequence: Synthetic peptide
  XENP018321 vhCDR2
EIRLKSNNYATHYAEPVKG

SEQ ID NO: 13879 - protein, 11 aa, Artificial Sequence
  Description of Artificial Sequence: Synthetic peptide
  XENP018321 vhCDR3
YYGNYKGYFDV

SEQ ID NO: 13880 - protein, 214 aa, Artificial Sequence; identical to SEQ ID NO: 11550
  Description of Artificial Sequence: Synthetic polypeptide
  XENP018321 1G6_H1.216_L1_IgG1_PVA_/S267K Light Chain

SEQ ID NO: 13881 - protein, 107 aa, Artificial Sequence; identical to SEQ ID NO: 6247
  Description of Artificial Sequence: Synthetic polypeptide
  VL of XENP018321

SEQ ID NO: 13882 - protein, 11 aa, Artificial Sequence
  Description of Artificial Sequence: Synthetic peptide
  XENP018321 vlCDR1
RASQSVSNDVA

SEQ ID NO: 13883 - protein, 7 aa, Artificial Sequence
  Description of Artificial Sequence: Synthetic peptide
  XENP018321 vlCDR2
YASHRYT

SEQ ID NO: 13884 - protein, 9 aa, Artificial Sequence
  Description of Artificial Sequence: Synthetic peptide
  XENP018321 vlCDR3
QQDYSSPRT

SEQ ID NO: 13885 - protein, 451 aa, Artificial Sequence
  Description of Artificial Sequence: Synthetic polypeptide
  XENP018322 1G6_H1.217_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13886 - protein, 122 aa, Artificial Sequence; identical to SEQ ID NO: 8304
  Description of Artificial Sequence: Synthetic polypeptide
  VH of XENP018322

SEQ ID NO: 13887 - protein, 5 aa, Artificial Sequence
  Description of Artificial Sequence: Synthetic peptide
  XENP018322 vhCDR1
NYWMN

SEQ ID NO: 13888 - protein, 19 aa, Artificial Sequence
  Description of Artificial Sequence: Synthetic peptide
  XENP018322 vhCDR2
EIRLKSNNYATHYAEPVKG

SEQ ID NO: 13889 - protein, 11 aa, Artificial Sequence
  Description of Artificial Sequence: Synthetic peptide
  XENP018322 vhCDR3
YYGNYLGYFDV

SEQ ID NO: 13890 - protein, 214 aa, Artificial Sequence; identical to SEQ ID NO: 11550
  Description of Artificial Sequence: Synthetic polypeptide
  XENP018322 1G6_H1.217_L1_IgG1_PVA_/S267K Light Chain

SEQ ID NO: 13891 - protein, 107 aa, Artificial Sequence; identical to SEQ ID NO: 6247
  Description of Artificial Sequence: Synthetic polypeptide
  VL of XENP018322

SEQ ID NO: 13892 - protein, 11 aa, Artificial Sequence
  Description of Artificial Sequence: Synthetic peptide
  XENP018322 vlCDR1
RASQSVSNDVA

SEQ ID NO: 13893 - protein, 7 aa, Artificial Sequence
  Description of Artificial Sequence: Synthetic peptide
  XENP018322 vlCDR2
YASHRYT

SEQ ID NO: 13894 - protein, 9 aa, Artificial Sequence
  Description of Artificial Sequence: Synthetic peptide
  XENP018322 vlCDR3
QQDYSSPRT

SEQ ID NO: 13895 - protein, 451 aa, Artificial Sequence
  Description of Artificial Sequence: Synthetic polypeptide
  XENP018323 1G6_H1.218_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13896 - protein, 122 aa, Artificial Sequence; identical to SEQ ID NO: 8313
  Description of Artificial Sequence: Synthetic polypeptide
  VH of XENP018323

SEQ ID NO: 13897 - protein, 5 aa, Artificial Sequence
  Description of Artificial Sequence: Synthetic peptide
  XENP018323 vhCDR1
NYWMN

SEQ ID NO: 13898 - protein, 19 aa, Artificial Sequence
  Description of Artificial Sequence: Synthetic peptide
  XENP018323 vhCDR2
EIRLKSNNYATHYAEPVKG

SEQ ID NO: 13899 - protein, 11 aa, Artificial Sequence
  Description of Artificial Sequence: Synthetic peptide
  XENP018323 vhCDR3
YYGNYFGYFDV

SEQ ID NO: 13900 - protein, 214 aa, Artificial Sequence; identical to SEQ ID NO: 11550
  Description of Artificial Sequence: Synthetic polypeptide
  XENP018323 1G6_H1.218_L1_IgG1_PVA_/S267K Light Chain

SEQ ID NO: 13901 - protein, 107 aa, Artificial Sequence; identical to SEQ ID NO: 6247
  Description of Artificial Sequence: Synthetic polypeptide
  VL of XENP018323

SEQ ID NO: 13902 - protein, 11 aa, Artificial Sequence
  Description of Artificial Sequence: Synthetic peptide
  XENP018323 vlCDR1
RASQSVSNDVA

SEQ ID NO: 13903 - protein, 7 aa, Artificial Sequence
  Description of Artificial Sequence: Synthetic peptide
  XENP018323 vlCDR2
YASHRYT

SEQ ID NO: 13904 - protein, 9 aa, Artificial Sequence
  Description of Artificial Sequence: Synthetic peptide
  XENP018323 vlCDR3
QQDYSSPRT

SEQ ID NO: 13905 - protein, 451 aa, Artificial Sequence
  Description of Artificial Sequence: Synthetic polypeptide
  XENP018324 1G6_H1.219_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13906 - protein, 122 aa, Artificial Sequence; identical to SEQ ID NO: 8322
  Description of Artificial Sequence: Synthetic polypeptide
  VH of XENP018324

SEQ ID NO: 13907 - protein, 5 aa, Artificial Sequence
  Description of Artificial Sequence: Synthetic peptide
  XENP018324 vhCDR1
NYWMN

SEQ ID NO: 13908 - protein, 19 aa, Artificial Sequence
  Description of Artificial Sequence: Synthetic peptide
  XENP018324 vhCDR2
EIRLKSNNYATHYAEPVKG

SEQ ID NO: 13909 - protein, 11 aa, Artificial Sequence
  Description of Artificial Sequence: Synthetic peptide
  XENP018324 vhCDR3
YYGNYGAYFDV

SEQ ID NO: 13910 - protein, 214 aa, Artificial Sequence; identical to SEQ ID NO: 11550
  Description of Artificial Sequence: Synthetic polypeptide
  XENP018324 1G6_H1.219_L1_IgG1_PVA_/S267K Light Chain

SEQ ID NO: 13911 - protein, 107 aa, Artificial Sequence; identical to SEQ ID NO: 6247
  Description of Artificial Sequence: Synthetic polypeptide
  VL of XENP018324

SEQ ID NO: 13912 - protein, 11 aa, Artificial Sequence
  Description of Artificial Sequence: Synthetic peptide
  XENP018324 vlCDR1
RASQSVSNDVA

SEQ ID NO: 13913 - protein, 7 aa, Artificial Sequence
  Description of Artificial Sequence: Synthetic peptide
  XENP018324 vlCDR2
YASHRYT

SEQ ID NO: 13914 - protein, 9 aa, Artificial Sequence
  Description of Artificial Sequence: Synthetic peptide
  XENP018324 vlCDR3
QQDYSSPRT

SEQ ID NO: 13915 - protein, 451 aa, Artificial Sequence
  Description of Artificial Sequence: Synthetic polypeptide
  XENP018325 1G6_H1.220_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13916 - protein, 122 aa, Artificial Sequence; identical to SEQ ID NO: 8331
  Description of Artificial Sequence: Synthetic polypeptide
  VH of XENP018325

SEQ ID NO: 13917 - protein, 5 aa, Artificial Sequence
  Description of Artificial Sequence: Synthetic peptide
  XENP018325 vhCDR1
NYWMN

SEQ ID NO: 13918 - protein, 19 aa, Artificial Sequence
  Description of Artificial Sequence: Synthetic peptide
  XENP018325 vhCDR2
EIRLKSNNYATHYAEPVKG

SEQ ID NO: 13919 - protein, 11 aa, Artificial Sequence
  Description of Artificial Sequence: Synthetic peptide
  XENP018325 vhCDR3
YYGNYGSYFDV

SEQ ID NO: 13920 - protein, 214 aa, Artificial Sequence; identical to SEQ ID NO: 11550
  Description of Artificial Sequence: Synthetic polypeptide
  XENP018325 1G6_H1.220_L1_IgG1_PVA_/S267K Light Chain

SEQ ID NO: 13921 - protein, 107 aa, Artificial Sequence; identical to SEQ ID NO: 6247
  Description of Artificial Sequence: Synthetic polypeptide
  VL of XENP018325

SEQ ID NO: 13922 - protein, 11 aa, Artificial Sequence
  Description of Artificial Sequence: Synthetic peptide
  XENP018325 vlCDR1
RASQSVSNDVA

SEQ ID NO: 13923 - protein, 7 aa, Artificial Sequence
  Description of Artificial Sequence: Synthetic peptide
  XENP018325 vlCDR2
YASHRYT

SEQ ID NO: 13924 - protein, 9 aa, Artificial Sequence
  Description of Artificial Sequence: Synthetic peptide
  XENP018325 vlCDR3
QQDYSSPRT

SEQ ID NO: 13925 - protein, 451 aa, Artificial Sequence
  Description of Artificial Sequence: Synthetic polypeptide
  XENP018326 1G6_H1.221_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13926 - protein, 122 aa, Artificial Sequence; identical to SEQ ID NO: 8340
  Description of Artificial Sequence: Synthetic polypeptide
  VH of XENP018326

SEQ ID NO: 13927 - protein, 5 aa, Artificial Sequence
  Description of Artificial Sequence: Synthetic peptide
  XENP018326 vhCDR1
NYWMN

SEQ ID NO: 13928 - protein, 19 aa, Artificial Sequence
  Description of Artificial Sequence: Synthetic peptide
  XENP018326 vhCDR2
EIRLKSNNYATHYAEPVKG

SEQ ID NO: 13929 - protein, 11 aa, Artificial Sequence
  Description of Artificial Sequence: Synthetic peptide
  XENP018326 vhCDR3
YYGNYGTYFDV

SEQ ID NO: 13930 - protein, 214 aa, Artificial Sequence; identical to SEQ ID NO: 11550
  Description of Artificial Sequence: Synthetic polypeptide
  XENP018326 1G6_H1.221_L1_IgG1_PVA_/S267K Light Chain

SEQ ID NO: 13931 - protein, 107 aa, Artificial Sequence; identical to SEQ ID NO: 6247
  Description of Artificial Sequence: Synthetic polypeptide
  VL of XENP018326

SEQ ID NO: 13932 - protein, 11 aa, Artificial Sequence
  Description of Artificial Sequence: Synthetic peptide
  XENP018326 vlCDR1
RASQSVSNDVA

SEQ ID NO: 13933 - protein, 7 aa, Artificial Sequence
  Description of Artificial Sequence: Synthetic peptide
  XENP018326 vlCDR2
YASHRYT

SEQ ID NO: 13934 - protein, 9 aa, Artificial Sequence
  Description of Artificial Sequence: Synthetic peptide
  XENP018326 vlCDR3
QQDYSSPRT

SEQ ID NO: 13935 - protein, 451 aa, Artificial Sequence
  Description of Artificial Sequence: Synthetic polypeptide
  XENP018327 1G6_H1.222_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13936 - protein, 122 aa, Artificial Sequence; identical to SEQ ID NO: 8349
  Description of Artificial Sequence: Synthetic polypeptide
  VH of XENP018327

SEQ ID NO: 13937 - protein, 5 aa, Artificial Sequence
  Description of Artificial Sequence: Synthetic peptide
  XENP018327 vhCDR1
NYWMN

SEQ ID NO: 13938 - protein, 19 aa, Artificial Sequence
  Description of Artificial Sequence: Synthetic peptide
  XENP018327 vhCDR2
EIRLKSNNYATHYAEPVKG

SEQ ID NO: 13939 - protein, 11 aa, Artificial Sequence
  Description of Artificial Sequence: Synthetic peptide
  XENP018327 vhCDR3
YYGNYGNYFDV

SEQ ID NO: 13940 - protein, 214 aa, Artificial Sequence; identical to SEQ ID NO: 11550
  Description of Artificial Sequence: Synthetic polypeptide
  XENP018327 1G6_H1.222_L1_IgG1_PVA_/S267K Light Chain

SEQ ID NO: 13941 - protein, 107 aa, Artificial Sequence; identical to SEQ ID NO: 6247
  Description of Artificial Sequence: Synthetic polypeptide
  VL of XENP018327

SEQ ID NO: 13942 - protein, 11 aa, Artificial Sequence
  Description of Artificial Sequence: Synthetic peptide
  XENP018327 vlCDR1
RASQSVSNDVA

SEQ ID NO: 13943 - protein, 7 aa, Artificial Sequence
  Description of Artificial Sequence: Synthetic peptide
  XENP018327 vlCDR2
YASHRYT

SEQ ID NO: 13944 - protein, 9 aa, Artificial Sequence
  Description of Artificial Sequence: Synthetic peptide
  XENP018327 vlCDR3
QQDYSSPRT

SEQ ID NO: 13945 - protein, 451 aa, Artificial Sequence
  Description of Artificial Sequence: Synthetic polypeptide
  XENP018328 1G6_H1.223_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13946 - protein, 122 aa, Artificial Sequence; identical to SEQ ID NO: 8358
  Description of Artificial Sequence: Synthetic polypeptide
  VH of XENP018328

SEQ ID NO: 13947 - protein, 5 aa, Artificial Sequence
  Description of Artificial Sequence: Synthetic peptide
  XENP018328 vhCDR1
NYWMN

SEQ ID NO: 13948 - protein, 19 aa, Artificial Sequence
  Description of Artificial Sequence: Synthetic peptide
  XENP018328 vhCDR2
EIRLKSNNYATHYAEPVKG

SEQ ID NO: 13949 - protein, 11 aa, Artificial Sequence
  Description of Artificial Sequence: Synthetic peptide
  XENP018328 vhCDR3
YYGNYGHYFDV

SEQ ID NO: 13950 - protein, 214 aa, Artificial Sequence; identical to SEQ ID NO: 11550
  Description of Artificial Sequence: Synthetic polypeptide
  XENP018328 1G6_H1.223_L1_IgG1_PVA_/S267K Light Chain

SEQ ID NO: 13951 - protein, 107 aa, Artificial Sequence; identical to SEQ ID NO: 6247
  Description of Artificial Sequence: Synthetic polypeptide
  VL of XENP018328

SEQ ID NO: 13952 - protein, 11 aa, Artificial Sequence
  Description of Artificial Sequence: Synthetic peptide
  XENP018328 vlCDR1
RASQSVSNDVA

SEQ ID NO: 13953 - protein, 7 aa, Artificial Sequence
  Description of Artificial Sequence: Synthetic peptide
  XENP018328 vlCDR2
YASHRYT

SEQ ID NO: 13954 - protein, 9 aa, Artificial Sequence
  Description of Artificial Sequence: Synthetic peptide
  XENP018328 vlCDR3
QQDYSSPRT

SEQ ID NO: 13955 - protein, 451 aa, Artificial Sequence
  Description of Artificial Sequence: Synthetic polypeptide
  XENP018329 1G6_H1.224_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13956 - protein, 122 aa, Artificial Sequence; identical to SEQ ID NO: 8367
  Description of Artificial Sequence: Synthetic polypeptide
  VH of XENP018329

SEQ ID NO: 13957 - protein, 5 aa, Artificial Sequence
  Description of Artificial Sequence: Synthetic peptide
  XENP018329 vhCDR1
NYWMN

SEQ ID NO: 13958 - protein, 19 aa, Artificial Sequence
  Description of Artificial Sequence: Synthetic peptide
  XENP018329 vhCDR2
EIRLKSNNYATHYAEPVKG

SEQ ID NO: 13959 - protein, 11 aa, Artificial Sequence
  Description of Artificial Sequence: Synthetic peptide
  XENP018329 vhCDR3
YYGNYGDYFDV

SEQ ID NO: 13960 - protein, 214 aa, Artificial Sequence; identical to SEQ ID NO: 11550
  Description of Artificial Sequence: Synthetic polypeptide
  XENP018329 1G6_H1.224_L1_IgG1_PVA_/S267K Light Chain

SEQ ID NO: 13961 - protein, 107 aa, Artificial Sequence; identical to SEQ ID NO: 6247
  Description of Artificial Sequence: Synthetic polypeptide
  VL of XENP018329

SEQ ID NO: 13962 - protein, 11 aa, Artificial Sequence
  Description of Artificial Sequence: Synthetic peptide
  XENP018329 vlCDR1
RASQSVSNDVA

SEQ ID NO: 13963 - protein, 7 aa, Artificial Sequence
  Description of Artificial Sequence: Synthetic peptide
  XENP018329 vlCDR2
YASHRYT

SEQ ID NO: 13964 - protein, 9 aa, Artificial Sequence
  Description of Artificial Sequence: Synthetic peptide
  XENP018329 vlCDR3
QQDYSSPRT

SEQ ID NO: 13965 - protein, 451 aa, Artificial Sequence
  Description of Artificial Sequence: Synthetic polypeptide
  XENP018330 1G6_H1.225_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13966 - protein, 122 aa, Artificial Sequence; identical to SEQ ID NO: 8376
  Description of Artificial Sequence: Synthetic polypeptide
  VH of XENP018330

SEQ ID NO: 13967 - protein, 5 aa, Artificial Sequence
  Description of Artificial Sequence: Synthetic peptide
  XENP018330 vhCDR1
NYWMN

SEQ ID NO: 13968 - protein, 19 aa, Artificial Sequence
  Description of Artificial Sequence: Synthetic peptide
  XENP018330 vhCDR2
EIRLKSNNYATHYAEPVKG

SEQ ID NO: 13969 - protein, 11 aa, Artificial Sequence
  Description of Artificial Sequence: Synthetic peptide
  XENP018330 vhCDR3
YYGNYGKYFDV

SEQ ID NO: 13970 - protein, 214 aa, Artificial Sequence; identical to SEQ ID NO: 11550
  Description of Artificial Sequence: Synthetic polypeptide
  XENP018330 1G6_H1.225_L1_IgG1_PVA_/S267K Light Chain

SEQ ID NO: 13971 - protein, 107 aa, Artificial Sequence; identical to SEQ ID NO: 6247
  Description of Artificial Sequence: Synthetic polypeptide
  VL of XENP018330

SEQ ID NO: 13972 - protein, 11 aa, Artificial Sequence
  Description of Artificial Sequence: Synthetic peptide
  XENP018330 vlCDR1
RASQSVSNDVA

SEQ ID NO: 13973 - protein, 7 aa, Artificial Sequence
  Description of Artificial Sequence: Synthetic peptide
  XENP018330 vlCDR2
YASHRYT

SEQ ID NO: 13974 - protein, 9 aa, Artificial Sequence
  Description of Artificial Sequence: Synthetic peptide
  XENP018330 vlCDR3
QQDYSSPRT

SEQ ID NO: 13975 - protein, 451 aa, Artificial Sequence
  Description of Artificial Sequence: Synthetic polypeptide
  XENP018331 1G6_H1.226_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13976 - protein, 122 aa, Artificial Sequence; identical to SEQ ID NO: 8385
  Description of Artificial Sequence: Synthetic polypeptide
  VH of XENP018331

SEQ ID NO: 13977 - protein, 5 aa, Artificial Sequence
  Description of Artificial Sequence: Synthetic peptide
  XENP018331 vhCDR1
NYWMN

SEQ ID NO: 13978 - protein, 19 aa, Artificial Sequence
  Description of Artificial Sequence: Synthetic peptide
  XENP018331 vhCDR2
EIRLKSNNYATHYAEPVKG

SEQ ID NO: 13979 - protein, 11 aa, Artificial Sequence
  Description of Artificial Sequence: Synthetic peptide
  XENP018331 vhCDR3
YYGNYGLYFDV

SEQ ID NO: 13980 - protein, 214 aa, Artificial Sequence; identical to SEQ ID NO: 11550
  Description of Artificial Sequence: Synthetic polypeptide
  XENP018331 1G6_H1.226_L1_IgG1_PVA_/S267K Light Chain

SEQ ID NO: 13981 - protein, 107 aa, Artificial Sequence; identical to SEQ ID NO: 6247
  Description of Artificial Sequence: Synthetic polypeptide
  VL of XENP018331

SEQ ID NO: 13982 - protein, 11 aa, Artificial Sequence
  Description of Artificial Sequence: Synthetic peptide
  XENP018331 vlCDR1
RASQSVSNDVA

SEQ ID NO: 13983 - protein, 7 aa, Artificial Sequence
  Description of Artificial Sequence: Synthetic peptide
  XENP018331 vlCDR2
YASHRYT

SEQ ID NO: 13984 - protein, 9 aa, Artificial Sequence
  Description of Artificial Sequence: Synthetic peptide
  XENP018331 vlCDR3
QQDYSSPRT

SEQ ID NO: 13985 - protein, 451 aa, Artificial Sequence
  Description of Artificial Sequence: Synthetic polypeptide
  XENP018332 1G6_H1.227_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13986 - protein, 122 aa, Artificial Sequence; identical to SEQ ID NO: 8394
  Description of Artificial Sequence: Synthetic polypeptide
  VH of XENP018332

SEQ ID NO: 13987 - protein, 5 aa, Artificial Sequence
  Description of Artificial Sequence: Synthetic peptide
  XENP018332 vhCDR1
NYWMN

SEQ ID NO: 13988 - protein, 19 aa, Artificial Sequence
  Description of Artificial Sequence: Synthetic peptide
  XENP018332 vhCDR2
EIRLKSNNYATHYAEPVKG

SEQ ID NO: 13989 - protein, 11 aa, Artificial Sequence
  Description of Artificial Sequence: Synthetic peptide
  XENP018332 vhCDR3
YYGNYGFYFDV

SEQ ID NO: 13990 - protein, 214 aa, Artificial Sequence; identical to SEQ ID NO: 11550
  Description of Artificial Sequence: Synthetic polypeptide
  XENP018332 1G6_H1.227_L1_IgG1_PVA_/S267K Light Chain

SEQ ID NO: 13991 - protein, 107 aa, Artificial Sequence; identical to SEQ ID NO: 6247
  Description of Artificial Sequence: Synthetic polypeptide
  VL of XENP018332

SEQ ID NO: 13992 - protein, 11 aa, Artificial Sequence
  Description of Artificial Sequence: Synthetic peptide
  XENP018332 vlCDR1
RASQSVSNDVA

SEQ ID NO: 13993 - protein, 7 aa, Artificial Sequence
  Description of Artificial Sequence: Synthetic peptide
  XENP018332 vlCDR2
YASHRYT

SEQ ID NO: 13994 - protein, 9 aa, Artificial Sequence
  Description of Artificial Sequence: Synthetic peptide
  XENP018332 vlCDR3
QQDYSSPRT

SEQ ID NO: 13995 - protein, 451 aa, Artificial Sequence
  Description of Artificial Sequence: Synthetic polypeptide
  XENP018333 1G6_H1.228_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13996 - protein, 122 aa, Artificial Sequence; identical to SEQ ID NO: 8403
  Description of Artificial Sequence: Synthetic polypeptide
  VH of XENP018333

SEQ ID NO: 13997 - protein, 5 aa, Artificial Sequence
  Description of Artificial Sequence: Synthetic peptide
  XENP018333 vhCDR1
NYWMN

SEQ ID NO: 13998 - protein, 19 aa, Artificial Sequence
  Description of Artificial Sequence: Synthetic peptide
  XENP018333 vhCDR2
EIRLKSNNYATHYAEPVKG

SEQ ID NO: 13999 - protein, 11 aa, Artificial Sequence
  Description of Artificial Sequence: Synthetic peptide
  XENP018333 vhCDR3
YYGNYGGFFDV

SEQ ID NO: 14000 - protein, 214 aa, Artificial Sequence; identical to SEQ ID NO: 11550
  Description of Artificial Sequence: Synthetic polypeptide
  XENP018333 1G6_H1.228_L1_IgG1_PVA_/S267K Light Chain

SEQ ID NO: 14001 - protein, 107 aa, Artificial Sequence; identical to SEQ ID NO: 6247
  Description of Artificial Sequence: Synthetic polypeptide
  VL of XENP018333

SEQ ID NO: 14002 - protein, 11 aa, Artificial Sequence
  Description of Artificial Sequence: Synthetic peptide
  XENP018333 vlCDR1
RASQSVSNDVA

SEQ ID NO: 14003 - protein, 7 aa, Artificial Sequence
  Description of Artificial Sequence: Synthetic peptide
  XENP018333 vlCDR2
YASHRYT

SEQ ID NO: 14004 - protein, 9 aa, Artificial Sequence
  Description of Artificial Sequence: Synthetic peptide
  XENP018333 vlCDR3
QQDYSSPRT

SEQ ID NO: 14005 - protein, 451 aa, Artificial Sequence
  Description of Artificial Sequence: Synthetic polypeptide
  XENP018334 1G6_H1.229_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14006 - protein, 122 aa, Artificial Sequence; identical to SEQ ID NO: 8412
  Description of Artificial Sequence: Synthetic polypeptide
  VH of XENP018334

SEQ ID NO: 14007 - protein, 5 aa, Artificial Sequence
  Description of Artificial Sequence: Synthetic peptide
  XENP018334 vhCDR1
NYWMN

SEQ ID NO: 14008 - protein, 19 aa, Artificial Sequence
  Description of Artificial Sequence: Synthetic peptide
  XENP018334 vhCDR2
EIRLKSNNYATHYAEPVKG

SEQ ID NO: 14009 - protein, 11 aa, Artificial Sequence
  Description of Artificial Sequence: Synthetic peptide
  XENP018334 vhCDR3
YYGNYGGHFDV

SEQ ID NO: 14010 - protein, 214 aa, Artificial Sequence; identical to SEQ ID NO: 11550
  Description of Artificial Sequence: Synthetic polypeptide
  XENP018334 1G6_H1.229_L1_IgG1_PVA_/S267K Light Chain

SEQ ID NO: 14011 - protein, 107 aa, Artificial Sequence; identical to SEQ ID NO: 6247
  Description of Artificial Sequence: Synthetic polypeptide
  VL of XENP018334

SEQ ID NO: 14012 - protein, 11 aa, Artificial Sequence
  Description of Artificial Sequence: Synthetic peptide
  XENP018334 vlCDR1
RASQSVSNDVA

SEQ ID NO: 14013 - protein, 7 aa, Artificial Sequence
  Description of Artificial Sequence: Synthetic peptide
  XENP018334 vlCDR2
YASHRYT

SEQ ID NO: 14014 - protein, 9 aa, Artificial Sequence
  Description of Artificial Sequence: Synthetic peptide
  XENP018334 vlCDR3
QQDYSSPRT

SEQ ID NO: 14015 - protein, 451 aa, Artificial Sequence
  Description of Artificial Sequence: Synthetic polypeptide
  XENP018335 1G6_H1.230_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14016 - protein, 122 aa, Artificial Sequence; identical to SEQ ID NO: 8421
  Description of Artificial Sequence: Synthetic polypeptide
  VH of XENP018335

SEQ ID NO: 14017 - protein, 5 aa, Artificial Sequence
  Description of Artificial Sequence: Synthetic peptide
  XENP018335 vhCDR1
NYWMN

SEQ ID NO: 14018 - protein, 19 aa, Artificial Sequence
  Description of Artificial Sequence: Synthetic peptide
  XENP018335 vhCDR2
EIRLKSNNYATHYAEPVKG

SEQ ID NO: 14019 - protein, 11 aa, Artificial Sequence
  Description of Artificial Sequence: Synthetic peptide
  XENP018335 vhCDR3
YYGNYGGLFDV

SEQ ID NO: 14020 - protein, 214 aa, Artificial Sequence; identical to SEQ ID NO: 11550
  Description of Artificial Sequence: Synthetic polypeptide
  XENP018335 1G6_H1.230_L1_IgG1_PVA_/S267K Light Chain

SEQ ID NO: 14021 - protein, 107 aa, Artificial Sequence; identical to SEQ ID NO: 6247
  Description of Artificial Sequence: Synthetic polypeptide
  VL of XENP018335

SEQ ID NO: 14022 - protein, 11 aa, Artificial Sequence
  Description of Artificial Sequence: Synthetic peptide
  XENP018335 vlCDR1
RASQSVSNDVA

SEQ ID NO: 14023 - protein, 7 aa, Artificial Sequence
  Description of Artificial Sequence: Synthetic peptide
  XENP018335 vlCDR2
YASHRYT

SEQ ID NO: 14024 - protein, 9 aa, Artificial Sequence
  Description of Artificial Sequence: Synthetic peptide
  XENP018335 vlCDR3
QQDYSSPRT

SEQ ID NO: 14025 - protein, 451 aa, Artificial Sequence
  Description of Artificial Sequence: Synthetic polypeptide
  XENP018336 1G6_H1.231_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14026 - protein, 122 aa, Artificial Sequence; identical to SEQ ID NO: 8430
  Description of Artificial Sequence: Synthetic polypeptide
  VH of XENP018336

SEQ ID NO: 14027 - protein, 5 aa, Artificial Sequence
  Description of Artificial Sequence: Synthetic peptide
  XENP018336 vhCDR1
NYWMN

SEQ ID NO: 14028 - protein, 19 aa, Artificial Sequence
  Description of Artificial Sequence: Synthetic peptide
  XENP018336 vhCDR2
EIRLKSNNYATHYAEPVKG

SEQ ID NO: 14029 - protein, 11 aa, Artificial Sequence
  Description of Artificial Sequence: Synthetic peptide
  XENP018336 vhCDR3
YYGNYGGWFDV

SEQ ID NO: 14030 - protein, 214 aa, Artificial Sequence; identical to SEQ ID NO: 11550
  Description of Artificial Sequence: Synthetic polypeptide
  XENP018336 1G6_H1.231_L1_IgG1_PVA_/S267K Light Chain

SEQ ID NO: 14031 - protein, 107 aa, Artificial Sequence; identical to SEQ ID NO: 6247
  Description of Artificial Sequence: Synthetic polypeptide
  VL of XENP018336

SEQ ID NO: 14032 - protein, 11 aa, Artificial Sequence
  Description of Artificial Sequence: Synthetic peptide
  XENP018336 vlCDR1
RASQSVSNDVA

SEQ ID NO: 14033 - protein, 7 aa, Artificial Sequence
  Description of Artificial Sequence: Synthetic peptide
  XENP018336 vlCDR2
YASHRYT

SEQ ID NO: 14034 - protein, 9 aa, Artificial Sequence
  Description of Artificial Sequence: Synthetic peptide
  XENP018336 vlCDR3
QQDYSSPRT

SEQ ID NO: 14035 - protein, 451 aa, Artificial Sequence
  Description of Artificial Sequence: Synthetic polypeptide
  XENP018337 1G6_H1.232_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14036 - protein, 122 aa, Artificial Sequence; identical to SEQ ID NO: 8439
  Description of Artificial Sequence: Synthetic polypeptide
  VH of XENP018337

SEQ ID NO: 14037 - protein, 5 aa, Artificial Sequence
  Description of Artificial Sequence: Synthetic peptide
  XENP018337 vhCDR1
NYWMN

SEQ ID NO: 14038 - protein, 19 aa, Artificial Sequence
  Description of Artificial Sequence: Synthetic peptide
  XENP018337 vhCDR2
EIRLKSNNYATHYAEPVKG

SEQ ID NO: 14039 - protein, 11 aa, Artificial Sequence
  Description of Artificial Sequence: Synthetic peptide
  XENP018337 vhCDR3
YYGNYGGVFDV

SEQ ID NO: 14040 - protein, 214 aa, Artificial Sequence; identical to SEQ ID NO: 11550
  Description of Artificial Sequence: Synthetic polypeptide
  XENP018337 1G6_H1.232_L1_IgG1_PVA_/S267K Light Chain

SEQ ID NO: 14041 - protein, 107 aa, Artificial Sequence; identical to SEQ ID NO: 6247
  Description of Artificial Sequence: Synthetic polypeptide
  VL of XENP018337

SEQ ID NO: 14042 - protein, 11 aa, Artificial Sequence
  Description of Artificial Sequence: Synthetic peptide
  XENP018337 vlCDR1
RASQSVSNDVA

SEQ ID NO: 14043 - protein, 7 aa, Artificial Sequence
  Description of Artificial Sequence: Synthetic peptide
  XENP018337 vlCDR2
YASHRYT

SEQ ID NO: 14044 - protein, 9 aa, Artificial Sequence
  Description of Artificial Sequence: Synthetic peptide
  XENP018337 vlCDR3
QQDYSSPRT

SEQ ID NO: 14045 - protein, 451 aa, Artificial Sequence
  Description of Artificial Sequence: Synthetic polypeptide
  XENP018338 1G6_H1.233_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14046 - protein, 122 aa, Artificial Sequence; identical to SEQ ID NO: 8448
  Description of Artificial Sequence: Synthetic polypeptide
  VH of XENP018338

SEQ ID NO: 14047 - protein, 5 aa, Artificial Sequence
  Description of Artificial Sequence: Synthetic peptide
  XENP018338 vhCDR1
NYWMN

SEQ ID NO: 14048 - protein, 19 aa, Artificial Sequence
  Description of Artificial Sequence: Synthetic peptide
  XENP018338 vhCDR2
EIRLKSNNYATHYAEPVKG

SEQ ID NO: 14049 - protein, 11 aa, Artificial Sequence
  Description of Artificial Sequence: Synthetic peptide
  XENP018338 vhCDR3
YYGNYGGAFDV

SEQ ID NO: 14050 - protein, 214 aa, Artificial Sequence; identical to SEQ ID NO: 11550
  Description of Artificial Sequence: Synthetic polypeptide
  XENP018338 1G6_H1.233_L1_IgG1_PVA_/S267K Light Chain

SEQ ID NO: 14051 - protein, 107 aa, Artificial Sequence; identical to SEQ ID NO: 6247
  Description of Artificial Sequence: Synthetic polypeptide
  VL of XENP018338

SEQ ID NO: 14052 - protein, 11 aa, Artificial Sequence
  Description of Artificial Sequence: Synthetic peptide
  XENP018338 vlCDR1
RASQSVSNDVA

SEQ ID NO: 14053 - protein, 7 aa, Artificial Sequence
  Description of Artificial Sequence: Synthetic peptide
  XENP018338 vlCDR2
YASHRYT

SEQ ID NO: 14054 - protein, 9 aa, Artificial Sequence
  Description of Artificial Sequence: Synthetic peptide
  XENP018338 vlCDR3
QQDYSSPRT

SEQ ID NO: 14055 - protein, 451 aa, Artificial Sequence
  Description of Artificial Sequence: Synthetic polypeptide
  XENP018339 1G6_H1.234_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14056 - protein, 122 aa, Artificial Sequence; identical to SEQ ID NO: 8457
  Description of Artificial Sequence: Synthetic polypeptide
  VH of XENP018339

SEQ ID NO: 14057 - protein, 5 aa, Artificial Sequence
  Description of Artificial Sequence: Synthetic peptide
  XENP018339 vhCDR1
NYWMN

SEQ ID NO: 14058 - protein, 19 aa, Artificial Sequence
  Description of Artificial Sequence: Synthetic peptide
  XENP018339 vhCDR2
EIRLKSNNYATHYAEPVKG

SEQ ID NO: 14059 - protein, 11 aa, Artificial Sequence
  Description of Artificial Sequence: Synthetic peptide
  XENP018339 vhCDR3
YYGNYGGQFDV

SEQ ID NO: 14060 - protein, 214 aa, Artificial Sequence; identical to SEQ ID NO: 11550
  Description of Artificial Sequence: Synthetic polypeptide
  XENP018339 1G6_H1.234_L1_IgG1_PVA_/S267K Light Chain

SEQ ID NO: 14061 - protein, 107 aa, Artificial Sequence; identical to SEQ ID NO: 6247
  Description of Artificial Sequence: Synthetic polypeptide
  VL of XENP018339

SEQ ID NO: 14062 - protein, 11 aa, Artificial Sequence
  Description of Artificial Sequence: Synthetic peptide
  XENP018339 vlCDR1
RASQSVSNDVA

SEQ ID NO: 14063 - protein, 7 aa, Artificial Sequence
  Description of Artificial Sequence: Synthetic peptide
  XENP018339 vlCDR2
YASHRYT

SEQ ID NO: 14064 - protein, 9 aa, Artificial Sequence
  Description of Artificial Sequence: Synthetic peptide
  XENP018339 vlCDR3
QQDYSSPRT

SEQ ID NO: 14065 - protein, 451 aa, Artificial Sequence
  Description of Artificial Sequence: Synthetic polypeptide
  XENP018340 1G6_H1.235_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14066 - protein, 122 aa, Artificial Sequence; identical to SEQ ID NO: 8466
  Description of Artificial Sequence: Synthetic polypeptide
  VH of XENP018340

SEQ ID NO: 14067 - protein, 5 aa, Artificial Sequence
  Description of Artificial Sequence: Synthetic peptide
  XENP018340 vhCDR1
NYWMN

SEQ ID NO: 14068 - protein, 19 aa, Artificial Sequence
  Description of Artificial Sequence: Synthetic peptide
  XENP018340 vhCDR2
EIRLKSNNYATHYAEPVKG

SEQ ID NO: 14069 - protein, 11 aa, Artificial Sequence
  Description of Artificial Sequence: Synthetic peptide
  XENP018340 vhCDR3
YYGNYGGDFDV

SEQ ID NO: 14070 - protein, 214 aa, Artificial Sequence; identical to SEQ ID NO: 11550
  Description of Artificial Sequence: Synthetic polypeptide
  XENP018340 1G6_H1.235_L1_IgG1_PVA_/S267K Light Chain

SEQ ID NO: 14071 - protein, 107 aa, Artificial Sequence; identical to SEQ ID NO: 6247
  Description of Artificial Sequence: Synthetic polypeptide
  VL of XENP018340

SEQ ID NO: 14072 - protein, 11 aa, Artificial Sequence
  Description of Artificial Sequence: Synthetic peptide
  XENP018340 vlCDR1
RASQSVSNDVA

SEQ ID NO: 14073 - protein, 7 aa, Artificial Sequence
  Description of Artificial Sequence: Synthetic peptide
  XENP018340 vlCDR2
YASHRYT

SEQ ID NO: 14074 - protein, 9 aa, Artificial Sequence
  Description of Artificial Sequence: Synthetic peptide
  XENP018340 vlCDR3
QQDYSSPRT

SEQ ID NO: 14075 - protein, 451 aa, Artificial Sequence
  Description of Artificial Sequence: Synthetic polypeptide
  XENP018341 1G6_H1.236_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14076 - protein, 122 aa, Artificial Sequence; identical to SEQ ID NO: 8475
  Description of Artificial Sequence: Synthetic polypeptide
  VH of XENP018341

SEQ ID NO: 14077 - protein, 5 aa, Artificial Sequence
  Description of Artificial Sequence: Synthetic peptide
  XENP018341 vhCDR1
NYWMN

SEQ ID NO: 14078 - protein, 19 aa, Artificial Sequence
  Description of Artificial Sequence: Synthetic peptide
  XENP018341 vhCDR2
EIRLKSNNYATHYAEPVKG

SEQ ID NO: 14079 - protein, 11 aa, Artificial Sequence
  Description of Artificial Sequence: Synthetic peptide
  XENP018341 vhCDR3
YYGNYGGKFDV

SEQ ID NO: 14080 - protein, 214 aa, Artificial Sequence; identical to SEQ ID NO: 11550
  Description of Artificial Sequence: Synthetic polypeptide
  XENP018341 1G6_H1.236_L1_IgG1_PVA_/S267K Light Chain

SEQ ID NO: 14081 - protein, 107 aa, Artificial Sequence; identical to SEQ ID NO: 6247
  Description of Artificial Sequence: Synthetic polypeptide
  VL of XENP018341

SEQ ID NO: 14082 - protein, 11 aa, Artificial Sequence
  Description of Artificial Sequence: Synthetic peptide
  XENP018341 vlCDR1
RASQSVSNDVA

SEQ ID NO: 14083 - protein, 7 aa, Artificial Sequence
  Description of Artificial Sequence: Synthetic peptide
  XENP018341 vlCDR2
YASHRYT

SEQ ID NO: 14084 - protein, 9 aa, Artificial Sequence
  Description of Artificial Sequence: Synthetic peptide
  XENP018341 vlCDR3
QQDYSSPRT

SEQ ID NO: 14085 - protein, 451 aa, Artificial Sequence
  Description of Artificial Sequence: Synthetic polypeptide
  XENP018342 1G6_H1.237_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14086 - protein, 122 aa, Artificial Sequence; identical to SEQ ID NO: 8484
  Description of Artificial Sequence: Synthetic polypeptide
  VH of XENP018342

SEQ ID NO: 14087 - protein, 5 aa, Artificial Sequence
  Description of Artificial Sequence: Synthetic peptide
  XENP018342 vhCDR1
NYWMN

SEQ ID NO: 14088 - protein, 19 aa, Artificial Sequence
  Description of Artificial Sequence: Synthetic peptide
  XENP018342 vhCDR2
EIRLKSNNYATHYAEPVKG

SEQ ID NO: 14089 - protein, 11 aa, Artificial Sequence
  Description of Artificial Sequence: Synthetic peptide
  XENP018342 vhCDR3
YYGNYGGYFDY

SEQ ID NO: 14090 - protein, 214 aa, Artificial Sequence; identical to SEQ ID NO: 11550
  Description of Artificial Sequence: Synthetic polypeptide
  XENP018342 1G6_H1.237_L1_IgG1_PVA_/S267K Light Chain

SEQ ID NO: 14091 - protein, 107 aa, Artificial Sequence; identical to SEQ ID NO: 6247
  Description of Artificial Sequence: Synthetic polypeptide
  VL of XENP018342

SEQ ID NO: 14092 - protein, 11 aa, Artificial Sequence
  Description of Artificial Sequence: Synthetic peptide
  XENP018342 vlCDR1
RASQSVSNDVA

SEQ ID NO: 14093 - protein, 7 aa, Artificial Sequence
  Description of Artificial Sequence: Synthetic peptide
  XENP018342 vlCDR2
YASHRYT

SEQ ID NO: 14094 - protein, 9 aa, Artificial Sequence
  Description of Artificial Sequence: Synthetic peptide
  XENP018342 vlCDR3
QQDYSSPRT

SEQ ID NO: 14095 - protein, 451 aa, Artificial Sequence
  Description of Artificial Sequence: Synthetic polypeptide
  XENP018343 1G6_H1.238_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14096 - protein, 122 aa, Artificial Sequence; identical to SEQ ID NO: 8493
  Description of Artificial Sequence: Synthetic polypeptide
  VH of XENP018343

SEQ ID NO: 14097 - protein, 5 aa, Artificial Sequence
  Description of Artificial Sequence: Synthetic peptide
  XENP018343 vhCDR1
NYWMN

SEQ ID NO: 14098 - protein, 19 aa, Artificial Sequence
  Description of Artificial Sequence: Synthetic peptide
  XENP018343 vhCDR2
EIRLKSNNYATHYAEPVKG

SEQ ID NO: 14099 - protein, 11 aa, Artificial Sequence
  Description of Artificial Sequence: Synthetic peptide
  XENP018343 vhCDR3
YYGNYGGYFDV

SEQ ID NO: 14100 - protein, 214 aa, Artificial Sequence; identical to SEQ ID NO: 11550
  Description of Artificial Sequence: Synthetic polypeptide
  XENP018343 1G6_H1.238_L1_IgG1_PVA_/S267K Light Chain

SEQ ID NO: 14101 - protein, 107 aa, Artificial Sequence; identical to SEQ ID NO: 6247
  Description of Artificial Sequence: Synthetic polypeptide
  VL of XENP018343

SEQ ID NO: 14102 - protein, 11 aa, Artificial Sequence
  Description of Artificial Sequence: Synthetic peptide
  XENP018343 vlCDR1
RASQSVSNDVA

SEQ ID NO: 14103 - protein, 7 aa, Artificial Sequence
  Description of Artificial Sequence: Synthetic peptide
  XENP018343 vlCDR2
YASHRYT

SEQ ID NO: 14104 - protein, 9 aa, Artificial Sequence
  Description of Artificial Sequence: Synthetic peptide
  XENP018343 vlCDR3
QQDYSSPRT

SEQ ID NO: 14105 - protein, 451 aa, Artificial Sequence; identical to SEQ ID NO: 11545
  Description of Artificial Sequence: Synthetic polypeptide
  XENP018344 1G6_H1_L1.1_IgG1_PVA_/S267K Heavy Chain

SEQ ID NO: 14106 - protein, 122 aa, Artificial Sequence; identical to SEQ ID NO: 6246
  Description of Artificial Sequence: Synthetic polypeptide
  VH of XENP018344

SEQ ID NO: 14107 - protein, 5 aa, Artificial Sequence
  Description of Artificial Sequence: Synthetic peptide
  XENP018344 vhCDR1
NYWMN

SEQ ID NO: 14108 - protein, 19 aa, Artificial Sequence
  Description of Artificial Sequence: Synthetic peptide
  XENP018344 vhCDR2
EIRLKSNNYATHYAEPVKG

SEQ ID NO: 14109 - protein, 11 aa, Artificial Sequence
  Description of Artificial Sequence: Synthetic peptide
  XENP018344 vhCDR3
YYGNYGGYFDV

SEQ ID NO: 14110 - protein, 214 aa, Artificial Sequence
  Description of Artificial Sequence: Synthetic polypeptide
  XENP018344 1G6_H1_L1.1_IgG1_PVA_/S267K Light Chain
EIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14111 - protein, 107 aa, Artificial Sequence; identical to SEQ ID NO: 8503
  Description of Artificial Sequence: Synthetic polypeptide
  VL of XENP018344

SEQ ID NO: 14112 - protein, 11 aa, Artificial Sequence
  Description of Artificial Sequence: Synthetic peptide
  XENP018344 vlCDR1
RASQSVSNDVA

SEQ ID NO: 14113 - protein, 7 aa, Artificial Sequence
  Description of Artificial Sequence: Synthetic peptide
  XENP018344 vlCDR2
YASHRYT

SEQ ID NO: 14114 - protein, 9 aa, Artificial Sequence
  Description of Artificial Sequence: Synthetic peptide
  XENP018344 vlCDR3
QQDYSSPRT

SEQ ID NO: 14115 - protein, 451 aa, Artificial Sequence; identical to SEQ ID NO: 11545
  Description of Artificial Sequence: Synthetic polypeptide
  XENP018345 1G6_H1_L1.2_IgG1_PVA_/S267K Heavy Chain

SEQ ID NO: 14116 - protein, 122 aa, Artificial Sequence; identical to SEQ ID NO: 6246
  Description of Artificial Sequence: Synthetic polypeptide
  VH of XENP018345

SEQ ID NO: 14117 - protein, 5 aa, Artificial Sequence
  Description of Artificial Sequence: Synthetic peptide
  XENP018345 vhCDR1
NYWMN

SEQ ID NO: 14118 - protein, 19 aa, Artificial Sequence
  Description of Artificial Sequence: Synthetic peptide
  XENP018345 vhCDR2
EIRLKSNNYATHYAEPVKG

SEQ ID NO: 14119 - protein, 11 aa, Artificial Sequence
  Description of Artificial Sequence: Synthetic peptide
  XENP018345 vhCDR3
YYGNYGGYFDV

SEQ ID NO: 14120 - protein, 214 aa, Artificial Sequence
  Description of Artificial Sequence: Synthetic polypeptide
  XENP018345 1G6_H1_L1.2_IgG1_PVA_/S267K Light Chain
DIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14121 - protein, 107 aa, Artificial Sequence; identical to SEQ ID NO: 8512
  Description of Artificial Sequence: Synthetic polypeptide
  VL of XENP018345

SEQ ID NO: 14122 - protein, 11 aa, Artificial Sequence
  Description of Artificial Sequence: Synthetic peptide
  XENP018345 vlCDR1
RASQSVSNDVA

SEQ ID NO: 14123 - protein, 7 aa, Artificial Sequence
  Description of Artificial Sequence: Synthetic peptide
  XENP018345 vlCDR2
YASHRYT

SEQ ID NO: 14124 - protein, 9 aa, Artificial Sequence
  Description of Artificial Sequence: Synthetic peptide
  XENP018345 vlCDR3
QQDYSSPRT

SEQ ID NO: 14125 - protein, 451 aa, Artificial Sequence; identical to SEQ ID NO: 11545
  Description of Artificial Sequence: Synthetic polypeptide
  XENP018346 1G6_H1_L1.3_IgG1_PVA_/S267K Heavy Chain

SEQ ID NO: 14126 - protein, 122 aa, Artificial Sequence; identical to SEQ ID NO: 6246
  Description of Artificial Sequence: Synthetic polypeptide
  VH of XENP018346

SEQ ID NO: 14127 - protein, 5 aa, Artificial Sequence
  Description of Artificial Sequence: Synthetic peptide
  XENP018346 vhCDR1
NYWMN

SEQ ID NO: 14128 - protein, 19 aa, Artificial Sequence
  Description of Artificial Sequence: Synthetic peptide
  XENP018346 vhCDR2
EIRLKSNNYATHYAEPVKG

SEQ ID NO: 14129 - protein, 11 aa, Artificial Sequence
  Description of Artificial Sequence: Synthetic peptide
  XENP018346 vhCDR3
YYGNYGGYFDV

SEQ ID NO: 14130 - protein, 214 aa, Artificial Sequence
  Description of Artificial Sequence: Synthetic polypeptide
  XENP018346 1G6_H1_L1.3_IgG1_PVA_/S267K Light Chain
SVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14131 - protein, 107 aa, Artificial Sequence; identical to SEQ ID NO: 8521
  Description of Artificial Sequence: Synthetic polypeptide
  VL of XENP018346

SEQ ID NO: 14132 - protein, 11 aa, Artificial Sequence
  Description of Artificial Sequence: Synthetic peptide
  XENP018346 vlCDR1
RASQSVSNDVA

SEQ ID NO: 14133 - protein, 7 aa, Artificial Sequence
  Description of Artificial Sequence: Synthetic peptide
  XENP018346 vlCDR2
YASHRYT

SEQ ID NO: 14134 - protein, 9 aa, Artificial Sequence
  Description of Artificial Sequence: Synthetic peptide
  XENP018346 vlCDR3
QQDYSSPRT

SEQ ID NO: 14135 - protein, 451 aa, Artificial Sequence; identical to SEQ ID NO: 11545
  Description of Artificial Sequence: Synthetic polypeptide
  XENP018347 1G6_H1_L1.4_IgG1_PVA_/S267K Heavy Chain

SEQ ID NO: 14136 - protein, 122 aa, Artificial Sequence; identical to SEQ ID NO: 6246
  Description of Artificial Sequence: Synthetic polypeptide
  VH of XENP018347

SEQ ID NO: 14137 - protein, 5 aa, Artificial Sequence
  Description of Artificial Sequence: Synthetic peptide
  XENP018347 vhCDR1
NYWMN

SEQ ID NO: 14138 - protein, 19 aa, Artificial Sequence
  Description of Artificial Sequence: Synthetic peptide
  XENP018347 vhCDR2
EIRLKSNNYATHYAEPVKG

SEQ ID NO: 14139 - protein, 11 aa, Artificial Sequence
  Description of Artificial Sequence: Synthetic peptide
  XENP018347 vhCDR3
YYGNYGGYFDV

SEQ ID NO: 14140 - protein, 214 aa, Artificial Sequence
  Description of Artificial Sequence: Synthetic polypeptide
  XENP018347 1G6_H1_L1.4_IgG1_PVA_/S267K Light Chain
SIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14141 - protein, 107 aa, Artificial Sequence; identical to SEQ ID NO: 8530
  Description of Artificial Sequence: Synthetic polypeptide
  VL of XENP018347

SEQ ID NO: 14142 - protein, 11 aa, Artificial Sequence
  Description of Artificial Sequence: Synthetic peptide
  XENP018347 vlCDR1
RASQSVSNDVA

SEQ ID NO: 14143 - protein, 7 aa, Artificial Sequence
  Description of Artificial Sequence: Synthetic peptide
  XENP018347 vlCDR2
YASHRYT

SEQ ID NO: 14144 - protein, 9 aa, Artificial Sequence
  Description of Artificial Sequence: Synthetic peptide
  XENP018347 vlCDR3
QQDYSSPRT

SEQ ID NO: 14145 - protein, 451 aa, Artificial Sequence; identical to SEQ ID NO: 11545
  Description of Artificial Sequence: Synthetic polypeptide
  XENP018348 1G6_H1_L1.5_IgG1_PVA_/S267K Heavy Chain

SEQ ID NO: 14146 - protein, 122 aa, Artificial Sequence; identical to SEQ ID NO: 6246
  Description of Artificial Sequence: Synthetic polypeptide
  VH of XENP018348

SEQ ID NO: 14147 - protein, 5 aa, Artificial Sequence
  Description of Artificial Sequence: Synthetic peptide
  XENP018348 vhCDR1
NYWMN

SEQ ID NO: 14148 - protein, 19 aa, Artificial Sequence
  Description of Artificial Sequence: Synthetic peptide
  XENP018348 vhCDR2
EIRLKSNNYATHYAEPVKG

SEQ ID NO: 14149 - protein, 11 aa, Artificial Sequence
  Description of Artificial Sequence: Synthetic peptide
  XENP018348 vhCDR3
YYGNYGGYFDV

SEQ ID NO: 14150 - protein, 214 aa, Artificial Sequence
  Description of Artificial Sequence: Synthetic polypeptide
  XENP018348 1G6_H1_L1.5_IgG1_PVA_/S267K Light Chain
SIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14151 - protein, 107 aa, Artificial Sequence; identical to SEQ ID NO: 8539
  Description of Artificial Sequence: Synthetic polypeptide
  VL of XENP018348

SEQ ID NO: 14152 - protein, 11 aa, Artificial Sequence
  Description of Artificial Sequence: Synthetic peptide
  XENP018348 vlCDR1
RASQSVSNDVA

SEQ ID NO: 14153 - protein, 7 aa, Artificial Sequence
  Description of Artificial Sequence: Synthetic peptide
  XENP018348 vlCDR2
YASHRYT

SEQ ID NO: 14154 - protein, 9 aa, Artificial Sequence
  Description of Artificial Sequence: Synthetic peptide
  XENP018348 vlCDR3
QQDYSSPRT

SEQ ID NO: 14155 - protein, 451 aa, Artificial Sequence; identical to SEQ ID NO: 11545
  Description of Artificial Sequence: Synthetic polypeptide
  XENP018349 1G6_H1_L1.6_IgG1_PVA_/S267K Heavy Chain

SEQ ID NO: 14156 - protein, 122 aa, Artificial Sequence; identical to SEQ ID NO: 6246
  Description of Artificial Sequence: Synthetic polypeptide
  VH of XENP018349

SEQ ID NO: 14157 - protein, 5 aa, Artificial Sequence
  Description of Artificial Sequence: Synthetic peptide
  XENP018349 vhCDR1
NYWMN

SEQ ID NO: 14158 - protein, 19 aa, Artificial Sequence
  Description of Artificial Sequence: Synthetic peptide
  XENP018349 vhCDR2
EIRLKSNNYATHYAEPVKG

SEQ ID NO: 14159 - protein, 11 aa, Artificial Sequence
  Description of Artificial Sequence: Synthetic peptide
  XENP018349 vhCDR3
YYGNYGGYFDV

SEQ ID NO: 14160 - protein, 214 aa, Artificial Sequence
  Description of Artificial Sequence: Synthetic polypeptide
  XENP018349 1G6_H1_L1.6_IgG1_PVA_/S267K Light Chain
SIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14161 - protein, 107 aa, Artificial Sequence; identical to SEQ ID NO: 8548
  Description of Artificial Sequence: Synthetic polypeptide
  VL of XENP018349

SEQ ID NO: 14162 - protein, 11 aa, Artificial Sequence
  Description of Artificial Sequence: Synthetic peptide
  XENP018349 vlCDR1
RASQSVSNDVA

SEQ ID NO: 14163 - protein, 7 aa, Artificial Sequence
  Description of Artificial Sequence: Synthetic peptide
  XENP018349 vlCDR2
YASHRYT

SEQ ID NO: 14164 - protein, 9 aa, Artificial Sequence
  Description of Artificial Sequence: Synthetic peptide
  XENP018349 vlCDR3
QQDYSSPRT

SEQ ID NO: 14165 - protein, 451 aa, Artificial Sequence; identical to SEQ ID NO: 11545
  Description of Artificial Sequence: Synthetic polypeptide
  XENP018350 1G6_H1_L1.7_IgG1_PVA_/S267K Heavy Chain

SEQ ID NO: 14166 - protein, 122 aa, Artificial Sequence; identical to SEQ ID NO: 6246
  Description of Artificial Sequence: Synthetic polypeptide
  VH of XENP018350

SEQ ID NO: 14167 - protein, 5 aa, Artificial Sequence
  Description of Artificial Sequence: Synthetic peptide
  XENP018350 vhCDR1
NYWMN

SEQ ID NO: 14168 - protein, 19 aa, Artificial Sequence
  Description of Artificial Sequence: Synthetic peptide
  XENP018350 vhCDR2
EIRLKSNNYATHYAEPVKG

SEQ ID NO: 14169 - protein, 11 aa, Artificial Sequence
  Description of Artificial Sequence: Synthetic peptide
  XENP018350 vhCDR3
YYGNYGGYFDV

SEQ ID NO: 14170 - protein, 214 aa, Artificial Sequence
  Description of Artificial Sequence: Synthetic polypeptide
  XENP018350 1G6_H1_L1.7_IgG1_PVA_/S267K Light Chain
SIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14171 - protein, 107 aa, Artificial Sequence; identical to SEQ ID NO: 8557
  Description of Artificial Sequence: Synthetic polypeptide
  VL of XENP018350

SEQ ID NO: 14172 - protein, 11 aa, Artificial Sequence
  Description of Artificial Sequence: Synthetic peptide
  XENP018350 vlCDR1
RASQSVSNDVA

SEQ ID NO: 14173 - protein, 7 aa, Artificial Sequence
  Description of Artificial Sequence: Synthetic peptide
  XENP018350 vlCDR2
YASHRYT

SEQ ID NO: 14174 - protein, 9 aa, Artificial Sequence
  Description of Artificial Sequence: Synthetic peptide
  XENP018350 vlCDR3
QQDYSSPRT

SEQ ID NO: 14175 - protein, 451 aa, Artificial Sequence; identical to SEQ ID NO: 11545
  Description of Artificial Sequence: Synthetic polypeptide
  XENP018351 1G6_H1_L1.8_IgG1_PVA_/S267K Heavy Chain

SEQ ID NO: 14176 - protein, 122 aa, Artificial Sequence; identical to SEQ ID NO: 6246
  Description of Artificial Sequence: Synthetic polypeptide
  VH of XENP018351

SEQ ID NO: 14177 - protein, 5 aa, Artificial Sequence
  Description of Artificial Sequence: Synthetic peptide
  XENP018351 vhCDR1
NYWMN

SEQ ID NO: 14178 - protein, 19 aa, Artificial Sequence
  Description of Artificial Sequence: Synthetic peptide
  XENP018351 vhCDR2
EIRLKSNNYATHYAEPVKG

SEQ ID NO: 14179 - protein, 11 aa, Artificial Sequence
  Description of Artificial Sequence: Synthetic peptide
  XENP018351 vhCDR3
YYGNYGGYFDV

SEQ ID NO: 14180 - protein, 214 aa, Artificial Sequence
  Description of Artificial Sequence: Synthetic polypeptide
  XENP018351 1G6_H1_L1.8_IgG1_PVA_/S267K Light Chain
SIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14181 - protein, 107 aa, Artificial Sequence; identical to SEQ ID NO: 8566
  Description of Artificial Sequence: Synthetic polypeptide
  VL of XENP018351

SEQ ID NO: 14182 - protein, 11 aa, Artificial Sequence
  Description of Artificial Sequence: Synthetic peptide
  XENP018351 vlCDR1
RASQSVSNDVA

SEQ ID NO: 14183 - protein, 7 aa, Artificial Sequence
  Description of Artificial Sequence: Synthetic peptide
  XENP018351 vlCDR2
YASHRYT

SEQ ID NO: 14184 - protein, 9 aa, Artificial Sequence
  Description of Artificial Sequence: Synthetic peptide
  XENP018351 vlCDR3
QQDYSSPRT

SEQ ID NO: 14185 - protein, 451 aa, Artificial Sequence; identical to SEQ ID NO: 11545
  Description of Artificial Sequence: Synthetic polypeptide
  XENP018352 1G6_H1_L1.9_IgG1_PVA_/S267K Heavy Chain

SEQ ID NO: 14186 - protein, 122 aa, Artificial Sequence; identical to SEQ ID NO: 6246
  Description of Artificial Sequence: Synthetic polypeptide
  VH of XENP018352

SEQ ID NO: 14187 - protein, 5 aa, Artificial Sequence
  Description of Artificial Sequence: Synthetic peptide
  XENP018352 vhCDR1
NYWMN

SEQ ID NO: 14188 - protein, 19 aa, Artificial Sequence
  Description of Artificial Sequence: Synthetic peptide
  XENP018352 vhCDR2
EIRLKSNNYATHYAEPVKG

SEQ ID NO: 14189 - protein, 11 aa, Artificial Sequence
  Description of Artificial Sequence: Synthetic peptide
  XENP018352 vhCDR3
YYGNYGGYFDV

SEQ ID NO: 14190 - protein, 214 aa, Artificial Sequence
  Description of Artificial Sequence: Synthetic polypeptide
  XENP018352 1G6_H1_L1.9_IgG1_PVA_/S267K Light Chain
SIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14191 - protein, 107 aa, Artificial Sequence; identical to SEQ ID NO: 8575
  Description of Artificial Sequence: Synthetic polypeptide
  VL of XENP018352

SEQ ID NO: 14192 - protein, 11 aa, Artificial Sequence
  Description of Artificial Sequence: Synthetic peptide
  XENP018352 vlCDR1
RASQSVSNDVA

SEQ ID NO: 14193 - protein, 7 aa, Artificial Sequence
  Description of Artificial Sequence: Synthetic peptide
  XENP018352 vlCDR2
YASHRYT

SEQ ID NO: 14194 - protein, 9 aa, Artificial Sequence
  Description of Artificial Sequence: Synthetic peptide
  XENP018352 vlCDR3
QQDYSSPRT

SEQ ID NO: 14195 - protein, 451 aa, Artificial Sequence; identical to SEQ ID NO: 11545
  Description of Artificial Sequence: Synthetic polypeptide
  XENP018353 1G6_H1_L1.10_IgG1_PVA_/S267K Heavy Chain

SEQ ID NO: 14196 - protein, 122 aa, Artificial Sequence; identical to SEQ ID NO: 6246
  Description of Artificial Sequence: Synthetic polypeptide
  VH of XENP018353

SEQ ID NO: 14197 - protein, 5 aa, Artificial Sequence
  Description of Artificial Sequence: Synthetic peptide
  XENP018353 vhCDR1
NYWMN

SEQ ID NO: 14198 - protein, 19 aa, Artificial Sequence
  Description of Artificial Sequence: Synthetic peptide
  XENP018353 vhCDR2
EIRLKSNNYATHYAEPVKG

SEQ ID NO: 14199 - protein, 11 aa, Artificial Sequence
  Description of Artificial Sequence: Synthetic peptide
  XENP018353 vhCDR3
YYGNYGGYFDV

SEQ ID NO: 14200 - protein, 214 aa, Artificial Sequence
  Description of Artificial Sequence: Synthetic polypeptide
  XENP018353 1G6_H1_L1.10_IgG1_PVA_/S267K Light Chain
SIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14201 - protein, 107 aa, Artificial Sequence; identical to SEQ ID NO: 8584
  Description of Artificial Sequence: Synthetic polypeptide
  VL of XENP018353

SEQ ID NO: 14202 - protein, 11 aa, Artificial Sequence
  Description of Artificial Sequence: Synthetic peptide
  XENP018353 vlCDR1
RASQSVSNDVA

SEQ ID NO: 14203 - protein, 7 aa, Artificial Sequence
  Description of Artificial Sequence: Synthetic peptide
  XENP018353 vlCDR2
YASHRYT

SEQ ID NO: 14204 - protein, 9 aa, Artificial Sequence
  Description of Artificial Sequence: Synthetic peptide
  XENP018353 vlCDR3
QQDYSSPRT

SEQ ID NO: 14205 - protein, 451 aa, Artificial Sequence; identical to SEQ ID NO: 11545
  Description of Artificial Sequence: Synthetic polypeptide
  XENP018354 1G6_H1_L1.11_IgG1_PVA_/S267K Heavy Chain

SEQ ID NO: 14206 - protein, 122 aa, Artificial Sequence; identical to SEQ ID NO: 6246
  Description of Artificial Sequence: Synthetic polypeptide
  VH of XENP018354

SEQ ID NO: 14207 - protein, 5 aa, Artificial Sequence
  Description of Artificial Sequence: Synthetic peptide
  XENP018354 vhCDR1
NYWMN

SEQ ID NO: 14208 - protein, 19 aa, Artificial Sequence
  Description of Artificial Sequence: Synthetic peptide
  XENP018354 vhCDR2
EIRLKSNNYATHYAEPVKG

SEQ ID NO: 14209 - protein, 11 aa, Artificial Sequence
  Description of Artificial Sequence: Synthetic peptide
  XENP018354 vhCDR3
YYGNYGGYFDV

SEQ ID NO: 14210 - protein, 214 aa, Artificial Sequence
  Description of Artificial Sequence: Synthetic polypeptide
  XENP018354 1G6_H1_L1.11_IgG1_PVA_/S267K Light Chain
SIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14211 - protein, 107 aa, Artificial Sequence; identical to SEQ ID NO: 8593
  Description of Artificial Sequence: Synthetic polypeptide
  VL of XENP018354

SEQ ID NO: 14212 - protein, 11 aa, Artificial Sequence
  Description of Artificial Sequence: Synthetic peptide
  XENP018354 vlCDR1
RASQSVSNDVA

SEQ ID NO: 14213 - protein, 7 aa, Artificial Sequence
  Description of Artificial Sequence: Synthetic peptide
  XENP018354 vlCDR2
YASHRYT

SEQ ID NO: 14214 - protein, 9 aa, Artificial Sequence
  Description of Artificial Sequence: Synthetic peptide
  XENP018354 vlCDR3
QQDYSSPRT

SEQ ID NO: 14215 - protein, 451 aa, Artificial Sequence; identical to SEQ ID NO: 11545
  Description of Artificial Sequence: Synthetic polypeptide
  XENP018355 1G6_H1_L1.12_IgG1_PVA_/S267K Heavy Chain

SEQ ID NO: 14216 - protein, 122 aa, Artificial Sequence; identical to SEQ ID NO: 6246
  Description of Artificial Sequence: Synthetic polypeptide
  VH of XENP018355

SEQ ID NO: 14217 - protein, 5 aa, Artificial Sequence
  Description of Artificial Sequence: Synthetic peptide
  XENP018355 vhCDR1
NYWMN

SEQ ID NO: 14218 - protein, 19 aa, Artificial Sequence
  Description of Artificial Sequence: Synthetic peptide
  XENP018355 vhCDR2
EIRLKSNNYATHYAEPVKG

SEQ ID NO: 14219 - protein, 11 aa, Artificial Sequence
  Description of Artificial Sequence: Synthetic peptide
  XENP018355 vhCDR3
YYGNYGGYFDV

SEQ ID NO: 14220 - protein, 214 aa, Artificial Sequence
  Description of Artificial Sequence: Synthetic polypeptide
  XENP018355 1G6_H1_L1.12_IgG1_PVA_/S267K Light Chain
SIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14221 - protein, 107 aa, Artificial Sequence; identical to SEQ ID NO: 8602
  Description of Artificial Sequence: Synthetic polypeptide
  VL of XENP018355

SEQ ID NO: 14222 - protein, 11 aa, Artificial Sequence
  Description of Artificial Sequence: Synthetic peptide
  XENP018355 vlCDR1
RASQSVSNDVA

SEQ ID NO: 14223 - protein, 7 aa, Artificial Sequence
  Description of Artificial Sequence: Synthetic peptide
  XENP018355 vlCDR2
YASHRYT

SEQ ID NO: 14224 - protein, 9 aa, Artificial Sequence
  Description of Artificial Sequence: Synthetic peptide
  XENP018355 vlCDR3
QQDYSSPRT

SEQ ID NO: 14225 - protein, 451 aa, Artificial Sequence; identical to SEQ ID NO: 11545
  Description of Artificial Sequence: Synthetic polypeptide
  XENP018356 1G6_H1_L1.13_IgG1_PVA_/S267K Heavy Chain

SEQ ID NO: 14226 - protein, 122 aa, Artificial Sequence; identical to SEQ ID NO: 6246
  Description of Artificial Sequence: Synthetic polypeptide
  VH of XENP018356

SEQ ID NO: 14227 - protein, 5 aa, Artificial Sequence
  Description of Artificial Sequence: Synthetic peptide
  XENP018356 vhCDR1
NYWMN

SEQ ID NO: 14228 - protein, 19 aa, Artificial Sequence
  Description of Artificial Sequence: Synthetic peptide
  XENP018356 vhCDR2
EIRLKSNNYATHYAEPVKG

SEQ ID NO: 14229 - protein, 11 aa, Artificial Sequence
  Description of Artificial Sequence: Synthetic peptide
  XENP018356 vhCDR3
YYGNYGGYFDV

SEQ ID NO: 14230 - protein, 214 aa, Artificial Sequence
  Description of Artificial Sequence: Synthetic polypeptide
  XENP018356 1G6_H1_L1.13_IgG1_PVA_/S267K Light Chain
SIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14231 - protein, 107 aa, Artificial Sequence; identical to SEQ ID NO: 8611
  Description of Artificial Sequence: Synthetic polypeptide
  VL of XENP018356

SEQ ID NO: 14232 - protein, 11 aa, Artificial Sequence
  Description of Artificial Sequence: Synthetic peptide
  XENP018356 vlCDR1
RASQSVSNDVA

SEQ ID NO: 14233 - protein, 7 aa, Artificial Sequence
  Description of Artificial Sequence: Synthetic peptide
  XENP018356 vlCDR2
YASHRYT

SEQ ID NO: 14234 - protein, 9 aa, Artificial Sequence
  Description of Artificial Sequence: Synthetic peptide
  XENP018356 vlCDR3
QQDYSSPRT

SEQ ID NO: 14235 - protein, 451 aa, Artificial Sequence; identical to SEQ ID NO: 11545
  Description of Artificial Sequence: Synthetic polypeptide
  XENP018357 1G6_H1_L1.14_IgG1_PVA_/S267K Heavy Chain

SEQ ID NO: 14236 - protein, 122 aa, Artificial Sequence; identical to SEQ ID NO: 6246
  Description of Artificial Sequence: Synthetic polypeptide
  VH of XENP018357

SEQ ID NO: 14237 - protein, 5 aa, Artificial Sequence
  Description of Artificial Sequence: Synthetic peptide
  XENP018357 vhCDR1
NYWMN

SEQ ID NO: 14238 - protein, 19 aa, Artificial Sequence
  Description of Artificial Sequence: Synthetic peptide
  XENP018357 vhCDR2
EIRLKSNNYATHYAEPVKG

SEQ ID NO: 14239 - protein, 11 aa, Artificial Sequence
  Description of Artificial Sequence: Synthetic peptide
  XENP018357 vhCDR3
YYGNYGGYFDV

SEQ ID NO: 14240 - protein, 214 aa, Artificial Sequence
  Description of Artificial Sequence: Synthetic polypeptide
  XENP018357 1G6_H1_L1.14_IgG1_PVA_/S267K Light Chain
SIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14241 - protein, 107 aa, Artificial Sequence; identical to SEQ ID NO: 8620
  Description of Artificial Sequence: Synthetic polypeptide
  VL of XENP018357

SEQ ID NO: 14242 - protein, 11 aa, Artificial Sequence
  Description of Artificial Sequence: Synthetic peptide
  XENP018357 vlCDR1
RASQSVSNDVA

SEQ ID NO: 14243 - protein, 7 aa, Artificial Sequence
  Description of Artificial Sequence: Synthetic peptide
  XENP018357 vlCDR2
YASHRYT

SEQ ID NO: 14244 - protein, 9 aa, Artificial Sequence
  Description of Artificial Sequence: Synthetic peptide
  XENP018357 vlCDR3
QQDYSSPRT

SEQ ID NO: 14245 - protein, 451 aa, Artificial Sequence; identical to SEQ ID NO: 11545
  Description of Artificial Sequence: Synthetic polypeptide
  XENP018358 1G6_H1_L1.15_IgG1_PVA_/S267K Heavy Chain

SEQ ID NO: 14246 - protein, 122 aa, Artificial Sequence; identical to SEQ ID NO: 6246
  Description of Artificial Sequence: Synthetic polypeptide
  VH of XENP018358

SEQ ID NO: 14247 - protein, 5 aa, Artificial Sequence
  Description of Artificial Sequence: Synthetic peptide
  XENP018358 vhCDR1
NYWMN

SEQ ID NO: 14248 - protein, 19 aa, Artificial Sequence
  Description of Artificial Sequence: Synthetic peptide
  XENP018358 vhCDR2
EIRLKSNNYATHYAEPVKG

SEQ ID NO: 14249 - protein, 11 aa, Artificial Sequence
  Description of Artificial Sequence: Synthetic peptide
  XENP018358 vhCDR3
YYGNYGGYFDV

SEQ ID NO: 14250 - protein, 214 aa, Artificial Sequence
  Description of Artificial Sequence: Synthetic polypeptide
  XENP018358 1G6_H1_L1.15_IgG1_PVA_/S267K Light Chain
SIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14251 - protein, 107 aa, Artificial Sequence; identical to SEQ ID NO: 8629
  Description of Artificial Sequence: Synthetic polypeptide
  VL of XENP018358

SEQ ID NO: 14252 - protein, 11 aa, Artificial Sequence
  Description of Artificial Sequence: Synthetic peptide
  XENP018358 vlCDR1
KASQSVSNDVA

SEQ ID NO: 14253 - protein, 7 aa, Artificial Sequence
  Description of Artificial Sequence: Synthetic peptide
  XENP018358 vlCDR2
YASHRYT

SEQ ID NO: 14254 - protein, 9 aa, Artificial Sequence
  Description of Artificial Sequence: Synthetic peptide
  XENP018358 vlCDR3
QQDYSSPRT

SEQ ID NO: 14255 - protein, 451 aa, Artificial Sequence; identical to SEQ ID NO: 11545
  Description of Artificial Sequence: Synthetic polypeptide
  XENP018359 1G6_H1_L1.16_IgG1_PVA_/S267K Heavy Chain

SEQ ID NO: 14256 - protein, 122 aa, Artificial Sequence; identical to SEQ ID NO: 6246
  Description of Artificial Sequence: Synthetic polypeptide
  VH of XENP018359

SEQ ID NO: 14257 - protein, 5 aa, Artificial Sequence
  Description of Artificial Sequence: Synthetic peptide
  XENP018359 vhCDR1
NYWMN

SEQ ID NO: 14258 - protein, 19 aa, Artificial Sequence
  Description of Artificial Sequence: Synthetic peptide
  XENP018359 vhCDR2
EIRLKSNNYATHYAEPVKG

SEQ ID NO: 14259 - protein, 11 aa, Artificial Sequence
  Description of Artificial Sequence: Synthetic peptide
  XENP018359 vhCDR3
YYGNYGGYFDV

SEQ ID NO: 14260 - protein, 214 aa, Artificial Sequence
  Description of Artificial Sequence: Synthetic polypeptide
  XENP018359 1G6_H1_L1.16_IgG1_PVA_/S267K Light Chain
SIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14261 - protein, 107 aa, Artificial Sequence; identical to SEQ ID NO: 8638
  Description of Artificial Sequence: Synthetic polypeptide
  VL of XENP018359

SEQ ID NO: 14262 - protein, 11 aa, Artificial Sequence
  Description of Artificial Sequence: Synthetic peptide
  XENP018359 vlCDR1
RASQDVSNDVA

SEQ ID NO: 14263 - protein, 7 aa, Artificial Sequence
  Description of Artificial Sequence: Synthetic peptide
  XENP018359 vlCDR2
YASHRYT

SEQ ID NO: 14264 - protein, 9 aa, Artificial Sequence
  Description of Artificial Sequence: Synthetic peptide
  XENP018359 vlCDR3
QQDYSSPRT

SEQ ID NO: 14265 - protein, 451 aa, Artificial Sequence; identical to SEQ ID NO: 11545
  Description of Artificial Sequence: Synthetic polypeptide
  XENP018360 1G6_H1_L1.17_IgG1_PVA_/S267K Heavy Chain

SEQ ID NO: 14266 - protein, 122 aa, Artificial Sequence; identical to SEQ ID NO: 6246
  Description of Artificial Sequence: Synthetic polypeptide
  VH of XENP018360

SEQ ID NO: 14267 - protein, 5 aa, Artificial Sequence
  Description of Artificial Sequence: Synthetic peptide
  XENP018360 vhCDR1
NYWMN

SEQ ID NO: 14268 - protein, 19 aa, Artificial Sequence
  Description of Artificial Sequence: Synthetic peptide
  XENP018360 vhCDR2
EIRLKSNNYATHYAEPVKG

SEQ ID NO: 14269 - protein, 11 aa, Artificial Sequence
  Description of Artificial Sequence: Synthetic peptide
  XENP018360 vhCDR3
YYGNYGGYFDV

SEQ ID NO: 14270 - protein, 214 aa, Artificial Sequence
  Description of Artificial Sequence: Synthetic polypeptide
  XENP018360 1G6_H1_L1.17_IgG1_PVA_/S267K Light Chain
SIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14271 - protein, 107 aa, Artificial Sequence; identical to SEQ ID NO: 8647
  Description of Artificial Sequence: Synthetic polypeptide
  VL of XENP018360

SEQ ID NO: 14272 - protein, 11 aa, Artificial Sequence
  Description of Artificial Sequence: Synthetic peptide
  XENP018360 vlCDR1
RASQGVSNDVA

SEQ ID NO: 14273 - protein, 7 aa, Artificial Sequence
  Description of Artificial Sequence: Synthetic peptide
  XENP018360 vlCDR2
YASHRYT

SEQ ID NO: 14274 - protein, 9 aa, Artificial Sequence
  Description of Artificial Sequence: Synthetic peptide
  XENP018360 vlCDR3
QQDYSSPRT

SEQ ID NO: 14275 - protein, 451 aa, Artificial Sequence; identical to SEQ ID NO: 11545
  Description of Artificial Sequence: Synthetic polypeptide
  XENP018361 1G6_H1_L1.18_IgG1_PVA_/S267K Heavy Chain

SEQ ID NO: 14276 - protein, 122 aa, Artificial Sequence; identical to SEQ ID NO: 6246
  Description of Artificial Sequence: Synthetic polypeptide
  VH of XENP018361

SEQ ID NO: 14277 - protein, 5 aa, Artificial Sequence
  Description of Artificial Sequence: Synthetic peptide
  XENP018361 vhCDR1
NYWMN

SEQ ID NO: 14278 - protein, 19 aa, Artificial Sequence
  Description of Artificial Sequence: Synthetic peptide
  XENP018361 vhCDR2
EIRLKSNNYATHYAEPVKG

SEQ ID NO: 14279 - protein, 11 aa, Artificial Sequence
  Description of Artificial Sequence: Synthetic peptide
  XENP018361 vhCDR3
YYGNYGGYFDV

SEQ ID NO: 14280 - protein, 214 aa, Artificial Sequence
  Description of Artificial Sequence: Synthetic polypeptide
  XENP018361 1G6_H1_L1.18_IgG1_PVA_/S267K Light Chain
SIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14281 - protein, 107 aa, Artificial Sequence; identical to SEQ ID NO: 8656
  Description of Artificial Sequence: Synthetic polypeptide
  VL of XENP018361

SEQ ID NO: 14282 - protein, 11 aa, Artificial Sequence
  Description of Artificial Sequence: Synthetic peptide
  XENP018361 vlCDR1
RASQSISNDVA

SEQ ID NO: 14283 - protein, 7 aa, Artificial Sequence
  Description of Artificial Sequence: Synthetic peptide
  XENP018361 vlCDR2
YASHRYT

SEQ ID NO: 14284 - protein, 9 aa, Artificial Sequence
  Description of Artificial Sequence: Synthetic peptide
  XENP018361 vlCDR3
QQDYSSPRT

SEQ ID NO: 14285 - protein, 451 aa, Artificial Sequence; identical to SEQ ID NO: 11545
  Description of Artificial Sequence: Synthetic polypeptide
  XENP018362 1G6_H1_L1.19_IgG1_PVA_/S267K Heavy Chain

SEQ ID NO: 14286 - protein, 122 aa, Artificial Sequence; identical to SEQ ID NO: 6246
  Description of Artificial Sequence: Synthetic polypeptide
  VH of XENP018362

SEQ ID NO: 14287 - protein, 5 aa, Artificial Sequence
  Description of Artificial Sequence: Synthetic peptide
  XENP018362 vhCDR1
NYWMN

SEQ ID NO: 14288 - protein, 19 aa, Artificial Sequence
  Description of Artificial Sequence: Synthetic peptide
  XENP018362 vhCDR2
EIRLKSNNYATHYAEPVKG

SEQ ID NO: 14289 - protein, 11 aa, Artificial Sequence
  Description of Artificial Sequence: Synthetic peptide
  XENP018362 vhCDR3
YYGNYGGYFDV

SEQ ID NO: 14290 - protein, 214 aa, Artificial Sequence
  Description of Artificial Sequence: Synthetic polypeptide
  XENP018362 1G6_H1_L1.19_IgG1_PVA_/S267K Light Chain
SIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14291 - protein, 107 aa, Artificial Sequence; identical to SEQ ID NO: 8665
  Description of Artificial Sequence: Synthetic polypeptide
  VL of XENP018362

SEQ ID NO: 14292 - protein, 11 aa, Artificial Sequence
  Description of Artificial Sequence: Synthetic peptide
  XENP018362 vlCDR1
RASQSLSNDVA

SEQ ID NO: 14293 - protein, 7 aa, Artificial Sequence
  Description of Artificial Sequence: Synthetic peptide
  XENP018362 vlCDR2
YASHRYT

SEQ ID NO: 14294 - protein, 9 aa, Artificial Sequence
  Description of Artificial Sequence: Synthetic peptide
  XENP018362 vlCDR3
QQDYSSPRT

SEQ ID NO: 14295 - protein, 451 aa, Artificial Sequence; identical to SEQ ID NO: 11545
  Description of Artificial Sequence: Synthetic polypeptide
  XENP018363 1G6_H1_L1.20_IgG1_PVA_/S267K Heavy Chain

SEQ ID NO: 14296 - protein, 122 aa, Artificial Sequence; identical to SEQ ID NO: 6246
  Description of Artificial Sequence: Synthetic polypeptide
  VH of XENP018363

SEQ ID NO: 14297 - protein, 5 aa, Artificial Sequence
  Description of Artificial Sequence: Synthetic peptide
  XENP018363 vhCDR1
NYWMN

SEQ ID NO: 14298 - protein, 19 aa, Artificial Sequence
  Description of Artificial Sequence: Synthetic peptide
  XENP018363 vhCDR2
EIRLKSNNYATHYAEPVKG

SEQ ID NO: 14299 - protein, 11 aa, Artificial Sequence
  Description of Artificial Sequence: Synthetic peptide
  XENP018363 vhCDR3
YYGNYGGYFDV

SEQ ID NO: 14300 - protein, 214 aa, Artificial Sequence
  Description of Artificial Sequence: Synthetic polypeptide
  XENP018363 1G6_H1_L1.20_IgG1_PVA_/S267K Light Chain
SIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14301 - protein, 107 aa, Artificial Sequence; identical to SEQ ID NO: 8674
  Description of Artificial Sequence: Synthetic polypeptide
  VL of XENP018363

SEQ ID NO: 14302 - protein, 11 aa, Artificial Sequence
  Description of Artificial Sequence: Synthetic peptide
  XENP018363 vlCDR1
RASQSVTNDVA

SEQ ID NO: 14303 - protein, 7 aa, Artificial Sequence
  Description of Artificial Sequence: Synthetic peptide
  XENP018363 vlCDR2
YASHRYT

SEQ ID NO: 14304 - protein, 9 aa, Artificial Sequence
  Description of Artificial Sequence: Synthetic peptide
  XENP018363 vlCDR3
QQDYSSPRT

SEQ ID NO: 14305 - protein, 451 aa, Artificial Sequence; identical to SEQ ID NO: 11545
  Description of Artificial Sequence: Synthetic polypeptide
  XENP018364 1G6_H1_L1.21_IgG1_PVA_/S267K Heavy Chain

SEQ ID NO: 14306 - protein, 122 aa, Artificial Sequence; identical to SEQ ID NO: 6246
  Description of Artificial Sequence: Synthetic polypeptide
  VH of XENP018364

SEQ ID NO: 14307 - protein, 5 aa, Artificial Sequence
  Description of Artificial Sequence: Synthetic peptide
  XENP018364 vhCDR1
NYWMN

SEQ ID NO: 14308 - protein, 19 aa, Artificial Sequence
  Description of Artificial Sequence: Synthetic peptide
  XENP018364 vhCDR2
EIRLKSNNYATHYAEPVKG

SEQ ID NO: 14309 - protein, 11 aa, Artificial Sequence
  Description of Artificial Sequence: Synthetic peptide
  XENP018364 vhCDR3
YYGNYGGYFDV

SEQ ID NO: 14310 - protein, 214 aa, Artificial Sequence
  Description of Artificial Sequence: Synthetic polypeptide
  XENP018364 1G6_H1_L1.21_IgG1_PVA_/S267K Light Chain
SIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14311 - protein, 107 aa, Artificial Sequence; identical to SEQ ID NO: 8683
  Description of Artificial Sequence: Synthetic polypeptide
  VL of XENP018364

SEQ ID NO: 14312 - protein, 11 aa, Artificial Sequence
  Description of Artificial Sequence: Synthetic peptide
  XENP018364 vlCDR1
RASQSVANDVA

SEQ ID NO: 14313 - protein, 7 aa, Artificial Sequence
  Description of Artificial Sequence: Synthetic peptide
  XENP018364 vlCDR2
YASHRYT

SEQ ID NO: 14314 - protein, 9 aa, Artificial Sequence
  Description of Artificial Sequence: Synthetic peptide
  XENP018364 vlCDR3
QQDYSSPRT

SEQ ID NO: 14315 - protein, 451 aa, Artificial Sequence; identical to SEQ ID NO: 11545
  Description of Artificial Sequence: Synthetic polypeptide
  XENP018365 1G6_H1_L1.22_IgG1_PVA_/S267K Heavy Chain

SEQ ID NO: 14316 - protein, 122 aa, Artificial Sequence; identical to SEQ ID NO: 6246
  Description of Artificial Sequence: Synthetic polypeptide
  VH of XENP018365

SEQ ID NO: 14317 - protein, 5 aa, Artificial Sequence
  Description of Artificial Sequence: Synthetic peptide
  XENP018365 vhCDR1
NYWMN

SEQ ID NO: 14318 - protein, 19 aa, Artificial Sequence
  Description of Artificial Sequence: Synthetic peptide
  XENP018365 vhCDR2
EIRLKSNNYATHYAEPVKG

SEQ ID NO: 14319 - protein, 11 aa, Artificial Sequence
  Description of Artificial Sequence: Synthetic peptide
  XENP018365 vhCDR3
YYGNYGGYFDV

SEQ ID NO: 14320 - protein, 214 aa, Artificial Sequence
  Description of Artificial Sequence: Synthetic polypeptide
  XENP018365 1G6_H1_L1.22_IgG1_PVA_/S267K Light Chain
SIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14321 - protein, 107 aa, Artificial Sequence; identical to SEQ ID NO: 8692
  Description of Artificial Sequence: Synthetic polypeptide
  VL of XENP018365

SEQ ID NO: 14322 - protein, 11 aa, Artificial Sequence
  Description of Artificial Sequence: Synthetic peptide
  XENP018365 vlCDR1
RASQSVQNDVA

SEQ ID NO: 14323 - protein, 7 aa, Artificial Sequence
  Description of Artificial Sequence: Synthetic peptide
  XENP018365 vlCDR2
YASHRYT

SEQ ID NO: 14324 - protein, 9 aa, Artificial Sequence
  Description of Artificial Sequence: Synthetic peptide
  XENP018365 vlCDR3
QQDYSSPRT

SEQ ID NO: 14325 - protein, 451 aa, Artificial Sequence; identical to SEQ ID NO: 11545
  Description of Artificial Sequence: Synthetic polypeptide
  XENP018366 1G6_H1_L1.23_IgG1_PVA_/S267K Heavy Chain

SEQ ID NO: 14326 - protein, 122 aa, Artificial Sequence; identical to SEQ ID NO: 6246
  Description of Artificial Sequence: Synthetic polypeptide
  VH of XENP018366

SEQ ID NO: 14327 - protein, 5 aa, Artificial Sequence
  Description of Artificial Sequence: Synthetic peptide
  XENP018366 vhCDR1
NYWMN

SEQ ID NO: 14328 - protein, 19 aa, Artificial Sequence
  Description of Artificial Sequence: Synthetic peptide
  XENP018366 vhCDR2
EIRLKSNNYATHYAEPVKG

SEQ ID NO: 14329 - protein, 11 aa, Artificial Sequence
  Description of Artificial Sequence: Synthetic peptide
  XENP018366 vhCDR3
YYGNYGGYFDV

SEQ ID NO: 14330 - protein, 214 aa, Artificial Sequence
  Description of Artificial Sequence: Synthetic polypeptide
  XENP018366 1G6_H1_L1.23_IgG1_PVA_/S267K Light Chain
SIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14331 - protein, 107 aa, Artificial Sequence; identical to SEQ ID NO: 8701
  Description of Artificial Sequence: Synthetic polypeptide
  VL of XENP018366

SEQ ID NO: 14332 - protein, 11 aa, Artificial Sequence
  Description of Artificial Sequence: Synthetic peptide
  XENP018366 vlCDR1
RASQSVGNDVA

SEQ ID NO: 14333 - protein, 7 aa, Artificial Sequence
  Description of Artificial Sequence: Synthetic peptide
  XENP018366 vlCDR2
YASHRYT

SEQ ID NO: 14334 - protein, 9 aa, Artificial Sequence
  Description of Artificial Sequence: Synthetic peptide
  XENP018366 vlCDR3
QQDYSSPRT

SEQ ID NO: 14335 - protein, 451 aa, Artificial Sequence; identical to SEQ ID NO: 11545
  Description of Artificial Sequence: Synthetic polypeptide
  XENP018367 1G6_H1_L1.24_IgG1_PVA_/S267K Heavy Chain

SEQ ID NO: 14336 - protein, 122 aa, Artificial Sequence; identical to SEQ ID NO: 6246
  Description of Artificial Sequence: Synthetic polypeptide
  VH of XENP018367

SEQ ID NO: 14337 - protein, 5 aa, Artificial Sequence
  Description of Artificial Sequence: Synthetic peptide
  XENP018367 vhCDR1
NYWMN

SEQ ID NO: 14338 - protein, 19 aa, Artificial Sequence
  Description of Artificial Sequence: Synthetic peptide
  XENP018367 vhCDR2
EIRLKSNNYATHYAEPVKG

SEQ ID NO: 14339 - protein, 11 aa, Artificial Sequence
  Description of Artificial Sequence: Synthetic peptide
  XENP018367 vhCDR3
YYGNYGGYFDV

SEQ ID NO: 14340 - protein, 214 aa, Artificial Sequence
  Description of Artificial Sequence: Synthetic polypeptide
  XENP018367 1G6_H1_L1.24_IgG1_PVA_/S267K Light Chain
SIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14341 - protein, 107 aa, Artificial Sequence; identical to SEQ ID NO: 8710
  Description of Artificial Sequence: Synthetic polypeptide
  VL of XENP018367

SEQ ID NO: 14342 - protein, 11 aa, Artificial Sequence
  Description of Artificial Sequence: Synthetic peptide
  XENP018367 vlCDR1
RASQSVVNDVA

SEQ ID NO: 14343 - protein, 7 aa, Artificial Sequence
  Description of Artificial Sequence: Synthetic peptide
  XENP018367 vlCDR2
YASHRYT

SEQ ID NO: 14344 - protein, 9 aa, Artificial Sequence
  Description of Artificial Sequence: Synthetic peptide
  XENP018367 vlCDR3
QQDYSSPRT

SEQ ID NO: 14345 - protein, 451 aa, Artificial Sequence; identical to SEQ ID NO: 11545
  Description of Artificial Sequence: Synthetic polypeptide
  XENP018368 1G6_H1_L1.25_IgG1_PVA_/S267K Heavy Chain

SEQ ID NO: 14346 - protein, 122 aa, Artificial Sequence; identical to SEQ ID NO: 6246
  Description of Artificial Sequence: Synthetic polypeptide
  VH of XENP018368

SEQ ID NO: 14347 - protein, 5 aa, Artificial Sequence
  Description of Artificial Sequence: Synthetic peptide
  XENP018368 vhCDR1
NYWMN

SEQ ID NO: 14348 - protein, 19 aa, Artificial Sequence
  Description of Artificial Sequence: Synthetic peptide
  XENP018368 vhCDR2
EIRLKSNNYATHYAEPVKG

SEQ ID NO: 14349 - protein, 11 aa, Artificial Sequence
  Description of Artificial Sequence: Synthetic peptide
  XENP018368 vhCDR3
YYGNYGGYFDV

SEQ ID NO: 14350 - protein, 214 aa, Artificial Sequence
  Description of Artificial Sequence: Synthetic polypeptide
  XENP018368 1G6_H1_L1.25_IgG1_PVA_/S267K Light Chain
SIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14351 - protein, 107 aa, Artificial Sequence; identical to SEQ ID NO: 8719
  Description of Artificial Sequence: Synthetic polypeptide
  VL of XENP018368

SEQ ID NO: 14352 - protein, 11 aa, Artificial Sequence
  Description of Artificial Sequence: Synthetic peptide
  XENP018368 vlCDR1
RASQSVHNDVA

SEQ ID NO: 14353 - protein, 7 aa, Artificial Sequence
  Description of Artificial Sequence: Synthetic peptide
  XENP018368 vlCDR2
YASHRYT

SEQ ID NO: 14354 - protein, 9 aa, Artificial Sequence
  Description of Artificial Sequence: Synthetic peptide
  XENP018368 vlCDR3
QQDYSSPRT

SEQ ID NO: 14355 - protein, 451 aa, Artificial Sequence; identical to SEQ ID NO: 11545
  Description of Artificial Sequence: Synthetic polypeptide
  XENP018369 1G6_H1_L1.26_IgG1_PVA_/S267K Heavy Chain

SEQ ID NO: 14356 - protein, 122 aa, Artificial Sequence; identical to SEQ ID NO: 6246
  Description of Artificial Sequence: Synthetic polypeptide
  VH of XENP018369

SEQ ID NO: 14357 - protein, 5 aa, Artificial Sequence
  Description of Artificial Sequence: Synthetic peptide
  XENP018369 vhCDR1
NYWMN

SEQ ID NO: 14358 - protein, 19 aa, Artificial Sequence
  Description of Artificial Sequence: Synthetic peptide
  XENP018369 vhCDR2
EIRLKSNNYATHYAEPVKG

SEQ ID NO: 14359 - protein, 11 aa, Artificial Sequence
  Description of Artificial Sequence: Synthetic peptide
  XENP018369 vhCDR3
YYGNYGGYFDV

SEQ ID NO: 14360 - protein, 214 aa, Artificial Sequence
  Description of Artificial Sequence: Synthetic polypeptide
  XENP018369 1G6_H1_L1.26_IgG1_PVA_/S267K Light Chain
SIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14361 - protein, 107 aa, Artificial Sequence; identical to SEQ ID NO: 8728
  Description of Artificial Sequence: Synthetic polypeptide
  VL of XENP018369

SEQ ID NO: 14362 - protein, 11 aa, Artificial Sequence
  Description of Artificial Sequence: Synthetic peptide
  XENP018369 vlCDR1
RASQSVDNDVA

SEQ ID NO: 14363 - protein, 7 aa, Artificial Sequence
  Description of Artificial Sequence: Synthetic peptide
  XENP018369 vlCDR2
YASHRYT

SEQ ID NO: 14364 - protein, 9 aa, Artificial Sequence
  Description of Artificial Sequence: Synthetic peptide
  XENP018369 vlCDR3
QQDYSSPRT

SEQ ID NO: 14365 - protein, 451 aa, Artificial Sequence; identical to SEQ ID NO: 11545
  Description of Artificial Sequence: Synthetic polypeptide
  XENP018370 1G6_H1_L1.27_IgG1_PVA_/S267K Heavy Chain

SEQ ID NO: 14366 - protein, 122 aa, Artificial Sequence; identical to SEQ ID NO: 6246
  Description of Artificial Sequence: Synthetic polypeptide
  VH of XENP018370

SEQ ID NO: 14367 - protein, 5 aa, Artificial Sequence
  Description of Artificial Sequence: Synthetic peptide
  XENP018370 vhCDR1
NYWMN

SEQ ID NO: 14368 - protein, 19 aa, Artificial Sequence
  Description of Artificial Sequence: Synthetic peptide
  XENP018370 vhCDR2
EIRLKSNNYATHYAEPVKG

SEQ ID NO: 14369 - protein, 11 aa, Artificial Sequence
  Description of Artificial Sequence: Synthetic peptide
  XENP018370 vhCDR3
YYGNYGGYFDV

SEQ ID NO: 14370 - protein, 214 aa, Artificial Sequence
  Description of Artificial Sequence: Synthetic polypeptide
  XENP018370 1G6_H1_L1.27_IgG1_PVA_/S267K Light Chain
SIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14371 - protein, 107 aa, Artificial Sequence; identical to SEQ ID NO: 8737
  Description of Artificial Sequence: Synthetic polypeptide
  VL of XENP018370

SEQ ID NO: 14372 - protein, 11 aa, Artificial Sequence
  Description of Artificial Sequence: Synthetic peptide
  XENP018370 vlCDR1
RASQSVKNDVA

SEQ ID NO: 14373 - protein, 7 aa, Artificial Sequence
  Description of Artificial Sequence: Synthetic peptide
  XENP018370 vlCDR2
YASHRYT

SEQ ID NO: 14374 - protein, 9 aa, Artificial Sequence
  Description of Artificial Sequence: Synthetic peptide
  XENP018370 vlCDR3
QQDYSSPRT

SEQ ID NO: 14375 - protein, 451 aa, Artificial Sequence; identical to SEQ ID NO: 11545
  Description of Artificial Sequence: Synthetic polypeptide
  XENP018371 1G6_H1_L1.28_IgG1_PVA_/S267K Heavy Chain

SEQ ID NO: 14376 - protein, 122 aa, Artificial Sequence; identical to SEQ ID NO: 6246
  Description of Artificial Sequence: Synthetic polypeptide
  VH of XENP018371

SEQ ID NO: 14377 - protein, 5 aa, Artificial Sequence
  Description of Artificial Sequence: Synthetic peptide
  XENP018371 vhCDR1
NYWMN

SEQ ID NO: 14378 - protein, 19 aa, Artificial Sequence
  Description of Artificial Sequence: Synthetic peptide
  XENP018371 vhCDR2
EIRLKSNNYATHYAEPVKG

SEQ ID NO: 14379 - protein, 11 aa, Artificial Sequence
  Description of Artificial Sequence: Synthetic peptide
  XENP018371 vhCDR3
YYGNYGGYFDV

SEQ ID NO: 14380 - protein, 214 aa, Artificial Sequence
  Description of Artificial Sequence: Synthetic polypeptide
  XENP018371 1G6_H1_L1.28_IgG1_PVA_/S267K Light Chain
SIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14381 - protein, 107 aa, Artificial Sequence; identical to SEQ ID NO: 8746
  Description of Artificial Sequence: Synthetic polypeptide
  VL of XENP018371

SEQ ID NO: 14382 - protein, 11 aa, Artificial Sequence
  Description of Artificial Sequence: Synthetic peptide
  XENP018371 vlCDR1
RASQSVYNDVA

SEQ ID NO: 14383 - protein, 7 aa, Artificial Sequence
  Description of Artificial Sequence: Synthetic peptide
  XENP018371 vlCDR2
YASHRYT

SEQ ID NO: 14384 - protein, 9 aa, Artificial Sequence
  Description of Artificial Sequence: Synthetic peptide
  XENP018371 vlCDR3
QQDYSSPRT

SEQ ID NO: 14385 - protein, 451 aa, Artificial Sequence; identical to SEQ ID NO: 11545
  Description of Artificial Sequence: Synthetic polypeptide
  XENP018372 1G6_H1_L1.29_IgG1_PVA_/S267K Heavy Chain

SEQ ID NO: 14386 - protein, 122 aa, Artificial Sequence; identical to SEQ ID NO: 6246
  Description of Artificial Sequence: Synthetic polypeptide
  VH of XENP018372

SEQ ID NO: 14387 - protein, 5 aa, Artificial Sequence
  Description of Artificial Sequence: Synthetic peptide
  XENP018372 vhCDR1
NYWMN

SEQ ID NO: 14388 - protein, 19 aa, Artificial Sequence
  Description of Artificial Sequence: Synthetic peptide
  XENP018372 vhCDR2
EIRLKSNNYATHYAEPVKG

SEQ ID NO: 14389 - protein, 11 aa, Artificial Sequence
  Description of Artificial Sequence: Synthetic peptide
  XENP018372 vhCDR3
YYGNYGGYFDV

SEQ ID NO: 14390 - protein, 214 aa, Artificial Sequence
  Description of Artificial Sequence: Synthetic polypeptide
  XENP018372 1G6_H1_L1.29_IgG1_PVA_/S267K Light Chain
SIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14391 - protein, 107 aa, Artificial Sequence; identical to SEQ ID NO: 8755
  Description of Artificial Sequence: Synthetic polypeptide
  VL of XENP018372

SEQ ID NO: 14392 - protein, 11 aa, Artificial Sequence
  Description of Artificial Sequence: Synthetic peptide
  XENP018372 vlCDR1
RASQSVSDDVA

SEQ ID NO: 14393 - protein, 7 aa, Artificial Sequence
  Description of Artificial Sequence: Synthetic peptide
  XENP018372 vlCDR2
YASHRYT

SEQ ID NO: 14394 - protein, 9 aa, Artificial Sequence
  Description of Artificial Sequence: Synthetic peptide
  XENP018372 vlCDR3
QQDYSSPRT

SEQ ID NO: 14395 - protein, 451 aa, Artificial Sequence; identical to SEQ ID NO: 11545
  Description of Artificial Sequence: Synthetic polypeptide
  XENP018373 1G6_H1_L1.30_IgG1_PVA_/S267K Heavy Chain

SEQ ID NO: 14396 - protein, 122 aa, Artificial Sequence; identical to SEQ ID NO: 6246
  Description of Artificial Sequence: Synthetic polypeptide
  VH of XENP018373

SEQ ID NO: 14397 - protein, 5 aa, Artificial Sequence
  Description of Artificial Sequence: Synthetic peptide
  XENP018373 vhCDR1
NYWMN

SEQ ID NO: 14398 - protein, 19 aa, Artificial Sequence
  Description of Artificial Sequence: Synthetic peptide
  XENP018373 vhCDR2
EIRLKSNNYATHYAEPVKG

SEQ ID NO: 14399 - protein, 11 aa, Artificial Sequence
  Description of Artificial Sequence: Synthetic peptide
  XENP018373 vhCDR3
YYGNYGGYFDV

SEQ ID NO: 14400 - protein, 214 aa, Artificial Sequence
  Description of Artificial Sequence: Synthetic polypeptide
  XENP018373 1G6_H1_L1.30_IgG1_PVA_/S267K Light Chain
SIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14401 - protein, 107 aa, Artificial Sequence; identical to SEQ ID NO: 8764
  Description of Artificial Sequence: Synthetic polypeptide
  VL of XENP018373

SEQ ID NO: 14402 - protein, 11 aa, Artificial Sequence
  Description of Artificial Sequence: Synthetic peptide
  XENP018373 vlCDR1
RASQSVSHDVA

SEQ ID NO: 14403 - protein, 7 aa, Artificial Sequence
  Description of Artificial Sequence: Synthetic peptide
  XENP018373 vlCDR2
YASHRYT

SEQ ID NO: 14404 - protein, 9 aa, Artificial Sequence
  Description of Artificial Sequence: Synthetic peptide
  XENP018373 vlCDR3
QQDYSSPRT

SEQ ID NO: 14405 - protein, 451 aa, Artificial Sequence; identical to SEQ ID NO: 11545
  Description of Artificial Sequence: Synthetic polypeptide
  XENP018374 1G6_H1_L1.31_IgG1_PVA_/S267K Heavy Chain

SEQ ID NO: 14406 - protein, 122 aa, Artificial Sequence; identical to SEQ ID NO: 6246
  Description of Artificial Sequence: Synthetic polypeptide
  VH of XENP018374

SEQ ID NO: 14407 - protein, 5 aa, Artificial Sequence
  Description of Artificial Sequence: Synthetic peptide
  XENP018374 vhCDR1
NYWMN

SEQ ID NO: 14408 - protein, 19 aa, Artificial Sequence
  Description of Artificial Sequence: Synthetic peptide
  XENP018374 vhCDR2
EIRLKSNNYATHYAEPVKG

SEQ ID NO: 14409 - protein, 11 aa, Artificial Sequence
  Description of Artificial Sequence: Synthetic peptide
  XENP018374 vhCDR3
YYGNYGGYFDV

SEQ ID NO: 14410 - protein, 214 aa, Artificial Sequence
  Description of Artificial Sequence: Synthetic polypeptide
  XENP018374 1G6_H1_L1.31_IgG1_PVA_/S267K Light Chain
SIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14411 - protein, 107 aa, Artificial Sequence; identical to SEQ ID NO: 8773
  Description of Artificial Sequence: Synthetic polypeptide
  VL of XENP018374

SEQ ID NO: 14412 - protein, 11 aa, Artificial Sequence
  Description of Artificial Sequence: Synthetic peptide
  XENP018374 vlCDR1
RASQSVSEDVA

SEQ ID NO: 14413 - protein, 7 aa, Artificial Sequence
  Description of Artificial Sequence: Synthetic peptide
  XENP018374 vlCDR2
YASHRYT

SEQ ID NO: 14414 - protein, 9 aa, Artificial Sequence
  Description of Artificial Sequence: Synthetic peptide
  XENP018374 vlCDR3
QQDYSSPRT

SEQ ID NO: 14415 - protein, 451 aa, Artificial Sequence; identical to SEQ ID NO: 11545
  Description of Artificial Sequence: Synthetic polypeptide
  XENP018375 1G6_H1_L1.32_IgG1_PVA_/S267K Heavy Chain

SEQ ID NO: 14416 - protein, 122 aa, Artificial Sequence; identical to SEQ ID NO: 6246
  Description of Artificial Sequence: Synthetic polypeptide
  VH of XENP018375

SEQ ID NO: 14417 - protein, 5 aa, Artificial Sequence
  Description of Artificial Sequence: Synthetic peptide
  XENP018375 vhCDR1
NYWMN

SEQ ID NO: 14418 - protein, 19 aa, Artificial Sequence
  Description of Artificial Sequence: Synthetic peptide
  XENP018375 vhCDR2
EIRLKSNNYATHYAEPVKG

SEQ ID NO: 14419 - protein, 11 aa, Artificial Sequence
  Description of Artificial Sequence: Synthetic peptide
  XENP018375 vhCDR3
YYGNYGGYFDV

SEQ ID NO: 14420 - protein, 214 aa, Artificial Sequence
  Description of Artificial Sequence: Synthetic polypeptide
  XENP018375 1G6_H1_L1.32_IgG1_PVA_/S267K Light Chain
SIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14421 - protein, 107 aa, Artificial Sequence; identical to SEQ ID NO: 8782
  Description of Artificial Sequence: Synthetic polypeptide
  VL of XENP018375

SEQ ID NO: 14422 - protein, 11 aa, Artificial Sequence
  Description of Artificial Sequence: Synthetic peptide
  XENP018375 vlCDR1
RASQSVSSDVA

SEQ ID NO: 14423 - protein, 7 aa, Artificial Sequence
  Description of Artificial Sequence: Synthetic peptide
  XENP018375 vlCDR2
YASHRYT

SEQ ID NO: 14424 - protein, 9 aa, Artificial Sequence
  Description of Artificial Sequence: Synthetic peptide
  XENP018375 vlCDR3
QQDYSSPRT

SEQ ID NO: 14425 - protein, 451 aa, Artificial Sequence; identical to SEQ ID NO: 11545
  Description of Artificial Sequence: Synthetic polypeptide
  XENP018376 1G6_H1_L1.33_IgG1_PVA_/S267K Heavy Chain

SEQ ID NO: 14426 - protein, 122 aa, Artificial Sequence; identical to SEQ ID NO: 6246
  Description of Artificial Sequence: Synthetic polypeptide
  VH of XENP018376

SEQ ID NO: 14427 - protein, 5 aa, Artificial Sequence
  Description of Artificial Sequence: Synthetic peptide
  XENP018376 vhCDR1
NYWMN

SEQ ID NO: 14428 - protein, 19 aa, Artificial Sequence
  Description of Artificial Sequence: Synthetic peptide
  XENP018376 vhCDR2
EIRLKSNNYATHYAEPVKG

SEQ ID NO: 14429 - protein, 11 aa, Artificial Sequence
  Description of Artificial Sequence: Synthetic peptide
  XENP018376 vhCDR3
YYGNYGGYFDV

SEQ ID NO: 14430 - protein, 214 aa, Artificial Sequence
  Description of Artificial Sequence: Synthetic polypeptide
  XENP018376 1G6_H1_L1.33_IgG1_PVA_/S267K Light Chain
SIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14431 - protein, 107 aa, Artificial Sequence; identical to SEQ ID NO: 8791
  Description of Artificial Sequence: Synthetic polypeptide
  VL of XENP018376

SEQ ID NO: 14432 - protein, 11 aa, Artificial Sequence
  Description of Artificial Sequence: Synthetic peptide
  XENP018376 vlCDR1
RASQSVSRDVA

SEQ ID NO: 14433 - protein, 7 aa, Artificial Sequence
  Description of Artificial Sequence: Synthetic peptide
  XENP018376 vlCDR2
YASHRYT

SEQ ID NO: 14434 - protein, 9 aa, Artificial Sequence
  Description of Artificial Sequence: Synthetic peptide
  XENP018376 vlCDR3
QQDYSSPRT

SEQ ID NO: 14435 - protein, 451 aa, Artificial Sequence; identical to SEQ ID NO: 11545
  Description of Artificial Sequence: Synthetic polypeptide
  XENP018377 1G6_H1_L1.34_IgG1_PVA_/S267K Heavy Chain

SEQ ID NO: 14436 - protein, 122 aa, Artificial Sequence; identical to SEQ ID NO: 6246
  Description of Artificial Sequence: Synthetic polypeptide
  VH of XENP018377

SEQ ID NO: 14437 - protein, 5 aa, Artificial Sequence
  Description of Artificial Sequence: Synthetic peptide
  XENP018377 vhCDR1
NYWMN

SEQ ID NO: 14438 - protein, 19 aa, Artificial Sequence
  Description of Artificial Sequence: Synthetic peptide
  XENP018377 vhCDR2
EIRLKSNNYATHYAEPVKG

SEQ ID NO: 14439 - protein, 11 aa, Artificial Sequence
  Description of Artificial Sequence: Synthetic peptide
  XENP018377 vhCDR3
YYGNYGGYFDV

SEQ ID NO: 14440 - protein, 214 aa, Artificial Sequence
  Description of Artificial Sequence: Synthetic polypeptide
  XENP018377 1G6_H1_L1.34_IgG1_PVA_/S267K Light Chain
SIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14441 - protein, 107 aa, Artificial Sequence; identical to SEQ ID NO: 8800
  Description of Artificial Sequence: Synthetic polypeptide
  VL of XENP018377

SEQ ID NO: 14442 - protein, 11 aa, Artificial Sequence
  Description of Artificial Sequence: Synthetic peptide
  XENP018377 vlCDR1
RASQSVSLDVA

SEQ ID NO: 14443 - protein, 7 aa, Artificial Sequence
  Description of Artificial Sequence: Synthetic peptide
  XENP018377 vlCDR2
YASHRYT

SEQ ID NO: 14444 - protein, 9 aa, Artificial Sequence
  Description of Artificial Sequence: Synthetic peptide
  XENP018377 vlCDR3
QQDYSSPRT

SEQ ID NO: 14445 - protein, 451 aa, Artificial Sequence; identical to SEQ ID NO: 11545
  Description of Artificial Sequence: Synthetic polypeptide
  XENP018378 1G6_H1_L1.35_IgG1_PVA_/S267K Heavy Chain

SEQ ID NO: 14446 - protein, 122 aa, Artificial Sequence; identical to SEQ ID NO: 6246
  Description of Artificial Sequence: Synthetic polypeptide
  VH of XENP018378

SEQ ID NO: 14447 - protein, 5 aa, Artificial Sequence
  Description of Artificial Sequence: Synthetic peptide
  XENP018378 vhCDR1
NYWMN

SEQ ID NO: 14448 - protein, 19 aa, Artificial Sequence
  Description of Artificial Sequence: Synthetic peptide
  XENP018378 vhCDR2
EIRLKSNNYATHYAEPVKG

SEQ ID NO: 14449 - protein, 11 aa, Artificial Sequence
  Description of Artificial Sequence: Synthetic peptide
  XENP018378 vhCDR3
YYGNYGGYFDV

SEQ ID NO: 14450 - protein, 214 aa, Artificial Sequence
  Description of Artificial Sequence: Synthetic polypeptide
  XENP018378 1G6_H1_L1.35_IgG1_PVA_/S267K Light Chain
SIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14451 - protein, 107 aa, Artificial Sequence; identical to SEQ ID NO: 8809
  Description of Artificial Sequence: Synthetic polypeptide
  VL of XENP018378

SEQ ID NO: 14452 - protein, 11 aa, Artificial Sequence
  Description of Artificial Sequence: Synthetic peptide
  XENP018378 vlCDR1
RASQSVSTDVA

SEQ ID NO: 14453 - protein, 7 aa, Artificial Sequence
  Description of Artificial Sequence: Synthetic peptide
  XENP018378 vlCDR2
YASHRYT

SEQ ID NO: 14454 - protein, 9 aa, Artificial Sequence
  Description of Artificial Sequence: Synthetic peptide
  XENP018378 vlCDR3
QQDYSSPRT

SEQ ID NO: 14455 - protein, 451 aa, Artificial Sequence; identical to SEQ ID NO: 11545
  Description of Artificial Sequence: Synthetic polypeptide
  XENP018379 1G6_H1_L1.36_IgG1_PVA_/S267K Heavy Chain

SEQ ID NO: 14456 - protein, 122 aa, Artificial Sequence; identical to SEQ ID NO: 6246
  Description of Artificial Sequence: Synthetic polypeptide
  VH of XENP018379

SEQ ID NO: 14457 - protein, 5 aa, Artificial Sequence
  Description of Artificial Sequence: Synthetic peptide
  XENP018379 vhCDR1
NYWMN

SEQ ID NO: 14458 - protein, 19 aa, Artificial Sequence
  Description of Artificial Sequence: Synthetic peptide
  XENP018379 vhCDR2
EIRLKSNNYATHYAEPVKG

SEQ ID NO: 14459 - protein, 11 aa, Artificial Sequence
  Description of Artificial Sequence: Synthetic peptide
  XENP018379 vhCDR3
YYGNYGGYFDV

SEQ ID NO: 14460 - protein, 214 aa, Artificial Sequence
  Description of Artificial Sequence: Synthetic polypeptide
  XENP018379 1G6_H1_L1.36_IgG1_PVA_/S267K Light Chain
SIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14461 - protein, 107 aa, Artificial Sequence; identical to SEQ ID NO: 8818
  Description of Artificial Sequence: Synthetic polypeptide
  VL of XENP018379

SEQ ID NO: 14462 - protein, 11 aa, Artificial Sequence
  Description of Artificial Sequence: Synthetic peptide
  XENP018379 vlCDR1
RASQSVSGDVA

SEQ ID NO: 14463 - protein, 7 aa, Artificial Sequence
  Description of Artificial Sequence: Synthetic peptide
  XENP018379 vlCDR2
YASHRYT

SEQ ID NO: 14464 - protein, 9 aa, Artificial Sequence
  Description of Artificial Sequence: Synthetic peptide
  XENP018379 vlCDR3
QQDYSSPRT

SEQ ID NO: 14465 - protein, 451 aa, Artificial Sequence; identical to SEQ ID NO: 11545
  Description of Artificial Sequence: Synthetic polypeptide
  XENP018380 1G6_H1_L1.37_IgG1_PVA_/S267K Heavy Chain

SEQ ID NO: 14466 - protein, 122 aa, Artificial Sequence; identical to SEQ ID NO: 6246
  Description of Artificial Sequence: Synthetic polypeptide
  VH of XENP018380

SEQ ID NO: 14467 - protein, 5 aa, Artificial Sequence
  Description of Artificial Sequence: Synthetic peptide
  XENP018380 vhCDR1
NYWMN

SEQ ID NO: 14468 - protein, 19 aa, Artificial Sequence
  Description of Artificial Sequence: Synthetic peptide
  XENP018380 vhCDR2
EIRLKSNNYATHYAEPVKG

SEQ ID NO: 14469 - protein, 11 aa, Artificial Sequence
  Description of Artificial Sequence: Synthetic peptide
  XENP018380 vhCDR3
YYGNYGGYFDV

SEQ ID NO: 14470 - protein, 214 aa, Artificial Sequence
  Description of Artificial Sequence: Synthetic polypeptide
  XENP018380 1G6_H1_L1.37_IgG1_PVA_/S267K Light Chain
SIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14471 - protein, 107 aa, Artificial Sequence; identical to SEQ ID NO: 8827
  Description of Artificial Sequence: Synthetic polypeptide
  VL of XENP018380

SEQ ID NO: 14472 - protein, 11 aa, Artificial Sequence
  Description of Artificial Sequence: Synthetic peptide
  XENP018380 vlCDR1
RASQSVSYDVA

SEQ ID NO: 14473 - protein, 7 aa, Artificial Sequence
  Description of Artificial Sequence: Synthetic peptide
  XENP018380 vlCDR2
YASHRYT

SEQ ID NO: 14474 - protein, 9 aa, Artificial Sequence
  Description of Artificial Sequence: Synthetic peptide
  XENP018380 vlCDR3
QQDYSSPRT

SEQ ID NO: 14475 - protein, 451 aa, Artificial Sequence; identical to SEQ ID NO: 11545
  Description of Artificial Sequence: Synthetic polypeptide
  XENP018381 1G6_H1_L1.38_IgG1_PVA_/S267K Heavy Chain

SEQ ID NO: 14476 - protein, 122 aa, Artificial Sequence; identical to SEQ ID NO: 6246
  Description of Artificial Sequence: Synthetic polypeptide
  VH of XENP018381

SEQ ID NO: 14477 - protein, 5 aa, Artificial Sequence
  Description of Artificial Sequence: Synthetic peptide
  XENP018381 vhCDR1
NYWMN

SEQ ID NO: 14478 - protein, 19 aa, Artificial Sequence
  Description of Artificial Sequence: Synthetic peptide
  XENP018381 vhCDR2
EIRLKSNNYATHYAEPVKG

SEQ ID NO: 14479 - protein, 11 aa, Artificial Sequence
  Description of Artificial Sequence: Synthetic peptide
  XENP018381 vhCDR3
YYGNYGGYFDV

SEQ ID NO: 14480 - protein, 214 aa, Artificial Sequence
  Description of Artificial Sequence: Synthetic polypeptide
  XENP018381 1G6_H1_L1.38_IgG1_PVA_/S267K Light Chain
SIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14481 - protein, 107 aa, Artificial Sequence; identical to SEQ ID NO: 8836
  Description of Artificial Sequence: Synthetic polypeptide
  VL of XENP018381

SEQ ID NO: 14482 - protein, 11 aa, Artificial Sequence
  Description of Artificial Sequence: Synthetic peptide
  XENP018381 vlCDR1
RASQSVSNNVA

SEQ ID NO: 14483 - protein, 7 aa, Artificial Sequence
  Description of Artificial Sequence: Synthetic peptide
  XENP018381 vlCDR2
YASHRYT

SEQ ID NO: 14484 - protein, 9 aa, Artificial Sequence
  Description of Artificial Sequence: Synthetic peptide
  XENP018381 vlCDR3
QQDYSSPRT

SEQ ID NO: 14485 - protein, 451 aa, Artificial Sequence; identical to SEQ ID NO: 11545
  Description of Artificial Sequence: Synthetic polypeptide
  XENP018382 1G6_H1_L1.39_IgG1_PVA_/S267K Heavy Chain

SEQ ID NO: 14486 - protein, 122 aa, Artificial Sequence; identical to SEQ ID NO: 6246
  Description of Artificial Sequence: Synthetic polypeptide
  VH of XENP018382

SEQ ID NO: 14487 - protein, 5 aa, Artificial Sequence
  Description of Artificial Sequence: Synthetic peptide
  XENP018382 vhCDR1
NYWMN

SEQ ID NO: 14488 - protein, 19 aa, Artificial Sequence
  Description of Artificial Sequence: Synthetic peptide
  XENP018382 vhCDR2
EIRLKSNNYATHYAEPVKG

SEQ ID NO: 14489 - protein, 11 aa, Artificial Sequence
  Description of Artificial Sequence: Synthetic peptide
  XENP018382 vhCDR3
YYGNYGGYFDV

SEQ ID NO: 14490 - protein, 214 aa, Artificial Sequence
  Description of Artificial Sequence: Synthetic polypeptide
  XENP018382 1G6_H1_L1.39_IgG1_PVA_/S267K Light Chain
SIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14491 - protein, 107 aa, Artificial Sequence; identical to SEQ ID NO: 8845
  Description of Artificial Sequence: Synthetic polypeptide
  VL of XENP018382

SEQ ID NO: 14492 - protein, 11 aa, Artificial Sequence
  Description of Artificial Sequence: Synthetic peptide
  XENP018382 vlCDR1
RASQSVSNEVA

SEQ ID NO: 14493 - protein, 7 aa, Artificial Sequence
  Description of Artificial Sequence: Synthetic peptide
  XENP018382 vlCDR2
YASHRYT

SEQ ID NO: 14494 - protein, 9 aa, Artificial Sequence
  Description of Artificial Sequence: Synthetic peptide
  XENP018382 vlCDR3
QQDYSSPRT

SEQ ID NO: 14495 - protein, 451 aa, Artificial Sequence; identical to SEQ ID NO: 11545
  Description of Artificial Sequence: Synthetic polypeptide
  XENP018383 1G6_H1_L1.40_IgG1_PVA_/S267K Heavy Chain

SEQ ID NO: 14496 - protein, 122 aa, Artificial Sequence; identical to SEQ ID NO: 6246
  Description of Artificial Sequence: Synthetic polypeptide
  VH of XENP018383

SEQ ID NO: 14497 - protein, 5 aa, Artificial Sequence
  Description of Artificial Sequence: Synthetic peptide
  XENP018383 vhCDR1
NYWMN

SEQ ID NO: 14498 - protein, 19 aa, Artificial Sequence
  Description of Artificial Sequence: Synthetic peptide
  XENP018383 vhCDR2
EIRLKSNNYATHYAEPVKG

SEQ ID NO: 14499 - protein, 11 aa, Artificial Sequence
  Description of Artificial Sequence: Synthetic peptide
  XENP018383 vhCDR3
YYGNYGGYFDV

SEQ ID NO: 14500 - protein, 214 aa, Artificial Sequence
  Description of Artificial Sequence: Synthetic polypeptide
  XENP018383 1G6_H1_L1.40_IgG1_PVA_/S267K Light Chain
SIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14501 - protein, 107 aa, Artificial Sequence; identical to SEQ ID NO: 8854
  Description of Artificial Sequence: Synthetic polypeptide
  VL of XENP018383

SEQ ID NO: 14502 - protein, 11 aa, Artificial Sequence
  Description of Artificial Sequence: Synthetic peptide
  XENP018383 vlCDR1
RASQSVSNHVA

SEQ ID NO: 14503 - protein, 7 aa, Artificial Sequence
  Description of Artificial Sequence: Synthetic peptide
  XENP018383 vlCDR2
YASHRYT

SEQ ID NO: 14504 - protein, 9 aa, Artificial Sequence
  Description of Artificial Sequence: Synthetic peptide
  XENP018383 vlCDR3
QQDYSSPRT

SEQ ID NO: 14505 - protein, 451 aa, Artificial Sequence; identical to SEQ ID NO: 11545
  Description of Artificial Sequence: Synthetic polypeptide
  XENP018384 1G6_H1_L1.41_IgG1_PVA_/S267K Heavy Chain

SEQ ID NO: 14506 - protein, 122 aa, Artificial Sequence; identical to SEQ ID NO: 6246
  Description of Artificial Sequence: Synthetic polypeptide
  VH of XENP018384

SEQ ID NO: 14507 - protein, 5 aa, Artificial Sequence
  Description of Artificial Sequence: Synthetic peptide
  XENP018384 vhCDR1
NYWMN

SEQ ID NO: 14508 - protein, 19 aa, Artificial Sequence
  Description of Artificial Sequence: Synthetic peptide
  XENP018384 vhCDR2
EIRLKSNNYATHYAEPVKG

SEQ ID NO: 14509 - protein, 11 aa, Artificial Sequence
  Description of Artificial Sequence: Synthetic peptide
  XENP018384 vhCDR3
YYGNYGGYFDV

SEQ ID NO: 14510 - protein, 214 aa, Artificial Sequence
  Description of Artificial Sequence: Synthetic polypeptide
  XENP018384 1G6_H1_L1.41_IgG1_PVA_/S267K Light Chain
SIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14511 - protein, 107 aa, Artificial Sequence; identical to SEQ ID NO: 8863
  Description of Artificial Sequence: Synthetic polypeptide
  VL of XENP018384

SEQ ID NO: 14512 - protein, 11 aa, Artificial Sequence
  Description of Artificial Sequence: Synthetic peptide
  XENP018384 vlCDR1
RASQSVSNSVA

SEQ ID NO: 14513 - protein, 7 aa, Artificial Sequence
  Description of Artificial Sequence: Synthetic peptide
  XENP018384 vlCDR2
YASHRYT

SEQ ID NO: 14514 - protein, 9 aa, Artificial Sequence
  Description of Artificial Sequence: Synthetic peptide
  XENP018384 vlCDR3
QQDYSSPRT

SEQ ID NO: 14515 - protein, 451 aa, Artificial Sequence; identical to SEQ ID NO: 11545
  Description of Artificial Sequence: Synthetic polypeptide
  XENP018385 1G6_H1_L1.42_IgG1_PVA_/S267K Heavy Chain

SEQ ID NO: 14516 - protein, 122 aa, Artificial Sequence; identical to SEQ ID NO: 6246
  Description of Artificial Sequence: Synthetic polypeptide
  VH of XENP018385

SEQ ID NO: 14517 - protein, 5 aa, Artificial Sequence
  Description of Artificial Sequence: Synthetic peptide
  XENP018385 vhCDR1
NYWMN

SEQ ID NO: 14518 - protein, 19 aa, Artificial Sequence
  Description of Artificial Sequence: Synthetic peptide
  XENP018385 vhCDR2
EIRLKSNNYATHYAEPVKG

SEQ ID NO: 14519 - protein, 11 aa, Artificial Sequence
  Description of Artificial Sequence: Synthetic peptide
  XENP018385 vhCDR3
YYGNYGGYFDV

SEQ ID NO: 14520 - protein, 214 aa, Artificial Sequence
  Description of Artificial Sequence: Synthetic polypeptide
  XENP018385 1G6_H1_L1.42_IgG1_PVA_/S267K Light Chain
SIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14521 - protein, 107 aa, Artificial Sequence; identical to SEQ ID NO: 8872
  Description of Artificial Sequence: Synthetic polypeptide
  VL of XENP018385

SEQ ID NO: 14522 - protein, 11 aa, Artificial Sequence
  Description of Artificial Sequence: Synthetic peptide
  XENP018385 vlCDR1
RASQSVSNRVA

SEQ ID NO: 14523 - protein, 7 aa, Artificial Sequence
  Description of Artificial Sequence: Synthetic peptide
  XENP018385 vlCDR2
YASHRYT

SEQ ID NO: 14524 - protein, 9 aa, Artificial Sequence
  Description of Artificial Sequence: Synthetic peptide
  XENP018385 vlCDR3
QQDYSSPRT

SEQ ID NO: 14525 - protein, 451 aa, Artificial Sequence; identical to SEQ ID NO: 11545
  Description of Artificial Sequence: Synthetic polypeptide
  XENP018386 1G6_H1_L1.43_IgG1_PVA_/S267K Heavy Chain

SEQ ID NO: 14526 - protein, 122 aa, Artificial Sequence; identical to SEQ ID NO: 6246
  Description of Artificial Sequence: Synthetic polypeptide
  VH of XENP018386

SEQ ID NO: 14527 - protein, 5 aa, Artificial Sequence
  Description of Artificial Sequence: Synthetic peptide
  XENP018386 vhCDR1
NYWMN

SEQ ID NO: 14528 - protein, 19 aa, Artificial Sequence
  Description of Artificial Sequence: Synthetic peptide
  XENP018386 vhCDR2
EIRLKSNNYATHYAEPVKG

SEQ ID NO: 14529 - protein, 11 aa, Artificial Sequence
  Description of Artificial Sequence: Synthetic peptide
  XENP018386 vhCDR3
YYGNYGGYFDV

SEQ ID NO: 14530 - protein, 214 aa, Artificial Sequence
  Description of Artificial Sequence: Synthetic polypeptide
  XENP018386 1G6_H1_L1.43_IgG1_PVA_/S267K Light Chain
SIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14531 - protein, 107 aa, Artificial Sequence; identical to SEQ ID NO: 8881
  Description of Artificial Sequence: Synthetic polypeptide
  VL of XENP018386

SEQ ID NO: 14532 - protein, 11 aa, Artificial Sequence
  Description of Artificial Sequence: Synthetic peptide
  XENP018386 vlCDR1
RASQSVSNLVA

SEQ ID NO: 14533 - protein, 7 aa, Artificial Sequence
  Description of Artificial Sequence: Synthetic peptide
  XENP018386 vlCDR2
YASHRYT

SEQ ID NO: 14534 - protein, 9 aa, Artificial Sequence
  Description of Artificial Sequence: Synthetic peptide
  XENP018386 vlCDR3
QQDYSSPRT

SEQ ID NO: 14535 - protein, 451 aa, Artificial Sequence; identical to SEQ ID NO: 11545
  Description of Artificial Sequence: Synthetic polypeptide
  XENP018387 1G6_H1_L1.44_IgG1_PVA_/S267K Heavy Chain

SEQ ID NO: 14536 - protein, 122 aa, Artificial Sequence; identical to SEQ ID NO: 6246
  Description of Artificial Sequence: Synthetic polypeptide
  VH of XENP018387

SEQ ID NO: 14537 - protein, 5 aa, Artificial Sequence
  Description of Artificial Sequence: Synthetic peptide
  XENP018387 vhCDR1
NYWMN

SEQ ID NO: 14538 - protein, 19 aa, Artificial Sequence
  Description of Artificial Sequence: Synthetic peptide
  XENP018387 vhCDR2
EIRLKSNNYATHYAEPVKG

SEQ ID NO: 14539 - protein, 11 aa, Artificial Sequence
  Description of Artificial Sequence: Synthetic peptide
  XENP018387 vhCDR3
YYGNYGGYFDV

SEQ ID NO: 14540 - protein, 214 aa, Artificial Sequence
  Description of Artificial Sequence: Synthetic polypeptide
  XENP018387 1G6_H1_L1.44_IgG1_PVA_/S267K Light Chain
SIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14541 - protein, 107 aa, Artificial Sequence; identical to SEQ ID NO: 8890
  Description of Artificial Sequence: Synthetic polypeptide
  VL of XENP018387

SEQ ID NO: 14542 - protein, 11 aa, Artificial Sequence
  Description of Artificial Sequence: Synthetic peptide
  XENP018387 vlCDR1
RASQSVSNTVA

SEQ ID NO: 14543 - protein, 7 aa, Artificial Sequence
  Description of Artificial Sequence: Synthetic peptide
  XENP018387 vlCDR2
YASHRYT

SEQ ID NO: 14544 - protein, 9 aa, Artificial Sequence
  Description of Artificial Sequence: Synthetic peptide
  XENP018387 vlCDR3
QQDYSSPRT

SEQ ID NO: 14545 - protein, 451 aa, Artificial Sequence; identical to SEQ ID NO: 11545
  Description of Artificial Sequence: Synthetic polypeptide
  XENP018388 1G6_H1_L1.45_IgG1_PVA_/S267K Heavy Chain

SEQ ID NO: 14546 - protein, 122 aa, Artificial Sequence; identical to SEQ ID NO: 6246
  Description of Artificial Sequence: Synthetic polypeptide
  VH of XENP018388

SEQ ID NO: 14547 - protein, 5 aa, Artificial Sequence
  Description of Artificial Sequence: Synthetic peptide
  XENP018388 vhCDR1
NYWMN

SEQ ID NO: 14548 - protein, 19 aa, Artificial Sequence
  Description of Artificial Sequence: Synthetic peptide
  XENP018388 vhCDR2
EIRLKSNNYATHYAEPVKG

SEQ ID NO: 14549 - protein, 11 aa, Artificial Sequence
  Description of Artificial Sequence: Synthetic peptide
  XENP018388 vhCDR3
YYGNYGGYFDV

SEQ ID NO: 14550 - protein, 214 aa, Artificial Sequence
  Description of Artificial Sequence: Synthetic polypeptide
  XENP018388 1G6_H1_L1.45_IgG1_PVA_/S267K Light Chain
SIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14551 - protein, 107 aa, Artificial Sequence; identical to SEQ ID NO: 8899
  Description of Artificial Sequence: Synthetic polypeptide
  VL of XENP018388

SEQ ID NO: 14552 - protein, 11 aa, Artificial Sequence
  Description of Artificial Sequence: Synthetic peptide
  XENP018388 vlCDR1
RASQSVSNGVA

SEQ ID NO: 14553 - protein, 7 aa, Artificial Sequence
  Description of Artificial Sequence: Synthetic peptide
  XENP018388 vlCDR2
YASHRYT

SEQ ID NO: 14554 - protein, 9 aa, Artificial Sequence
  Description of Artificial Sequence: Synthetic peptide
  XENP018388 vlCDR3
QQDYSSPRT

SEQ ID NO: 14555 - protein, 451 aa, Artificial Sequence; identical to SEQ ID NO: 11545
  Description of Artificial Sequence: Synthetic polypeptide
  XENP018389 1G6_H1_L1.46_IgG1_PVA_/S267K Heavy Chain

SEQ ID NO: 14556 - protein, 122 aa, Artificial Sequence; identical to SEQ ID NO: 6246
  Description of Artificial Sequence: Synthetic polypeptide
  VH of XENP018389

SEQ ID NO: 14557 - protein, 5 aa, Artificial Sequence
  Description of Artificial Sequence: Synthetic peptide
  XENP018389 vhCDR1
NYWMN

SEQ ID NO: 14558 - protein, 19 aa, Artificial Sequence
  Description of Artificial Sequence: Synthetic peptide
  XENP018389 vhCDR2
EIRLKSNNYATHYAEPVKG

SEQ ID NO: 14559 - protein, 11 aa, Artificial Sequence
  Description of Artificial Sequence: Synthetic peptide
  XENP018389 vhCDR3
YYGNYGGYFDV

SEQ ID NO: 14560 - protein, 214 aa, Artificial Sequence
  Description of Artificial Sequence: Synthetic polypeptide
  XENP018389 1G6_H1_L1.46_IgG1_PVA_/S267K Light Chain
SIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14561 - protein, 107 aa, Artificial Sequence; identical to SEQ ID NO: 8908
  Description of Artificial Sequence: Synthetic polypeptide
  VL of XENP018389

SEQ ID NO: 14562 - protein, 11 aa, Artificial Sequence
  Description of Artificial Sequence: Synthetic peptide
  XENP018389 vlCDR1
RASQSVSNYVA

SEQ ID NO: 14563 - protein, 7 aa, Artificial Sequence
  Description of Artificial Sequence: Synthetic peptide
  XENP018389 vlCDR2
YASHRYT

SEQ ID NO: 14564 - protein, 9 aa, Artificial Sequence
  Description of Artificial Sequence: Synthetic peptide
  XENP018389 vlCDR3
QQDYSSPRT

SEQ ID NO: 14565 - protein, 451 aa, Artificial Sequence; identical to SEQ ID NO: 11545
  Description of Artificial Sequence: Synthetic polypeptide
  XENP018390 1G6_H1_L1.47_IgG1_PVA_/S267K Heavy Chain

SEQ ID NO: 14566 - protein, 122 aa, Artificial Sequence; identical to SEQ ID NO: 6246
  Description of Artificial Sequence: Synthetic polypeptide
  VH of XENP018390

SEQ ID NO: 14567 - protein, 5 aa, Artificial Sequence
  Description of Artificial Sequence: Synthetic peptide
  XENP018390 vhCDR1
NYWMN

SEQ ID NO: 14568 - protein, 19 aa, Artificial Sequence
  Description of Artificial Sequence: Synthetic peptide
  XENP018390 vhCDR2
EIRLKSNNYATHYAEPVKG

SEQ ID NO: 14569 - protein, 11 aa, Artificial Sequence
  Description of Artificial Sequence: Synthetic peptide
  XENP018390 vhCDR3
YYGNYGGYFDV

SEQ ID NO: 14570 - protein, 214 aa, Artificial Sequence
  Description of Artificial Sequence: Synthetic polypeptide
  XENP018390 1G6_H1_L1.47_IgG1_PVA_/S267K Light Chain
SIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14571 - protein, 107 aa, Artificial Sequence; identical to SEQ ID NO: 8917
  Description of Artificial Sequence: Synthetic polypeptide
  VL of XENP018390

SEQ ID NO: 14572 - protein, 11 aa, Artificial Sequence
  Description of Artificial Sequence: Synthetic peptide
  XENP018390 vlCDR1
RASQSVSNDLA

SEQ ID NO: 14573 - protein, 7 aa, Artificial Sequence
  Description of Artificial Sequence: Synthetic peptide
  XENP018390 vlCDR2
YASHRYT

SEQ ID NO: 14574 - protein, 9 aa, Artificial Sequence
  Description of Artificial Sequence: Synthetic peptide
  XENP018390 vlCDR3
QQDYSSPRT

SEQ ID NO: 14575 - protein, 451 aa, Artificial Sequence; identical to SEQ ID NO: 11545
  Description of Artificial Sequence: Synthetic polypeptide
  XENP018391 1G6_H1_L1.48_IgG1_PVA_/S267K Heavy Chain

SEQ ID NO: 14576 - protein, 122 aa, Artificial Sequence; identical to SEQ ID NO: 6246
  Description of Artificial Sequence: Synthetic polypeptide
  VH of XENP018391

SEQ ID NO: 14577 - protein, 5 aa, Artificial Sequence
  Description of Artificial Sequence: Synthetic peptide
  XENP018391 vhCDR1
NYWMN

SEQ ID NO: 14578 - protein, 19 aa, Artificial Sequence
  Description of Artificial Sequence: Synthetic peptide
  XENP018391 vhCDR2
EIRLKSNNYATHYAEPVKG

SEQ ID NO: 14579 - protein, 11 aa, Artificial Sequence
  Description of Artificial Sequence: Synthetic peptide
  XENP018391 vhCDR3
YYGNYGGYFDV

SEQ ID NO: 14580 - protein, 214 aa, Artificial Sequence
  Description of Artificial Sequence: Synthetic polypeptide
  XENP018391 1G6_H1_L1.48_IgG1_PVA_/S267K Light Chain
SIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14581 - protein, 107 aa, Artificial Sequence; identical to SEQ ID NO: 8926
  Description of Artificial Sequence: Synthetic polypeptide
  VL of XENP018391

SEQ ID NO: 14582 - protein, 11 aa, Artificial Sequence
  Description of Artificial Sequence: Synthetic peptide
  XENP018391 vlCDR1
RASQSVSNDVS

SEQ ID NO: 14583 - protein, 7 aa, Artificial Sequence
  Description of Artificial Sequence: Synthetic peptide
  XENP018391 vlCDR2
YASHRYT

SEQ ID NO: 14584 - protein, 9 aa, Artificial Sequence
  Description of Artificial Sequence: Synthetic peptide
  XENP018391 vlCDR3
QQDYSSPRT

SEQ ID NO: 14585 - protein, 451 aa, Artificial Sequence; identical to SEQ ID NO: 11545
  Description of Artificial Sequence: Synthetic polypeptide
  XENP018392 1G6_H1_L1.49_IgG1_PVA_/S267K Heavy Chain

SEQ ID NO: 14586 - protein, 122 aa, Artificial Sequence; identical to SEQ ID NO: 6246
  Description of Artificial Sequence: Synthetic polypeptide
  VH of XENP018392

SEQ ID NO: 14587 - protein, 5 aa, Artificial Sequence
  Description of Artificial Sequence: Synthetic peptide
  XENP018392 vhCDR1
NYWMN

SEQ ID NO: 14588 - protein, 19 aa, Artificial Sequence
  Description of Artificial Sequence: Synthetic peptide
  XENP018392 vhCDR2
EIRLKSNNYATHYAEPVKG

SEQ ID NO: 14589 - protein, 11 aa, Artificial Sequence
  Description of Artificial Sequence: Synthetic peptide
  XENP018392 vhCDR3
YYGNYGGYFDV

SEQ ID NO: 14590 - protein, 214 aa, Artificial Sequence
  Description of Artificial Sequence: Synthetic polypeptide
  XENP018392 1G6_H1_L1.49_IgG1_PVA_/S267K Light Chain
SIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14591 - protein, 107 aa, Artificial Sequence; identical to SEQ ID NO: 8935
  Description of Artificial Sequence: Synthetic polypeptide
  VL of XENP018392

SEQ ID NO: 14592 - protein, 11 aa, Artificial Sequence
  Description of Artificial Sequence: Synthetic peptide
  XENP018392 vlCDR1
RASQSVSNDVT

SEQ ID NO: 14593 - protein, 7 aa, Artificial Sequence
  Description of Artificial Sequence: Synthetic peptide
  XENP018392 vlCDR2
YASHRYT

SEQ ID NO: 14594 - protein, 9 aa, Artificial Sequence
  Description of Artificial Sequence: Synthetic peptide
  XENP018392 vlCDR3
QQDYSSPRT

SEQ ID NO: 14595 - protein, 451 aa, Artificial Sequence; identical to SEQ ID NO: 11545
  Description of Artificial Sequence: Synthetic polypeptide
  XENP018393 1G6_H1_L1.50_IgG1_PVA_/S267K Heavy Chain

SEQ ID NO: 14596 - protein, 122 aa, Artificial Sequence; identical to SEQ ID NO: 6246
  Description of Artificial Sequence: Synthetic polypeptide
  VH of XENP018393

SEQ ID NO: 14597 - protein, 5 aa, Artificial Sequence
  Description of Artificial Sequence: Synthetic peptide
  XENP018393 vhCDR1
NYWMN

SEQ ID NO: 14598 - protein, 19 aa, Artificial Sequence
  Description of Artificial Sequence: Synthetic peptide
  XENP018393 vhCDR2
EIRLKSNNYATHYAEPVKG

SEQ ID NO: 14599 - protein, 11 aa, Artificial Sequence
  Description of Artificial Sequence: Synthetic peptide
  XENP018393 vhCDR3
YYGNYGGYFDV

SEQ ID NO: 14600 - protein, 214 aa, Artificial Sequence
  Description of Artificial Sequence: Synthetic polypeptide
  XENP018393 1G6_H1_L1.50_IgG1_PVA_/S267K Light Chain
SIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14601 - protein, 107 aa, Artificial Sequence; identical to SEQ ID NO: 8944
  Description of Artificial Sequence: Synthetic polypeptide
  VL of XENP018393

SEQ ID NO: 14602 - protein, 11 aa, Artificial Sequence
  Description of Artificial Sequence: Synthetic peptide
  XENP018393 vlCDR1
RASQSVSNDVA

SEQ ID NO: 14603 - protein, 7 aa, Artificial Sequence
  Description of Artificial Sequence: Synthetic peptide
  XENP018393 vlCDR2
YASHRYT

SEQ ID NO: 14604 - protein, 9 aa, Artificial Sequence
  Description of Artificial Sequence: Synthetic peptide
  XENP018393 vlCDR3
QQDYSSPRT

SEQ ID NO: 14605 - protein, 451 aa, Artificial Sequence; identical to SEQ ID NO: 11545
  Description of Artificial Sequence: Synthetic polypeptide
  XENP018394 1G6_H1_L1.51_IgG1_PVA_/S267K Heavy Chain

SEQ ID NO: 14606 - protein, 122 aa, Artificial Sequence; identical to SEQ ID NO: 6246
  Description of Artificial Sequence: Synthetic polypeptide
  VH of XENP018394

SEQ ID NO: 14607 - protein, 5 aa, Artificial Sequence
  Description of Artificial Sequence: Synthetic peptide
  XENP018394 vhCDR1
NYWMN

SEQ ID NO: 14608 - protein, 19 aa, Artificial Sequence
  Description of Artificial Sequence: Synthetic peptide
  XENP018394 vhCDR2
EIRLKSNNYATHYAEPVKG

SEQ ID NO: 14609 - protein, 11 aa, Artificial Sequence
  Description of Artificial Sequence: Synthetic peptide
  XENP018394 vhCDR3
YYGNYGGYFDV

SEQ ID NO: 14610 - protein, 214 aa, Artificial Sequence
  Description of Artificial Sequence: Synthetic polypeptide
  XENP018394 1G6_H1_L1.51_IgG1_PVA_/S267K Light Chain
SIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14611 - protein, 107 aa, Artificial Sequence; identical to SEQ ID NO: 8953
  Description of Artificial Sequence: Synthetic polypeptide
  VL of XENP018394

SEQ ID NO: 14612 - protein, 11 aa, Artificial Sequence
  Description of Artificial Sequence: Synthetic peptide
  XENP018394 vlCDR1
RASQSVSNDVA

SEQ ID NO: 14613 - protein, 7 aa, Artificial Sequence
  Description of Artificial Sequence: Synthetic peptide
  XENP018394 vlCDR2
YASHRYT

SEQ ID NO: 14614 - protein, 9 aa, Artificial Sequence
  Description of Artificial Sequence: Synthetic peptide
  XENP018394 vlCDR3
QQDYSSPRT

SEQ ID NO: 14615 - protein, 451 aa, Artificial Sequence; identical to SEQ ID NO: 11545
  Description of Artificial Sequence: Synthetic polypeptide
  XENP018395 1G6_H1_L1.52_IgG1_PVA_/S267K Heavy Chain

SEQ ID NO: 14616 - protein, 122 aa, Artificial Sequence; identical to SEQ ID NO: 6246
  Description of Artificial Sequence: Synthetic polypeptide
  VH of XENP018395

SEQ ID NO: 14617 - protein, 5 aa, Artificial Sequence
  Description of Artificial Sequence: Synthetic peptide
  XENP018395 vhCDR1
NYWMN

SEQ ID NO: 14618 - protein, 19 aa, Artificial Sequence
  Description of Artificial Sequence: Synthetic peptide
  XENP018395 vhCDR2
EIRLKSNNYATHYAEPVKG

SEQ ID NO: 14619 - protein, 11 aa, Artificial Sequence
  Description of Artificial Sequence: Synthetic peptide
  XENP018395 vhCDR3
YYGNYGGYFDV

SEQ ID NO: 14620 - protein, 214 aa, Artificial Sequence
  Description of Artificial Sequence: Synthetic polypeptide
  XENP018395 1G6_H1_L1.52_IgG1_PVA_/S267K Light Chain
SIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14621 - protein, 107 aa, Artificial Sequence; identical to SEQ ID NO: 8962
  Description of Artificial Sequence: Synthetic polypeptide
  VL of XENP018395

SEQ ID NO: 14622 - protein, 11 aa, Artificial Sequence
  Description of Artificial Sequence: Synthetic peptide
  XENP018395 vlCDR1
RASQSVSNDVA

SEQ ID NO: 14623 - protein, 7 aa, Artificial Sequence
  Description of Artificial Sequence: Synthetic peptide
  XENP018395 vlCDR2
YASHRYT

SEQ ID NO: 14624 - protein, 9 aa, Artificial Sequence
  Description of Artificial Sequence: Synthetic peptide
  XENP018395 vlCDR3
QQDYSSPRT

SEQ ID NO: 14625 - protein, 451 aa, Artificial Sequence; identical to SEQ ID NO: 11545
  Description of Artificial Sequence: Synthetic polypeptide
  XENP018396 1G6_H1_L1.53_IgG1_PVA_/S267K Heavy Chain

SEQ ID NO: 14626 - protein, 122 aa, Artificial Sequence; identical to SEQ ID NO: 6246
  Description of Artificial Sequence: Synthetic polypeptide
  VH of XENP018396

SEQ ID NO: 14627 - protein, 5 aa, Artificial Sequence
  Description of Artificial Sequence: Synthetic peptide
  XENP018396 vhCDR1
NYWMN

SEQ ID NO: 14628 - protein, 19 aa, Artificial Sequence
  Description of Artificial Sequence: Synthetic peptide
  XENP018396 vhCDR2
EIRLKSNNYATHYAEPVKG

SEQ ID NO: 14629 - protein, 11 aa, Artificial Sequence
  Description of Artificial Sequence: Synthetic peptide
  XENP018396 vhCDR3
YYGNYGGYFDV

SEQ ID NO: 14630 - protein, 214 aa, Artificial Sequence
  Description of Artificial Sequence: Synthetic polypeptide
  XENP018396 1G6_H1_L1.53_IgG1_PVA_/S267K Light Chain
SIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14631 - protein, 107 aa, Artificial Sequence; identical to SEQ ID NO: 8971
  Description of Artificial Sequence: Synthetic polypeptide
  VL of XENP018396

SEQ ID NO: 14632 - protein, 11 aa, Artificial Sequence
  Description of Artificial Sequence: Synthetic peptide
  XENP018396 vlCDR1
RASQSVSNDVA

SEQ ID NO: 14633 - protein, 7 aa, Artificial Sequence
  Description of Artificial Sequence: Synthetic peptide
  XENP018396 vlCDR2
YASHRYT

SEQ ID NO: 14634 - protein, 9 aa, Artificial Sequence
  Description of Artificial Sequence: Synthetic peptide
  XENP018396 vlCDR3
QQDYSSPRT

SEQ ID NO: 14635 - protein, 451 aa, Artificial Sequence; identical to SEQ ID NO: 11545
  Description of Artificial Sequence: Synthetic polypeptide
  XENP018401 1G6_H1_L1.54_IgG1_PVA_/S267K Heavy Chain

SEQ ID NO: 14636 - protein, 122 aa, Artificial Sequence; identical to SEQ ID NO: 6246
  Description of Artificial Sequence: Synthetic polypeptide
  VH of XENP018401

SEQ ID NO: 14637 - protein, 5 aa, Artificial Sequence
  Description of Artificial Sequence: Synthetic peptide
  XENP018401 vhCDR1
NYWMN

SEQ ID NO: 14638 - protein, 19 aa, Artificial Sequence
  Description of Artificial Sequence: Synthetic peptide
  XENP018401 vhCDR2
EIRLKSNNYATHYAEPVKG

SEQ ID NO: 14639 - protein, 11 aa, Artificial Sequence
  Description of Artificial Sequence: Synthetic peptide
  XENP018401 vhCDR3
YYGNYGGYFDV

SEQ ID NO: 14640 - protein, 214 aa, Artificial Sequence
  Description of Artificial Sequence: Synthetic polypeptide
  XENP018401 1G6_H1_L1.54_IgG1_PVA_/S267K Light Chain
SIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14641 - protein, 107 aa, Artificial Sequence; identical to SEQ ID NO: 8980
  Description of Artificial Sequence: Synthetic polypeptide
  VL of XENP018401

SEQ ID NO: 14642 - protein, 11 aa, Artificial Sequence
  Description of Artificial Sequence: Synthetic peptide
  XENP018401 vlCDR1
RASQSVSNDVA

SEQ ID NO: 14643 - protein, 7 aa, Artificial Sequence
  Description of Artificial Sequence: Synthetic peptide
  XENP018401 vlCDR2
YASHRYT

SEQ ID NO: 14644 - protein, 9 aa, Artificial Sequence
  Description of Artificial Sequence: Synthetic peptide
  XENP018401 vlCDR3
QQDYSSPRT

SEQ ID NO: 14645 - protein, 451 aa, Artificial Sequence; identical to SEQ ID NO: 11545
  Description of Artificial Sequence: Synthetic polypeptide
  XENP018402 1G6_H1_L1.55_IgG1_PVA_/S267K Heavy Chain

SEQ ID NO: 14646 - protein, 122 aa, Artificial Sequence; identical to SEQ ID NO: 6246
  Description of Artificial Sequence: Synthetic polypeptide
  VH of XENP018402

SEQ ID NO: 14647 - protein, 5 aa, Artificial Sequence
  Description of Artificial Sequence: Synthetic peptide
  XENP018402 vhCDR1
NYWMN

SEQ ID NO: 14648 - protein, 19 aa, Artificial Sequence
  Description of Artificial Sequence: Synthetic peptide
  XENP018402 vhCDR2
EIRLKSNNYATHYAEPVKG

SEQ ID NO: 14649 - protein, 11 aa, Artificial Sequence
  Description of Artificial Sequence: Synthetic peptide
  XENP018402 vhCDR3
YYGNYGGYFDV

SEQ ID NO: 14650 - protein, 214 aa, Artificial Sequence
  Description of Artificial Sequence: Synthetic polypeptide
  XENP018402 1G6_H1_L1.55_IgG1_PVA_/S267K Light Chain
SIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14651 - protein, 107 aa, Artificial Sequence; identical to SEQ ID NO: 8989
  Description of Artificial Sequence: Synthetic polypeptide
  VL of XENP018402

SEQ ID NO: 14652 - protein, 11 aa, Artificial Sequence
  Description of Artificial Sequence: Synthetic peptide
  XENP018402 vlCDR1
RASQSVSNDVA

SEQ ID NO: 14653 - protein, 7 aa, Artificial Sequence
  Description of Artificial Sequence: Synthetic peptide
  XENP018402 vlCDR2
FASHRYT

SEQ ID NO: 14654 - protein, 9 aa, Artificial Sequence
  Description of Artificial Sequence: Synthetic peptide
  XENP018402 vlCDR3
QQDYSSPRT

SEQ ID NO: 14655 - protein, 451 aa, Artificial Sequence; identical to SEQ ID NO: 11545
  Description of Artificial Sequence: Synthetic polypeptide
  XENP018403 1G6_H1_L1.56_IgG1_PVA_/S267K Heavy Chain

SEQ ID NO: 14656 - protein, 122 aa, Artificial Sequence; identical to SEQ ID NO: 6246
  Description of Artificial Sequence: Synthetic polypeptide
  VH of XENP018403

SEQ ID NO: 14657 - protein, 5 aa, Artificial Sequence
  Description of Artificial Sequence: Synthetic peptide
  XENP018403 vhCDR1
NYWMN

SEQ ID NO: 14658 - protein, 19 aa, Artificial Sequence
  Description of Artificial Sequence: Synthetic peptide
  XENP018403 vhCDR2
EIRLKSNNYATHYAEPVKG

SEQ ID NO: 14659 - protein, 11 aa, Artificial Sequence
  Description of Artificial Sequence: Synthetic peptide
  XENP018403 vhCDR3
YYGNYGGYFDV

SEQ ID NO: 14660 - protein, 214 aa, Artificial Sequence
  Description of Artificial Sequence: Synthetic polypeptide
  XENP018403 1G6_H1_L1.56_IgG1_PVA_/S267K Light Chain
SIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14661 - protein, 107 aa, Artificial Sequence; identical to SEQ ID NO: 8998
  Description of Artificial Sequence: Synthetic polypeptide
  VL of XENP018403

SEQ ID NO: 14662 - protein, 11 aa, Artificial Sequence
  Description of Artificial Sequence: Synthetic peptide
  XENP018403 vlCDR1
RASQSVSNDVA

SEQ ID NO: 14663 - protein, 7 aa, Artificial Sequence
  Description of Artificial Sequence: Synthetic peptide
  XENP018403 vlCDR2
HASHRYT

SEQ ID NO: 14664 - protein, 9 aa, Artificial Sequence
  Description of Artificial Sequence: Synthetic peptide
  XENP018403 vlCDR3
QQDYSSPRT

SEQ ID NO: 14665 - protein, 451 aa, Artificial Sequence; identical to SEQ ID NO: 11545
  Description of Artificial Sequence: Synthetic polypeptide
  XENP018404 1G6_H1_L1.57_IgG1_PVA_/S267K Heavy Chain

SEQ ID NO: 14666 - protein, 122 aa, Artificial Sequence; identical to SEQ ID NO: 6246
  Description of Artificial Sequence: Synthetic polypeptide
  VH of XENP018404

SEQ ID NO: 14667 - protein, 5 aa, Artificial Sequence
  Description of Artificial Sequence: Synthetic peptide
  XENP018404 vhCDR1
NYWMN

SEQ ID NO: 14668 - protein, 19 aa, Artificial Sequence
  Description of Artificial Sequence: Synthetic peptide
  XENP018404 vhCDR2
EIRLKSNNYATHYAEPVKG

SEQ ID NO: 14669 - protein, 11 aa, Artificial Sequence
  Description of Artificial Sequence: Synthetic peptide
  XENP018404 vhCDR3
YYGNYGGYFDV

SEQ ID NO: 14670 - protein, 214 aa, Artificial Sequence
  Description of Artificial Sequence: Synthetic polypeptide
  XENP018404 1G6_H1_L1.57_IgG1_PVA_/S267K Light Chain
SIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14671 - protein, 107 aa, Artificial Sequence; identical to SEQ ID NO: 9007
  Description of Artificial Sequence: Synthetic polypeptide
  VL of XENP018404

SEQ ID NO: 14672 - protein, 11 aa, Artificial Sequence
  Description of Artificial Sequence: Synthetic peptide
  XENP018404 vlCDR1
RASQSVSNDVA

SEQ ID NO: 14673 - protein, 7 aa, Artificial Sequence
  Description of Artificial Sequence: Synthetic peptide
  XENP018404 vlCDR2
LASHRYT

SEQ ID NO: 14674 - protein, 9 aa, Artificial Sequence
  Description of Artificial Sequence: Synthetic peptide
  XENP018404 vlCDR3
QQDYSSPRT

SEQ ID NO: 14675 - protein, 451 aa, Artificial Sequence; identical to SEQ ID NO: 11545
  Description of Artificial Sequence: Synthetic polypeptide
  XENP018405 1G6_H1_L1.58_IgG1_PVA_/S267K Heavy Chain

SEQ ID NO: 14676 - protein, 122 aa, Artificial Sequence; identical to SEQ ID NO: 6246
  Description of Artificial Sequence: Synthetic polypeptide
  VH of XENP018405

SEQ ID NO: 14677 - protein, 5 aa, Artificial Sequence
  Description of Artificial Sequence: Synthetic peptide
  XENP018405 vhCDR1
NYWMN

SEQ ID NO: 14678 - protein, 19 aa, Artificial Sequence
  Description of Artificial Sequence: Synthetic peptide
  XENP018405 vhCDR2
EIRLKSNNYATHYAEPVKG

SEQ ID NO: 14679 - protein, 11 aa, Artificial Sequence
  Description of Artificial Sequence: Synthetic peptide
  XENP018405 vhCDR3
YYGNYGGYFDV

SEQ ID NO: 14680 - protein, 214 aa, Artificial Sequence
  Description of Artificial Sequence: Synthetic polypeptide
  XENP018405 1G6_H1_L1.58_IgG1_PVA_/S267K Light Chain
SIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14681 - protein, 107 aa, Artificial Sequence; identical to SEQ ID NO: 9016
  Description of Artificial Sequence: Synthetic polypeptide
  VL of XENP018405

SEQ ID NO: 14682 - protein, 11 aa, Artificial Sequence
  Description of Artificial Sequence: Synthetic peptide
  XENP018405 vlCDR1
RASQSVSNDVA

SEQ ID NO: 14683 - protein, 7 aa, Artificial Sequence
  Description of Artificial Sequence: Synthetic peptide
  XENP018405 vlCDR2
WASHRYT

SEQ ID NO: 14684 - protein, 9 aa, Artificial Sequence
  Description of Artificial Sequence: Synthetic peptide
  XENP018405 vlCDR3
QQDYSSPRT

SEQ ID NO: 14685 - protein, 451 aa, Artificial Sequence; identical to SEQ ID NO: 11545
  Description of Artificial Sequence: Synthetic polypeptide
  XENP018406 1G6_H1_L1.59_IgG1_PVA_/S267K Heavy Chain

SEQ ID NO: 14686 - protein, 122 aa, Artificial Sequence; identical to SEQ ID NO: 6246
  Description of Artificial Sequence: Synthetic polypeptide
  VH of XENP018406

SEQ ID NO: 14687 - protein, 5 aa, Artificial Sequence
  Description of Artificial Sequence: Synthetic peptide
  XENP018406 vhCDR1
NYWMN

SEQ ID NO: 14688 - protein, 19 aa, Artificial Sequence
  Description of Artificial Sequence: Synthetic peptide
  XENP018406 vhCDR2
EIRLKSNNYATHYAEPVKG

SEQ ID NO: 14689 - protein, 11 aa, Artificial Sequence
  Description of Artificial Sequence: Synthetic peptide
  XENP018406 vhCDR3
YYGNYGGYFDV

SEQ ID NO: 14690 - protein, 214 aa, Artificial Sequence
  Description of Artificial Sequence: Synthetic polypeptide
  XENP018406 1G6_H1_L1.59_IgG1_PVA_/S267K Light Chain
SIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14691 - protein, 107 aa, Artificial Sequence; identical to SEQ ID NO: 9025
  Description of Artificial Sequence: Synthetic polypeptide
  VL of XENP018406

SEQ ID NO: 14692 - protein, 11 aa, Artificial Sequence
  Description of Artificial Sequence: Synthetic peptide
  XENP018406 vlCDR1
RASQSVSNDVA

SEQ ID NO: 14693 - protein, 7 aa, Artificial Sequence
  Description of Artificial Sequence: Synthetic peptide
  XENP018406 vlCDR2
VASHRYT

SEQ ID NO: 14694 - protein, 9 aa, Artificial Sequence
  Description of Artificial Sequence: Synthetic peptide
  XENP018406 vlCDR3
QQDYSSPRT

SEQ ID NO: 14695 - protein, 451 aa, Artificial Sequence; identical to SEQ ID NO: 11545
  Description of Artificial Sequence: Synthetic polypeptide
  XENP018407 1G6_H1_L1.60_IgG1_PVA_/S267K Heavy Chain

SEQ ID NO: 14696 - protein, 122 aa, Artificial Sequence; identical to SEQ ID NO: 6246
  Description of Artificial Sequence: Synthetic polypeptide
  VH of XENP018407

SEQ ID NO: 14697 - protein, 5 aa, Artificial Sequence
  Description of Artificial Sequence: Synthetic peptide
  XENP018407 vhCDR1
NYWMN

SEQ ID NO: 14698 - protein, 19 aa, Artificial Sequence
  Description of Artificial Sequence: Synthetic peptide
  XENP018407 vhCDR2
EIRLKSNNYATHYAEPVKG

SEQ ID NO: 14699 - protein, 11 aa, Artificial Sequence
  Description of Artificial Sequence: Synthetic peptide
  XENP018407 vhCDR3
YYGNYGGYFDV

SEQ ID NO: 14700 - protein, 214 aa, Artificial Sequence
  Description of Artificial Sequence: Synthetic polypeptide
  XENP018407 1G6_H1_L1.60_IgG1_PVA_/S267K Light Chain
SIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14701 - protein, 107 aa, Artificial Sequence; identical to SEQ ID NO: 9034
  Description of Artificial Sequence: Synthetic polypeptide
  VL of XENP018407

SEQ ID NO: 14702 - protein, 11 aa, Artificial Sequence
  Description of Artificial Sequence: Synthetic peptide
  XENP018407 vlCDR1
RASQSVSNDVA

SEQ ID NO: 14703 - protein, 7 aa, Artificial Sequence
  Description of Artificial Sequence: Synthetic peptide
  XENP018407 vlCDR2
AASHRYT

SEQ ID NO: 14704 - protein, 9 aa, Artificial Sequence
  Description of Artificial Sequence: Synthetic peptide
  XENP018407 vlCDR3
QQDYSSPRT

SEQ ID NO: 14705 - protein, 451 aa, Artificial Sequence; identical to SEQ ID NO: 11545
  Description of Artificial Sequence: Synthetic polypeptide
  XENP018408 1G6_H1_L1.61_IgG1_PVA_/S267K Heavy Chain

SEQ ID NO: 14706 - protein, 122 aa, Artificial Sequence; identical to SEQ ID NO: 6246
  Description of Artificial Sequence: Synthetic polypeptide
  VH of XENP018408

SEQ ID NO: 14707 - protein, 5 aa, Artificial Sequence
  Description of Artificial Sequence: Synthetic peptide
  XENP018408 vhCDR1
NYWMN

SEQ ID NO: 14708 - protein, 19 aa, Artificial Sequence
  Description of Artificial Sequence: Synthetic peptide
  XENP018408 vhCDR2
EIRLKSNNYATHYAEPVKG

SEQ ID NO: 14709 - protein, 11 aa, Artificial Sequence
  Description of Artificial Sequence: Synthetic peptide
  XENP018408 vhCDR3
YYGNYGGYFDV

SEQ ID NO: 14710 - protein, 214 aa, Artificial Sequence
  Description of Artificial Sequence: Synthetic polypeptide
  XENP018408 1G6_H1_L1.61_IgG1_PVA_/S267K Light Chain
SIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14711 - protein, 107 aa, Artificial Sequence; identical to SEQ ID NO: 9043
  Description of Artificial Sequence: Synthetic polypeptide
  VL of XENP018408

SEQ ID NO: 14712 - protein, 11 aa, Artificial Sequence
  Description of Artificial Sequence: Synthetic peptide
  XENP018408 vlCDR1
RASQSVSNDVA

SEQ ID NO: 14713 - protein, 7 aa, Artificial Sequence
  Description of Artificial Sequence: Synthetic peptide
  XENP018408 vlCDR2
QASHRYT

SEQ ID NO: 14714 - protein, 9 aa, Artificial Sequence
  Description of Artificial Sequence: Synthetic peptide
  XENP018408 vlCDR3
QQDYSSPRT

SEQ ID NO: 14715 - protein, 451 aa, Artificial Sequence; identical to SEQ ID NO: 11545
  Description of Artificial Sequence: Synthetic polypeptide
  XENP018409 1G6_H1_L1.62_IgG1_PVA_/S267K Heavy Chain

SEQ ID NO: 14716 - protein, 122 aa, Artificial Sequence; identical to SEQ ID NO: 6246
  Description of Artificial Sequence: Synthetic polypeptide
  VH of XENP018409

SEQ ID NO: 14717 - protein, 5 aa, Artificial Sequence
  Description of Artificial Sequence: Synthetic peptide
  XENP018409 vhCDR1
NYWMN

SEQ ID NO: 14718 - protein, 19 aa, Artificial Sequence
  Description of Artificial Sequence: Synthetic peptide
  XENP018409 vhCDR2
EIRLKSNNYATHYAEPVKG

SEQ ID NO: 14719 - protein, 11 aa, Artificial Sequence
  Description of Artificial Sequence: Synthetic peptide
  XENP018409 vhCDR3
YYGNYGGYFDV

SEQ ID NO: 14720 - protein, 214 aa, Artificial Sequence
  Description of Artificial Sequence: Synthetic polypeptide
  XENP018409 1G6_H1_L1.62_IgG1_PVA_/S267K Light Chain
SIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14721 - protein, 107 aa, Artificial Sequence; identical to SEQ ID NO: 9052
  Description of Artificial Sequence: Synthetic polypeptide
  VL of XENP018409

SEQ ID NO: 14722 - protein, 11 aa, Artificial Sequence
  Description of Artificial Sequence: Synthetic peptide
  XENP018409 vlCDR1
RASQSVSNDVA

SEQ ID NO: 14723 - protein, 7 aa, Artificial Sequence
  Description of Artificial Sequence: Synthetic peptide
  XENP018409 vlCDR2
DASHRYT

SEQ ID NO: 14724 - protein, 9 aa, Artificial Sequence
  Description of Artificial Sequence: Synthetic peptide
  XENP018409 vlCDR3
QQDYSSPRT

SEQ ID NO: 14725 - protein, 451 aa, Artificial Sequence; identical to SEQ ID NO: 11545
  Description of Artificial Sequence: Synthetic polypeptide
  XENP018410 1G6_H1_L1.63_IgG1_PVA_/S267K Heavy Chain

SEQ ID NO: 14726 - protein, 122 aa, Artificial Sequence; identical to SEQ ID NO: 6246
  Description of Artificial Sequence: Synthetic polypeptide
  VH of XENP018410

SEQ ID NO: 14727 - protein, 5 aa, Artificial Sequence
  Description of Artificial Sequence: Synthetic peptide
  XENP018410 vhCDR1
NYWMN

SEQ ID NO: 14728 - protein, 19 aa, Artificial Sequence
  Description of Artificial Sequence: Synthetic peptide
  XENP018410 vhCDR2
EIRLKSNNYATHYAEPVKG

SEQ ID NO: 14729 - protein, 11 aa, Artificial Sequence
  Description of Artificial Sequence: Synthetic peptide
  XENP018410 vhCDR3
YYGNYGGYFDV

SEQ ID NO: 14730 - protein, 214 aa, Artificial Sequence
  Description of Artificial Sequence: Synthetic polypeptide
  XENP018410 1G6_H1_L1.63_IgG1_PVA_/S267K Light Chain
SIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14731 - protein, 107 aa, Artificial Sequence; identical to SEQ ID NO: 9061
  Description of Artificial Sequence: Synthetic polypeptide
  VL of XENP018410

SEQ ID NO: 14732 - protein, 11 aa, Artificial Sequence
  Description of Artificial Sequence: Synthetic peptide
  XENP018410 vlCDR1
RASQSVSNDVA

SEQ ID NO: 14733 - protein, 7 aa, Artificial Sequence
  Description of Artificial Sequence: Synthetic peptide
  XENP018410 vlCDR2
KASHRYT

SEQ ID NO: 14734 - protein, 9 aa, Artificial Sequence
  Description of Artificial Sequence: Synthetic peptide
  XENP018410 vlCDR3
QQDYSSPRT

SEQ ID NO: 14735 - protein, 451 aa, Artificial Sequence; identical to SEQ ID NO: 11545
  Description of Artificial Sequence: Synthetic polypeptide
  XENP018411 1G6_H1_L1.64_IgG1_PVA_/S267K Heavy Chain

SEQ ID NO: 14736 - protein, 122 aa, Artificial Sequence; identical to SEQ ID NO: 6246
  Description of Artificial Sequence: Synthetic polypeptide
  VH of XENP018411

SEQ ID NO: 14737 - protein, 5 aa, Artificial Sequence
  Description of Artificial Sequence: Synthetic peptide
  XENP018411 vhCDR1
NYWMN

SEQ ID NO: 14738 - protein, 19 aa, Artificial Sequence
  Description of Artificial Sequence: Synthetic peptide
  XENP018411 vhCDR2
EIRLKSNNYATHYAEPVKG

SEQ ID NO: 14739 - protein, 11 aa, Artificial Sequence
  Description of Artificial Sequence: Synthetic peptide
  XENP018411 vhCDR3
YYGNYGGYFDV

SEQ ID NO: 14740 - protein, 214 aa, Artificial Sequence
  Description of Artificial Sequence: Synthetic polypeptide
  XENP018411 1G6_H1_L1.64_IgG1_PVA_/S267K Light Chain
SIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14741 - protein, 107 aa, Artificial Sequence; identical to SEQ ID NO: 9070
  Description of Artificial Sequence: Synthetic polypeptide
  VL of XENP018411

SEQ ID NO: 14742 - protein, 11 aa, Artificial Sequence
  Description of Artificial Sequence: Synthetic peptide
  XENP018411 vlCDR1
RASQSVSNDVA

SEQ ID NO: 14743 - protein, 7 aa, Artificial Sequence
  Description of Artificial Sequence: Synthetic peptide
  XENP018411 vlCDR2
YASYRYT

SEQ ID NO: 14744 - protein, 9 aa, Artificial Sequence
  Description of Artificial Sequence: Synthetic peptide
  XENP018411 vlCDR3
QQDYSSPRT

SEQ ID NO: 14745 - protein, 451 aa, Artificial Sequence; identical to SEQ ID NO: 11545
  Description of Artificial Sequence: Synthetic polypeptide
  XENP018412 1G6_H1_L1.65_IgG1_PVA_/S267K Heavy Chain

SEQ ID NO: 14746 - protein, 122 aa, Artificial Sequence; identical to SEQ ID NO: 6246
  Description of Artificial Sequence: Synthetic polypeptide
  VH of XENP018412

SEQ ID NO: 14747 - protein, 5 aa, Artificial Sequence
  Description of Artificial Sequence: Synthetic peptide
  XENP018412 vhCDR1
NYWMN

SEQ ID NO: 14748 - protein, 19 aa, Artificial Sequence
  Description of Artificial Sequence: Synthetic peptide
  XENP018412 vhCDR2
EIRLKSNNYATHYAEPVKG

SEQ ID NO: 14749 - protein, 11 aa, Artificial Sequence
  Description of Artificial Sequence: Synthetic peptide
  XENP018412 vhCDR3
YYGNYGGYFDV

SEQ ID NO: 14750 - protein, 214 aa, Artificial Sequence
  Description of Artificial Sequence: Synthetic polypeptide
  XENP018412 1G6_H1_L1.65_IgG1_PVA_/S267K Light Chain
SIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14751 - protein, 107 aa, Artificial Sequence; identical to SEQ ID NO: 9079
  Description of Artificial Sequence: Synthetic polypeptide
  VL of XENP018412

SEQ ID NO: 14752 - protein, 11 aa, Artificial Sequence
  Description of Artificial Sequence: Synthetic peptide
  XENP018412 vlCDR1
RASQSVSNDVA

SEQ ID NO: 14753 - protein, 7 aa, Artificial Sequence
  Description of Artificial Sequence: Synthetic peptide
  XENP018412 vlCDR2
YASQRYT

SEQ ID NO: 14754 - protein, 9 aa, Artificial Sequence
  Description of Artificial Sequence: Synthetic peptide
  XENP018412 vlCDR3
QQDYSSPRT

SEQ ID NO: 14755 - protein, 451 aa, Artificial Sequence; identical to SEQ ID NO: 11545
  Description of Artificial Sequence: Synthetic polypeptide
  XENP018413 1G6_H1_L1.66_IgG1_PVA_/S267K Heavy Chain

SEQ ID NO: 14756 - protein, 122 aa, Artificial Sequence; identical to SEQ ID NO: 6246
  Description of Artificial Sequence: Synthetic polypeptide
  VH of XENP018413

SEQ ID NO: 14757 - protein, 5 aa, Artificial Sequence
  Description of Artificial Sequence: Synthetic peptide
  XENP018413 vhCDR1
NYWMN

SEQ ID NO: 14758 - protein, 19 aa, Artificial Sequence
  Description of Artificial Sequence: Synthetic peptide
  XENP018413 vhCDR2
EIRLKSNNYATHYAEPVKG

SEQ ID NO: 14759 - protein, 11 aa, Artificial Sequence
  Description of Artificial Sequence: Synthetic peptide
  XENP018413 vhCDR3
YYGNYGGYFDV

SEQ ID NO: 14760 - protein, 214 aa, Artificial Sequence
  Description of Artificial Sequence: Synthetic polypeptide
  XENP018413 1G6_H1_L1.66_IgG1_PVA_/S267K Light Chain
SIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14761 - protein, 107 aa, Artificial Sequence; identical to SEQ ID NO: 9088
  Description of Artificial Sequence: Synthetic polypeptide
  VL of XENP018413

SEQ ID NO: 14762 - protein, 11 aa, Artificial Sequence
  Description of Artificial Sequence: Synthetic peptide
  XENP018413 vlCDR1
RASQSVSNDVA

SEQ ID NO: 14763 - protein, 7 aa, Artificial Sequence
  Description of Artificial Sequence: Synthetic peptide
  XENP018413 vlCDR2
YASDRYT

SEQ ID NO: 14764 - protein, 9 aa, Artificial Sequence
  Description of Artificial Sequence: Synthetic peptide
  XENP018413 vlCDR3
QQDYSSPRT

SEQ ID NO: 14765 - protein, 451 aa, Artificial Sequence; identical to SEQ ID NO: 11545
  Description of Artificial Sequence: Synthetic polypeptide
  XENP018414 1G6_H1_L1.67_IgG1_PVA_/S267K Heavy Chain

SEQ ID NO: 14766 - protein, 122 aa, Artificial Sequence; identical to SEQ ID NO: 6246
  Description of Artificial Sequence: Synthetic polypeptide
  VH of XENP018414

SEQ ID NO: 14767 - protein, 5 aa, Artificial Sequence
  Description of Artificial Sequence: Synthetic peptide
  XENP018414 vhCDR1
NYWMN

SEQ ID NO: 14768 - protein, 19 aa, Artificial Sequence
  Description of Artificial Sequence: Synthetic peptide
  XENP018414 vhCDR2
EIRLKSNNYATHYAEPVKG

SEQ ID NO: 14769 - protein, 11 aa, Artificial Sequence
  Description of Artificial Sequence: Synthetic peptide
  XENP018414 vhCDR3
YYGNYGGYFDV

SEQ ID NO: 14770 - protein, 214 aa, Artificial Sequence
  Description of Artificial Sequence: Synthetic polypeptide
  XENP018414 1G6_H1_L1.67_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14771 - protein, 107 aa, Artificial Sequence; identical to SEQ ID NO: 9097
  Description of Artificial Sequence: Synthetic polypeptide
  VL of XENP018414

SEQ ID NO: 14772 - protein, 11 aa, Artificial Sequence
  Description of Artificial Sequence: Synthetic peptide
  XENP018414 vlCDR1
RASQSVSNDVA

SEQ ID NO: 14773 - protein, 7 aa, Artificial Sequence
  Description of Artificial Sequence: Synthetic peptide
  XENP018414 vlCDR2
YASWRYT

SEQ ID NO: 14774 - protein, 9 aa, Artificial Sequence
  Description of Artificial Sequence: Synthetic peptide
  XENP018414 vlCDR3
QQDYSSPRT

SEQ ID NO: 14775 - protein, 451 aa, Artificial Sequence; identical to SEQ ID NO: 11545
  Description of Artificial Sequence: Synthetic polypeptide
  XENP018415 1G6_H1_L1.68_IgG1_PVA_/S267K Heavy Chain

SEQ ID NO: 14776 - protein, 122 aa, Artificial Sequence; identical to SEQ ID NO: 6246
  Description of Artificial Sequence: Synthetic polypeptide
  VH of XENP018415

SEQ ID NO: 14777 - protein, 5 aa, Artificial Sequence
  Description of Artificial Sequence: Synthetic peptide
  XENP018415 vhCDR1
NYWMN

SEQ ID NO: 14778 - protein, 19 aa, Artificial Sequence
  Description of Artificial Sequence: Synthetic peptide
  XENP018415 vhCDR2
EIRLKSNNYATHYAEPVKG

SEQ ID NO: 14779 - protein, 11 aa, Artificial Sequence
  Description of Artificial Sequence: Synthetic peptide
  XENP018415 vhCDR3
YYGNYGGYFDV

SEQ ID NO: 14780 - protein, 214 aa, Artificial Sequence
  Description of Artificial Sequence: Synthetic polypeptide
  XENP018415 1G6_H1_L1.68_IgG1_PVA_/S267K Light Chain
SIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14781 - protein, 107 aa, Artificial Sequence; identical to SEQ ID NO: 9106
  Description of Artificial Sequence: Synthetic polypeptide
  VL of XENP018415

SEQ ID NO: 14782 - protein, 11 aa, Artificial Sequence
  Description of Artificial Sequence: Synthetic peptide
  XENP018415 vlCDR1
RASQSVSNDVA

SEQ ID NO: 14783 - protein, 7 aa, Artificial Sequence
  Description of Artificial Sequence: Synthetic peptide
  XENP018415 vlCDR2
YASARYT

SEQ ID NO: 14784 - protein, 9 aa, Artificial Sequence
  Description of Artificial Sequence: Synthetic peptide
  XENP018415 vlCDR3
QQDYSSPRT

SEQ ID NO: 14785 - protein, 451 aa, Artificial Sequence; identical to SEQ ID NO: 11545
  Description of Artificial Sequence: Synthetic polypeptide
  XENP018416 1G6_H1_L1.69_IgG1_PVA_/S267K Heavy Chain

SEQ ID NO: 14786 - protein, 122 aa, Artificial Sequence; identical to SEQ ID NO: 6246
  Description of Artificial Sequence: Synthetic polypeptide
  VH of XENP018416

SEQ ID NO: 14787 - protein, 5 aa, Artificial Sequence
  Description of Artificial Sequence: Synthetic peptide
  XENP018416 vhCDR1
NYWMN

SEQ ID NO: 14788 - protein, 19 aa, Artificial Sequence
  Description of Artificial Sequence: Synthetic peptide
  XENP018416 vhCDR2
EIRLKSNNYATHYAEPVKG

SEQ ID NO: 14789 - protein, 11 aa, Artificial Sequence
  Description of Artificial Sequence: Synthetic peptide
  XENP018416 vhCDR3
YYGNYGGYFDV

SEQ ID NO: 14790 - protein, 214 aa, Artificial Sequence
  Description of Artificial Sequence: Synthetic polypeptide
  XENP018416 1G6_H1_L1.69_IgG1_PVA_/S267K Light Chain
SIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14791 - protein, 107 aa, Artificial Sequence; identical to SEQ ID NO: 9115
  Description of Artificial Sequence: Synthetic polypeptide
  VL of XENP018416

SEQ ID NO: 14792 - protein, 11 aa, Artificial Sequence
  Description of Artificial Sequence: Synthetic peptide
  XENP018416 vlCDR1
RASQSVSNDVA

SEQ ID NO: 14793 - protein, 7 aa, Artificial Sequence
  Description of Artificial Sequence: Synthetic peptide
  XENP018416 vlCDR2
YASTRYT

SEQ ID NO: 14794 - protein, 9 aa, Artificial Sequence
  Description of Artificial Sequence: Synthetic peptide
  XENP018416 vlCDR3
QQDYSSPRT

SEQ ID NO: 14795 - protein, 451 aa, Artificial Sequence; identical to SEQ ID NO: 11545
  Description of Artificial Sequence: Synthetic polypeptide
  XENP018417 1G6_H1_L1.70_IgG1_PVA_/S267K Heavy Chain

SEQ ID NO: 14796 - protein, 122 aa, Artificial Sequence; identical to SEQ ID NO: 6246
  Description of Artificial Sequence: Synthetic polypeptide
  VH of XENP018417

SEQ ID NO: 14797 - protein, 5 aa, Artificial Sequence
  Description of Artificial Sequence: Synthetic peptide
  XENP018417 vhCDR1
NYWMN

SEQ ID NO: 14798 - protein, 19 aa, Artificial Sequence
  Description of Artificial Sequence: Synthetic peptide
  XENP018417 vhCDR2
EIRLKSNNYATHYAEPVKG

SEQ ID NO: 14799 - protein, 11 aa, Artificial Sequence
  Description of Artificial Sequence: Synthetic peptide
  XENP018417 vhCDR3
YYGNYGGYFDV

SEQ ID NO: 14800 - protein, 214 aa, Artificial Sequence
  Description of Artificial Sequence: Synthetic polypeptide
  XENP018417 1G6_H1_L1.70_IgG1_PVA_/S267K Light Chain
SIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14801 - protein, 107 aa, Artificial Sequence; identical to SEQ ID NO: 9124
  Description of Artificial Sequence: Synthetic polypeptide
  VL of XENP018417

SEQ ID NO: 14802 - protein, 11 aa, Artificial Sequence
  Description of Artificial Sequence: Synthetic peptide
  XENP018417 vlCDR1
RASQSVSNDVA

SEQ ID NO: 14803 - protein, 7 aa, Artificial Sequence
  Description of Artificial Sequence: Synthetic peptide
  XENP018417 vlCDR2
YASKRYT

SEQ ID NO: 14804 - protein, 9 aa, Artificial Sequence
  Description of Artificial Sequence: Synthetic peptide
  XENP018417 vlCDR3
QQDYSSPRT

SEQ ID NO: 14805 - protein, 451 aa, Artificial Sequence; identical to SEQ ID NO: 11545
  Description of Artificial Sequence: Synthetic polypeptide
  XENP018418 1G6_H1_L1.71_IgG1_PVA_/S267K Heavy Chain

SEQ ID NO: 14806 - protein, 122 aa, Artificial Sequence; identical to SEQ ID NO: 6246
  Description of Artificial Sequence: Synthetic polypeptide
  VH of XENP018418

SEQ ID NO: 14807 - protein, 5 aa, Artificial Sequence
  Description of Artificial Sequence: Synthetic peptide
  XENP018418 vhCDR1
NYWMN

SEQ ID NO: 14808 - protein, 19 aa, Artificial Sequence
  Description of Artificial Sequence: Synthetic peptide
  XENP018418 vhCDR2
EIRLKSNNYATHYAEPVKG

SEQ ID NO: 14809 - protein, 11 aa, Artificial Sequence
  Description of Artificial Sequence: Synthetic peptide
  XENP018418 vhCDR3
YYGNYGGYFDV

SEQ ID NO: 14810 - protein, 214 aa, Artificial Sequence
  Description of Artificial Sequence: Synthetic polypeptide
  XENP018418 1G6_H1_L1.71_IgG1_PVA_/S267K Light Chain
SIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14811 - protein, 107 aa, Artificial Sequence; identical to SEQ ID NO: 9133
  Description of Artificial Sequence: Synthetic polypeptide
  VL of XENP018418

SEQ ID NO: 14812 - protein, 11 aa, Artificial Sequence
  Description of Artificial Sequence: Synthetic peptide
  XENP018418 vlCDR1
RASQSVSNDVA

SEQ ID NO: 14813 - protein, 7 aa, Artificial Sequence
  Description of Artificial Sequence: Synthetic peptide
  XENP018418 vlCDR2
YASGRYT

SEQ ID NO: 14814 - protein, 9 aa, Artificial Sequence
  Description of Artificial Sequence: Synthetic peptide
  XENP018418 vlCDR3
QQDYSSPRT

SEQ ID NO: 14815 - protein, 451 aa, Artificial Sequence; identical to SEQ ID NO: 11545
  Description of Artificial Sequence: Synthetic polypeptide
  XENP018419 1G6_H1_L1.72_IgG1_PVA_/S267K Heavy Chain

SEQ ID NO: 14816 - protein, 122 aa, Artificial Sequence; identical to SEQ ID NO: 6246
  Description of Artificial Sequence: Synthetic polypeptide
  VH of XENP018419

SEQ ID NO: 14817 - protein, 5 aa, Artificial Sequence
  Description of Artificial Sequence: Synthetic peptide
  XENP018419 vhCDR1
NYWMN

SEQ ID NO: 14818 - protein, 19 aa, Artificial Sequence
  Description of Artificial Sequence: Synthetic peptide
  XENP018419 vhCDR2
EIRLKSNNYATHYAEPVKG

SEQ ID NO: 14819 - protein, 11 aa, Artificial Sequence
  Description of Artificial Sequence: Synthetic peptide
  XENP018419 vhCDR3
YYGNYGGYFDV

SEQ ID NO: 14820 - protein, 214 aa, Artificial Sequence
  Description of Artificial Sequence: Synthetic polypeptide
  XENP018419 1G6_H1_L1.72_IgG1_PVA_/S267K Light Chain
SIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14821 - protein, 107 aa, Artificial Sequence; identical to SEQ ID NO: 9142
  Description of Artificial Sequence: Synthetic polypeptide
  VL of XENP018419

SEQ ID NO: 14822 - protein, 11 aa, Artificial Sequence
  Description of Artificial Sequence: Synthetic peptide
  XENP018419 vlCDR1
RASQSVSNDVA

SEQ ID NO: 14823 - protein, 7 aa, Artificial Sequence
  Description of Artificial Sequence: Synthetic peptide
  XENP018419 vlCDR2
YASLRYT

SEQ ID NO: 14824 - protein, 9 aa, Artificial Sequence
  Description of Artificial Sequence: Synthetic peptide
  XENP018419 vlCDR3
QQDYSSPRT

SEQ ID NO: 14825 - protein, 451 aa, Artificial Sequence; identical to SEQ ID NO: 11545
  Description of Artificial Sequence: Synthetic polypeptide
  XENP018420 1G6_H1_L1.73_IgG1_PVA_/S267K Heavy Chain

SEQ ID NO: 14826 - protein, 122 aa, Artificial Sequence; identical to SEQ ID NO: 6246
  Description of Artificial Sequence: Synthetic polypeptide
  VH of XENP018420

SEQ ID NO: 14827 - protein, 5 aa, Artificial Sequence
  Description of Artificial Sequence: Synthetic peptide
  XENP018420 vhCDR1
NYWMN

SEQ ID NO: 14828 - protein, 19 aa, Artificial Sequence
  Description of Artificial Sequence: Synthetic peptide
  XENP018420 vhCDR2
EIRLKSNNYATHYAEPVKG

SEQ ID NO: 14829 - protein, 11 aa, Artificial Sequence
  Description of Artificial Sequence: Synthetic peptide
  XENP018420 vhCDR3
YYGNYGGYFDV

SEQ ID NO: 14830 - protein, 214 aa, Artificial Sequence
  Description of Artificial Sequence: Synthetic polypeptide
  XENP018420 1G6_H1_L1.73_IgG1_PVA_/S267K Light Chain
SIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14831 - protein, 107 aa, Artificial Sequence; identical to SEQ ID NO: 9151
  Description of Artificial Sequence: Synthetic polypeptide
  VL of XENP018420

SEQ ID NO: 14832 - protein, 11 aa, Artificial Sequence
  Description of Artificial Sequence: Synthetic peptide
  XENP018420 vlCDR1
RASQSVSNDVA

SEQ ID NO: 14833 - protein, 7 aa, Artificial Sequence
  Description of Artificial Sequence: Synthetic peptide
  XENP018420 vlCDR2
YASHLYT

SEQ ID NO: 14834 - protein, 9 aa, Artificial Sequence
  Description of Artificial Sequence: Synthetic peptide
  XENP018420 vlCDR3
QQDYSSPRT

SEQ ID NO: 14835 - protein, 451 aa, Artificial Sequence; identical to SEQ ID NO: 11545
  Description of Artificial Sequence: Synthetic polypeptide
  XENP018421 1G6_H1_L1.74_IgG1_PVA_/S267K Heavy Chain

SEQ ID NO: 14836 - protein, 122 aa, Artificial Sequence; identical to SEQ ID NO: 6246
  Description of Artificial Sequence: Synthetic polypeptide
  VH of XENP018421

SEQ ID NO: 14837 - protein, 5 aa, Artificial Sequence
  Description of Artificial Sequence: Synthetic peptide
  XENP018421 vhCDR1
NYWMN

SEQ ID NO: 14838 - protein, 19 aa, Artificial Sequence
  Description of Artificial Sequence: Synthetic peptide
  XENP018421 vhCDR2
EIRLKSNNYATHYAEPVKG

SEQ ID NO: 14839 - protein, 11 aa, Artificial Sequence
  Description of Artificial Sequence: Synthetic peptide
  XENP018421 vhCDR3
YYGNYGGYFDV

SEQ ID NO: 14840 - protein, 214 aa, Artificial Sequence
  Description of Artificial Sequence: Synthetic polypeptide
  XENP018421 1G6_H1_L1.74_IgG1_PVA_/S267K Light Chain
SIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14841 - protein, 107 aa, Artificial Sequence; identical to SEQ ID NO: 9160
  Description of Artificial Sequence: Synthetic polypeptide
  VL of XENP018421

SEQ ID NO: 14842 - protein, 11 aa, Artificial Sequence
  Description of Artificial Sequence: Synthetic peptide
  XENP018421 vlCDR1
RASQSVSNDVA

SEQ ID NO: 14843 - protein, 7 aa, Artificial Sequence
  Description of Artificial Sequence: Synthetic peptide
  XENP018421 vlCDR2
YASHWYT

SEQ ID NO: 14844 - protein, 9 aa, Artificial Sequence
  Description of Artificial Sequence: Synthetic peptide
  XENP018421 vlCDR3
QQDYSSPRT

SEQ ID NO: 14845 - protein, 451 aa, Artificial Sequence; identical to SEQ ID NO: 11545
  Description of Artificial Sequence: Synthetic polypeptide
  XENP018422 1G6_H1_L1.75_IgG1_PVA_/S267K Heavy Chain

SEQ ID NO: 14846 - protein, 122 aa, Artificial Sequence; identical to SEQ ID NO: 6246
  Description of Artificial Sequence: Synthetic polypeptide
  VH of XENP018422

SEQ ID NO: 14847 - protein, 5 aa, Artificial Sequence
  Description of Artificial Sequence: Synthetic peptide
  XENP018422 vhCDR1
NYWMN

SEQ ID NO: 14848 - protein, 19 aa, Artificial Sequence
  Description of Artificial Sequence: Synthetic peptide
  XENP018422 vhCDR2
EIRLKSNNYATHYAEPVKG

SEQ ID NO: 14849 - protein, 11 aa, Artificial Sequence
  Description of Artificial Sequence: Synthetic peptide
  XENP018422 vhCDR3
YYGNYGGYFDV

SEQ ID NO: 14850 - protein, 214 aa, Artificial Sequence
  Description of Artificial Sequence: Synthetic polypeptide
  XENP018422 1G6_H1_L1.75_IgG1_PVA_/S267K Light Chain
SIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14851 - protein, 107 aa, Artificial Sequence; identical to SEQ ID NO: 9169
  Description of Artificial Sequence: Synthetic polypeptide
  VL of XENP018422

SEQ ID NO: 14852 - protein, 11 aa, Artificial Sequence
  Description of Artificial Sequence: Synthetic peptide
  XENP018422 vlCDR1
RASQSVSNDVA

SEQ ID NO: 14853 - protein, 7 aa, Artificial Sequence
  Description of Artificial Sequence: Synthetic peptide
  XENP018422 vlCDR2
YASHSYT

SEQ ID NO: 14854 - protein, 9 aa, Artificial Sequence
  Description of Artificial Sequence: Synthetic peptide
  XENP018422 vlCDR3
QQDYSSPRT

SEQ ID NO: 14855 - protein, 451 aa, Artificial Sequence; identical to SEQ ID NO: 11545
  Description of Artificial Sequence: Synthetic polypeptide
  XENP018423 1G6_H1_L1.76_IgG1_PVA_/S267K Heavy Chain

SEQ ID NO: 14856 - protein, 122 aa, Artificial Sequence; identical to SEQ ID NO: 6246
  Description of Artificial Sequence: Synthetic polypeptide
  VH of XENP018423

SEQ ID NO: 14857 - protein, 5 aa, Artificial Sequence
  Description of Artificial Sequence: Synthetic peptide
  XENP018423 vhCDR1
NYWMN

SEQ ID NO: 14858 - protein, 19 aa, Artificial Sequence
  Description of Artificial Sequence: Synthetic peptide
  XENP018423 vhCDR2
EIRLKSNNYATHYAEPVKG

SEQ ID NO: 14859 - protein, 11 aa, Artificial Sequence
  Description of Artificial Sequence: Synthetic peptide
  XENP018423 vhCDR3
YYGNYGGYFDV

SEQ ID NO: 14860 - protein, 214 aa, Artificial Sequence
  Description of Artificial Sequence: Synthetic polypeptide
  XENP018423 1G6_H1_L1.76_IgG1_PVA_/S267K Light Chain
SIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14861 - protein, 107 aa, Artificial Sequence; identical to SEQ ID NO: 9178
  Description of Artificial Sequence: Synthetic polypeptide
  VL of XENP018423

SEQ ID NO: 14862 - protein, 11 aa, Artificial Sequence
  Description of Artificial Sequence: Synthetic peptide
  XENP018423 vlCDR1
RASQSVSNDVA

SEQ ID NO: 14863 - protein, 7 aa, Artificial Sequence
  Description of Artificial Sequence: Synthetic peptide
  XENP018423 vlCDR2
YASHRFT

SEQ ID NO: 14864 - protein, 9 aa, Artificial Sequence
  Description of Artificial Sequence: Synthetic peptide
  XENP018423 vlCDR3
QQDYSSPRT

SEQ ID NO: 14865 - protein, 451 aa, Artificial Sequence; identical to SEQ ID NO: 11545
  Description of Artificial Sequence: Synthetic polypeptide
  XENP018424 1G6_H1_L1.77_IgG1_PVA_/S267K Heavy Chain

SEQ ID NO: 14866 - protein, 122 aa, Artificial Sequence; identical to SEQ ID NO: 6246
  Description of Artificial Sequence: Synthetic polypeptide
  VH of XENP018424

SEQ ID NO: 14867 - protein, 5 aa, Artificial Sequence
  Description of Artificial Sequence: Synthetic peptide
  XENP018424 vhCDR1
NYWMN

SEQ ID NO: 14868 - protein, 19 aa, Artificial Sequence
  Description of Artificial Sequence: Synthetic peptide
  XENP018424 vhCDR2
EIRLKSNNYATHYAEPVKG

SEQ ID NO: 14869 - protein, 11 aa, Artificial Sequence
  Description of Artificial Sequence: Synthetic peptide
  XENP018424 vhCDR3
YYGNYGGYFDV

SEQ ID NO: 14870 - protein, 214 aa, Artificial Sequence
  Description of Artificial Sequence: Synthetic polypeptide
  XENP018424 1G6_H1_L1.77_IgG1_PVA_/S267K Light Chain
SIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14871 - protein, 107 aa, Artificial Sequence; identical to SEQ ID NO: 9187
  Description of Artificial Sequence: Synthetic polypeptide
  VL of XENP018424

SEQ ID NO: 14872 - protein, 11 aa, Artificial Sequence
  Description of Artificial Sequence: Synthetic peptide
  XENP018424 vlCDR1
RASQSVSNDVA

SEQ ID NO: 14873 - protein, 7 aa, Artificial Sequence
  Description of Artificial Sequence: Synthetic peptide
  XENP018424 vlCDR2
YASHRHT

SEQ ID NO: 14874 - protein, 9 aa, Artificial Sequence
  Description of Artificial Sequence: Synthetic peptide
  XENP018424 vlCDR3
QQDYSSPRT

SEQ ID NO: 14875 - protein, 451 aa, Artificial Sequence; identical to SEQ ID NO: 11545
  Description of Artificial Sequence: Synthetic polypeptide
  XENP018425 1G6_H1_L1.78_IgG1_PVA_/S267K Heavy Chain

SEQ ID NO: 14876 - protein, 122 aa, Artificial Sequence; identical to SEQ ID NO: 6246
  Description of Artificial Sequence: Synthetic polypeptide
  VH of XENP018425

SEQ ID NO: 14877 - protein, 5 aa, Artificial Sequence
  Description of Artificial Sequence: Synthetic peptide
  XENP018425 vhCDR1
NYWMN

SEQ ID NO: 14878 - protein, 19 aa, Artificial Sequence
  Description of Artificial Sequence: Synthetic peptide
  XENP018425 vhCDR2
EIRLKSNNYATHYAEPVKG

SEQ ID NO: 14879 - protein, 11 aa, Artificial Sequence
  Description of Artificial Sequence: Synthetic peptide
  XENP018425 vhCDR3
YYGNYGGYFDV

SEQ ID NO: 14880 - protein, 214 aa, Artificial Sequence
  Description of Artificial Sequence: Synthetic polypeptide
  XENP018425 1G6_H1_L1.78_IgG1_PVA_/S267K Light Chain
SIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14881 - protein, 107 aa, Artificial Sequence; identical to SEQ ID NO: 9196
  Description of Artificial Sequence: Synthetic polypeptide
  VL of XENP018425

SEQ ID NO: 14882 - protein, 11 aa, Artificial Sequence
  Description of Artificial Sequence: Synthetic peptide
  XENP018425 vlCDR1
RASQSVSNDVA

SEQ ID NO: 14883 - protein, 7 aa, Artificial Sequence
  Description of Artificial Sequence: Synthetic peptide
  XENP018425 vlCDR2
YASHRLT

SEQ ID NO: 14884 - protein, 9 aa, Artificial Sequence
  Description of Artificial Sequence: Synthetic peptide
  XENP018425 vlCDR3
QQDYSSPRT

SEQ ID NO: 14885 - protein, 451 aa, Artificial Sequence; identical to SEQ ID NO: 11545
  Description of Artificial Sequence: Synthetic polypeptide
  XENP018426 1G6_H1_L1.79_IgG1_PVA_/S267K Heavy Chain

SEQ ID NO: 14886 - protein, 122 aa, Artificial Sequence; identical to SEQ ID NO: 6246
  Description of Artificial Sequence: Synthetic polypeptide
  VH of XENP018426

SEQ ID NO: 14887 - protein, 5 aa, Artificial Sequence
  Description of Artificial Sequence: Synthetic peptide
  XENP018426 vhCDR1
NYWMN

SEQ ID NO: 14888 - protein, 19 aa, Artificial Sequence
  Description of Artificial Sequence: Synthetic peptide
  XENP018426 vhCDR2
EIRLKSNNYATHYAEPVKG

SEQ ID NO: 14889 - protein, 11 aa, Artificial Sequence
  Description of Artificial Sequence: Synthetic peptide
  XENP018426 vhCDR3
YYGNYGGYFDV

SEQ ID NO: 14890 - protein, 214 aa, Artificial Sequence
  Description of Artificial Sequence: Synthetic polypeptide
  XENP018426 1G6_H1_L1.79_IgG1_PVA_/S267K Light Chain
SIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14891 - protein, 107 aa, Artificial Sequence; identical to SEQ ID NO: 9205
  Description of Artificial Sequence: Synthetic polypeptide
  VL of XENP018426

SEQ ID NO: 14892 - protein, 11 aa, Artificial Sequence
  Description of Artificial Sequence: Synthetic peptide
  XENP018426 vlCDR1
RASQSVSNDVA

SEQ ID NO: 14893 - protein, 7 aa, Artificial Sequence
  Description of Artificial Sequence: Synthetic peptide
  XENP018426 vlCDR2
YASHRWT

SEQ ID NO: 14894 - protein, 9 aa, Artificial Sequence
  Description of Artificial Sequence: Synthetic peptide
  XENP018426 vlCDR3
QQDYSSPRT

SEQ ID NO: 14895 - protein, 451 aa, Artificial Sequence; identical to SEQ ID NO: 11545
  Description of Artificial Sequence: Synthetic polypeptide
  XENP018427 1G6_H1_L1.80_IgG1_PVA_/S267K Heavy Chain

SEQ ID NO: 14896 - protein, 122 aa, Artificial Sequence; identical to SEQ ID NO: 6246
  Description of Artificial Sequence: Synthetic polypeptide
  VH of XENP018427

SEQ ID NO: 14897 - protein, 5 aa, Artificial Sequence
  Description of Artificial Sequence: Synthetic peptide
  XENP018427 vhCDR1
NYWMN

SEQ ID NO: 14898 - protein, 19 aa, Artificial Sequence
  Description of Artificial Sequence: Synthetic peptide
  XENP018427 vhCDR2
EIRLKSNNYATHYAEPVKG

SEQ ID NO: 14899 - protein, 11 aa, Artificial Sequence
  Description of Artificial Sequence: Synthetic peptide
  XENP018427 vhCDR3
YYGNYGGYFDV

SEQ ID NO: 14900 - protein, 214 aa, Artificial Sequence
  Description of Artificial Sequence: Synthetic polypeptide
  XENP018427 1G6_H1_L1.80_IgG1_PVA_/S267K Light Chain
SIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14901 - protein, 107 aa, Artificial Sequence; identical to SEQ ID NO: 9214
  Description of Artificial Sequence: Synthetic polypeptide
  VL of XENP018427

SEQ ID NO: 14902 - protein, 11 aa, Artificial Sequence
  Description of Artificial Sequence: Synthetic peptide
  XENP018427 vlCDR1
RASQSVSNDVA

SEQ ID NO: 14903 - protein, 7 aa, Artificial Sequence
  Description of Artificial Sequence: Synthetic peptide
  XENP018427 vlCDR2
YASHRVT

SEQ ID NO: 14904 - protein, 9 aa, Artificial Sequence
  Description of Artificial Sequence: Synthetic peptide
  XENP018427 vlCDR3
QQDYSSPRT

SEQ ID NO: 14905 - protein, 451 aa, Artificial Sequence; identical to SEQ ID NO: 11545
  Description of Artificial Sequence: Synthetic polypeptide
  XENP018428 1G6_H1_L1.81_IgG1_PVA_/S267K Heavy Chain

SEQ ID NO: 14906 - protein, 122 aa, Artificial Sequence; identical to SEQ ID NO: 6246
  Description of Artificial Sequence: Synthetic polypeptide
  VH of XENP018428

SEQ ID NO: 14907 - protein, 5 aa, Artificial Sequence
  Description of Artificial Sequence: Synthetic peptide
  XENP018428 vhCDR1
NYWMN

SEQ ID NO: 14908 - protein, 19 aa, Artificial Sequence
  Description of Artificial Sequence: Synthetic peptide
  XENP018428 vhCDR2
EIRLKSNNYATHYAEPVKG

SEQ ID NO: 14909 - protein, 11 aa, Artificial Sequence
  Description of Artificial Sequence: Synthetic peptide
  XENP018428 vhCDR3
YYGNYGGYFDV

SEQ ID NO: 14910 - protein, 214 aa, Artificial Sequence
  Description of Artificial Sequence: Synthetic polypeptide
  XENP018428 1G6_H1_L1.81_IgG1_PVA_/S267K Light Chain
SIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14911 - protein, 107 aa, Artificial Sequence; identical to SEQ ID NO: 9223
  Description of Artificial Sequence: Synthetic polypeptide
  VL of XENP018428

SEQ ID NO: 14912 - protein, 11 aa, Artificial Sequence
  Description of Artificial Sequence: Synthetic peptide
  XENP018428 vlCDR1
RASQSVSNDVA

SEQ ID NO: 14913 - protein, 7 aa, Artificial Sequence
  Description of Artificial Sequence: Synthetic peptide
  XENP018428 vlCDR2
YASHRAT

SEQ ID NO: 14914 - protein, 9 aa, Artificial Sequence
  Description of Artificial Sequence: Synthetic peptide
  XENP018428 vlCDR3
QQDYSSPRT

SEQ ID NO: 14915 - protein, 451 aa, Artificial Sequence; identical to SEQ ID NO: 11545
  Description of Artificial Sequence: Synthetic polypeptide
  XENP018429 1G6_H1_L1.82_IgG1_PVA_/S267K Heavy Chain

SEQ ID NO: 14916 - protein, 122 aa, Artificial Sequence; identical to SEQ ID NO: 6246
  Description of Artificial Sequence: Synthetic polypeptide
  VH of XENP018429

SEQ ID NO: 14917 - protein, 5 aa, Artificial Sequence
  Description of Artificial Sequence: Synthetic peptide
  XENP018429 vhCDR1
NYWMN

SEQ ID NO: 14918 - protein, 19 aa, Artificial Sequence
  Description of Artificial Sequence: Synthetic peptide
  XENP018429 vhCDR2
EIRLKSNNYATHYAEPVKG

SEQ ID NO: 14919 - protein, 11 aa, Artificial Sequence
  Description of Artificial Sequence: Synthetic peptide
  XENP018429 vhCDR3
YYGNYGGYFDV

SEQ ID NO: 14920 - protein, 214 aa, Artificial Sequence
  Description of Artificial Sequence: Synthetic polypeptide
  XENP018429 1G6_H1_L1.82_IgG1_PVA_/S267K Light Chain
SIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14921 - protein, 107 aa, Artificial Sequence; identical to SEQ ID NO: 9232
  Description of Artificial Sequence: Synthetic polypeptide
  VL of XENP018429

SEQ ID NO: 14922 - protein, 11 aa, Artificial Sequence
  Description of Artificial Sequence: Synthetic peptide
  XENP018429 vlCDR1
RASQSVSNDVA

SEQ ID NO: 14923 - protein, 7 aa, Artificial Sequence
  Description of Artificial Sequence: Synthetic peptide
  XENP018429 vlCDR2
YASHRQT

SEQ ID NO: 14924 - protein, 9 aa, Artificial Sequence
  Description of Artificial Sequence: Synthetic peptide
  XENP018429 vlCDR3
QQDYSSPRT

SEQ ID NO: 14925 - protein, 451 aa, Artificial Sequence; identical to SEQ ID NO: 11545
  Description of Artificial Sequence: Synthetic polypeptide
  XENP018430 1G6_H1_L1.83_IgG1_PVA_/S267K Heavy Chain

SEQ ID NO: 14926 - protein, 122 aa, Artificial Sequence; identical to SEQ ID NO: 6246
  Description of Artificial Sequence: Synthetic polypeptide
  VH of XENP018430

SEQ ID NO: 14927 - protein, 5 aa, Artificial Sequence
  Description of Artificial Sequence: Synthetic peptide
  XENP018430 vhCDR1
NYWMN

SEQ ID NO: 14928 - protein, 19 aa, Artificial Sequence
  Description of Artificial Sequence: Synthetic peptide
  XENP018430 vhCDR2
EIRLKSNNYATHYAEPVKG

SEQ ID NO: 14929 - protein, 11 aa, Artificial Sequence
  Description of Artificial Sequence: Synthetic peptide
  XENP018430 vhCDR3
YYGNYGGYFDV

SEQ ID NO: 14930 - protein, 214 aa, Artificial Sequence
  Description of Artificial Sequence: Synthetic polypeptide
  XENP018430 1G6_H1_L1.83_IgG1_PVA_/S267K Light Chain
SIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14931 - protein, 107 aa, Artificial Sequence; identical to SEQ ID NO: 9241
  Description of Artificial Sequence: Synthetic polypeptide
  VL of XENP018430

SEQ ID NO: 14932 - protein, 11 aa, Artificial Sequence
  Description of Artificial Sequence: Synthetic peptide
  XENP018430 vlCDR1
RASQSVSNDVA

SEQ ID NO: 14933 - protein, 7 aa, Artificial Sequence
  Description of Artificial Sequence: Synthetic peptide
  XENP018430 vlCDR2
YASHRDT

SEQ ID NO: 14934 - protein, 9 aa, Artificial Sequence
  Description of Artificial Sequence: Synthetic peptide
  XENP018430 vlCDR3
QQDYSSPRT

SEQ ID NO: 14935 - protein, 451 aa, Artificial Sequence; identical to SEQ ID NO: 11545
  Description of Artificial Sequence: Synthetic polypeptide
  XENP018431 1G6_H1_L1.84_IgG1_PVA_/S267K Heavy Chain

SEQ ID NO: 14936 - protein, 122 aa, Artificial Sequence; identical to SEQ ID NO: 6246
  Description of Artificial Sequence: Synthetic polypeptide
  VH of XENP018431

SEQ ID NO: 14937 - protein, 5 aa, Artificial Sequence
  Description of Artificial Sequence: Synthetic peptide
  XENP018431 vhCDR1
NYWMN

SEQ ID NO: 14938 - protein, 19 aa, Artificial Sequence
  Description of Artificial Sequence: Synthetic peptide
  XENP018431 vhCDR2
EIRLKSNNYATHYAEPVKG

SEQ ID NO: 14939 - protein, 11 aa, Artificial Sequence
  Description of Artificial Sequence: Synthetic peptide
  XENP018431 vhCDR3
YYGNYGGYFDV

SEQ ID NO: 14940 - protein, 214 aa, Artificial Sequence
  Description of Artificial Sequence: Synthetic polypeptide
  XENP018431 1G6_H1_L1.84_IgG1_PVA_/S267K Light Chain
SIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14941 - protein, 107 aa, Artificial Sequence; identical to SEQ ID NO: 9250
  Description of Artificial Sequence: Synthetic polypeptide
  VL of XENP018431

SEQ ID NO: 14942 - protein, 11 aa, Artificial Sequence
  Description of Artificial Sequence: Synthetic peptide
  XENP018431 vlCDR1
RASQSVSNDVA

SEQ ID NO: 14943 - protein, 7 aa, Artificial Sequence
  Description of Artificial Sequence: Synthetic peptide
  XENP018431 vlCDR2
YASHRKT

SEQ ID NO: 14944 - protein, 9 aa, Artificial Sequence
  Description of Artificial Sequence: Synthetic peptide
  XENP018431 vlCDR3
QQDYSSPRT

SEQ ID NO: 14945 - protein, 451 aa, Artificial Sequence; identical to SEQ ID NO: 11545
  Description of Artificial Sequence: Synthetic polypeptide
  XENP018432 1G6_H1_L1.85_IgG1_PVA_/S267K Heavy Chain

SEQ ID NO: 14946 - protein, 122 aa, Artificial Sequence; identical to SEQ ID NO: 6246
  Description of Artificial Sequence: Synthetic polypeptide
  VH of XENP018432

SEQ ID NO: 14947 - protein, 5 aa, Artificial Sequence
  Description of Artificial Sequence: Synthetic peptide
  XENP018432 vhCDR1
NYWMN

SEQ ID NO: 14948 - protein, 19 aa, Artificial Sequence
  Description of Artificial Sequence: Synthetic peptide
  XENP018432 vhCDR2
EIRLKSNNYATHYAEPVKG

SEQ ID NO: 14949 - protein, 11 aa, Artificial Sequence
  Description of Artificial Sequence: Synthetic peptide
  XENP018432 vhCDR3
YYGNYGGYFDV

SEQ ID NO: 14950 - protein, 214 aa, Artificial Sequence
  Description of Artificial Sequence: Synthetic polypeptide
  XENP018432 1G6_H1_L1.85_IgG1_PVA_/S267K Light Chain
SIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14951 - protein, 107 aa, Artificial Sequence; identical to SEQ ID NO: 9259
  Description of Artificial Sequence: Synthetic polypeptide
  VL of XENP018432

SEQ ID NO: 14952 - protein, 11 aa, Artificial Sequence
  Description of Artificial Sequence: Synthetic peptide
  XENP018432 vlCDR1
RASQSVSNDVA

SEQ ID NO: 14953 - protein, 7 aa, Artificial Sequence
  Description of Artificial Sequence: Synthetic peptide
  XENP018432 vlCDR2
YASHRYV

SEQ ID NO: 14954 - protein, 9 aa, Artificial Sequence
  Description of Artificial Sequence: Synthetic peptide
  XENP018432 vlCDR3
QQDYSSPRT

SEQ ID NO: 14955 - protein, 451 aa, Artificial Sequence; identical to SEQ ID NO: 11545
  Description of Artificial Sequence: Synthetic polypeptide
  XENP018433 1G6_H1_L1.86_IgG1_PVA_/S267K Heavy Chain

SEQ ID NO: 14956 - protein, 122 aa, Artificial Sequence; identical to SEQ ID NO: 6246
  Description of Artificial Sequence: Synthetic polypeptide
  VH of XENP018433

SEQ ID NO: 14957 - protein, 5 aa, Artificial Sequence
  Description of Artificial Sequence: Synthetic peptide
  XENP018433 vhCDR1
NYWMN

SEQ ID NO: 14958 - protein, 19 aa, Artificial Sequence
  Description of Artificial Sequence: Synthetic peptide
  XENP018433 vhCDR2
EIRLKSNNYATHYAEPVKG

SEQ ID NO: 14959 - protein, 11 aa, Artificial Sequence
  Description of Artificial Sequence: Synthetic peptide
  XENP018433 vhCDR3
YYGNYGGYFDV

SEQ ID NO: 14960 - protein, 214 aa, Artificial Sequence
  Description of Artificial Sequence: Synthetic polypeptide
  XENP018433 1G6_H1_L1.86_IgG1_PVA_/S267K Light Chain
SIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14961 - protein, 107 aa, Artificial Sequence; identical to SEQ ID NO: 9268
  Description of Artificial Sequence: Synthetic polypeptide
  VL of XENP018433

SEQ ID NO: 14962 - protein, 11 aa, Artificial Sequence
  Description of Artificial Sequence: Synthetic peptide
  XENP018433 vlCDR1
RASQSVSNDVA

SEQ ID NO: 14963 - protein, 7 aa, Artificial Sequence
  Description of Artificial Sequence: Synthetic peptide
  XENP018433 vlCDR2
YASHRYS

SEQ ID NO: 14964 - protein, 9 aa, Artificial Sequence
  Description of Artificial Sequence: Synthetic peptide
  XENP018433 vlCDR3
QQDYSSPRT

SEQ ID NO: 14965 - protein, 451 aa, Artificial Sequence; identical to SEQ ID NO: 11545
  Description of Artificial Sequence: Synthetic polypeptide
  XENP018434 1G6_H1_L1.87_IgG1_PVA_/S267K Heavy Chain

SEQ ID NO: 14966 - protein, 122 aa, Artificial Sequence; identical to SEQ ID NO: 6246
  Description of Artificial Sequence: Synthetic polypeptide
  VH of XENP018434

SEQ ID NO: 14967 - protein, 5 aa, Artificial Sequence
  Description of Artificial Sequence: Synthetic peptide
  XENP018434 vhCDR1
NYWMN

SEQ ID NO: 14968 - protein, 19 aa, Artificial Sequence
  Description of Artificial Sequence: Synthetic peptide
  XENP018434 vhCDR2
EIRLKSNNYATHYAEPVKG

SEQ ID NO: 14969 - protein, 11 aa, Artificial Sequence
  Description of Artificial Sequence: Synthetic peptide
  XENP018434 vhCDR3
YYGNYGGYFDV

SEQ ID NO: 14970 - protein, 214 aa, Artificial Sequence
  Description of Artificial Sequence: Synthetic polypeptide
  XENP018434 1G6_H1_L1.87_IgG1_PVA_/S267K Light Chain
SIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14971 - protein, 107 aa, Artificial Sequence; identical to SEQ ID NO: 9277
  Description of Artificial Sequence: Synthetic polypeptide
  VL of XENP018434

SEQ ID NO: 14972 - protein, 11 aa, Artificial Sequence
  Description of Artificial Sequence: Synthetic peptide
  XENP018434 vlCDR1
RASQSVSNDVA

SEQ ID NO: 14973 - protein, 7 aa, Artificial Sequence
  Description of Artificial Sequence: Synthetic peptide
  XENP018434 vlCDR2
YASHRYA

SEQ ID NO: 14974 - protein, 9 aa, Artificial Sequence
  Description of Artificial Sequence: Synthetic peptide
  XENP018434 vlCDR3
QQDYSSPRT

SEQ ID NO: 14975 - protein, 451 aa, Artificial Sequence; identical to SEQ ID NO: 11545
  Description of Artificial Sequence: Synthetic polypeptide
  XENP018435 1G6_H1_L1.88_IgG1_PVA_/S267K Heavy Chain

SEQ ID NO: 14976 - protein, 122 aa, Artificial Sequence; identical to SEQ ID NO: 6246
  Description of Artificial Sequence: Synthetic polypeptide
  VH of XENP018435

SEQ ID NO: 14977 - protein, 5 aa, Artificial Sequence
  Description of Artificial Sequence: Synthetic peptide
  XENP018435 vhCDR1
NYWMN

SEQ ID NO: 14978 - protein, 19 aa, Artificial Sequence
  Description of Artificial Sequence: Synthetic peptide
  XENP018435 vhCDR2
EIRLKSNNYATHYAEPVKG

SEQ ID NO: 14979 - protein, 11 aa, Artificial Sequence
  Description of Artificial Sequence: Synthetic peptide
  XENP018435 vhCDR3
YYGNYGGYFDV

SEQ ID NO: 14980 - protein, 214 aa, Artificial Sequence
  Description of Artificial Sequence: Synthetic polypeptide
  XENP018435 1G6_H1_L1.88_IgG1_PVA_/S267K Light Chain
SIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14981 - protein, 107 aa, Artificial Sequence; identical to SEQ ID NO: 9286
  Description of Artificial Sequence: Synthetic polypeptide
  VL of XENP018435

SEQ ID NO: 14982 - protein, 11 aa, Artificial Sequence
  Description of Artificial Sequence: Synthetic peptide
  XENP018435 vlCDR1
RASQSVSNDVA

SEQ ID NO: 14983 - protein, 7 aa, Artificial Sequence
  Description of Artificial Sequence: Synthetic peptide
  XENP018435 vlCDR2
YASHRYI

SEQ ID NO: 14984 - protein, 9 aa, Artificial Sequence
  Description of Artificial Sequence: Synthetic peptide
  XENP018435 vlCDR3
QQDYSSPRT

SEQ ID NO: 14985 - protein, 451 aa, Artificial Sequence; identical to SEQ ID NO: 11545
  Description of Artificial Sequence: Synthetic polypeptide
  XENP018436 1G6_H1_L1.89_IgG1_PVA_/S267K Heavy Chain

SEQ ID NO: 14986 - protein, 122 aa, Artificial Sequence; identical to SEQ ID NO: 6246
  Description of Artificial Sequence: Synthetic polypeptide
  VH of XENP018436

SEQ ID NO: 14987 - protein, 5 aa, Artificial Sequence
  Description of Artificial Sequence: Synthetic peptide
  XENP018436 vhCDR1
NYWMN

SEQ ID NO: 14988 - protein, 19 aa, Artificial Sequence
  Description of Artificial Sequence: Synthetic peptide
  XENP018436 vhCDR2
EIRLKSNNYATHYAEPVKG

SEQ ID NO: 14989 - protein, 11 aa, Artificial Sequence
  Description of Artificial Sequence: Synthetic peptide
  XENP018436 vhCDR3
YYGNYGGYFDV

SEQ ID NO: 14990 - protein, 214 aa, Artificial Sequence
  Description of Artificial Sequence: Synthetic polypeptide
  XENP018436 1G6_H1_L1.89_IgG1_PVA_/S267K Light Chain
SIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14991 - protein, 107 aa, Artificial Sequence; identical to SEQ ID NO: 9295
  Description of Artificial Sequence: Synthetic polypeptide
  VL of XENP018436

SEQ ID NO: 14992 - protein, 11 aa, Artificial Sequence
  Description of Artificial Sequence: Synthetic peptide
  XENP018436 vlCDR1
RASQSVSNDVA

SEQ ID NO: 14993 - protein, 7 aa, Artificial Sequence
  Description of Artificial Sequence: Synthetic peptide
  XENP018436 vlCDR2
YASHRYQ

SEQ ID NO: 14994 - protein, 9 aa, Artificial Sequence
  Description of Artificial Sequence: Synthetic peptide
  XENP018436 vlCDR3
QQDYSSPRT

SEQ ID NO: 14995 - protein, 451 aa, Artificial Sequence; identical to SEQ ID NO: 11545
  Description of Artificial Sequence: Synthetic polypeptide
  XENP018437 1G6_H1_L1.90_IgG1_PVA_/S267K Heavy Chain

SEQ ID NO: 14996 - protein, 122 aa, Artificial Sequence; identical to SEQ ID NO: 6246
  Description of Artificial Sequence: Synthetic polypeptide
  VH of XENP018437

SEQ ID NO: 14997 - protein, 5 aa, Artificial Sequence
  Description of Artificial Sequence: Synthetic peptide
  XENP018437 vhCDR1
NYWMN

SEQ ID NO: 14998 - protein, 19 aa, Artificial Sequence
  Description of Artificial Sequence: Synthetic peptide
  XENP018437 vhCDR2
EIRLKSNNYATHYAEPVKG

SEQ ID NO: 14999 - protein, 11 aa, Artificial Sequence
  Description of Artificial Sequence: Synthetic peptide
  XENP018437 vhCDR3
YYGNYGGYFDV

SEQ ID NO: 15000 - protein, 214 aa, Artificial Sequence
  Description of Artificial Sequence: Synthetic polypeptide
  XENP018437 1G6_H1_L1.90_IgG1_PVA_/S267K Light Chain
SIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15001 - protein, 107 aa, Artificial Sequence; identical to SEQ ID NO: 9304
  Description of Artificial Sequence: Synthetic polypeptide
  VL of XENP018437

SEQ ID NO: 15002 - protein, 11 aa, Artificial Sequence
  Description of Artificial Sequence: Synthetic peptide
  XENP018437 vlCDR1
RASQSVSNDVA

SEQ ID NO: 15003 - protein, 7 aa, Artificial Sequence
  Description of Artificial Sequence: Synthetic peptide
  XENP018437 vlCDR2
YASHRYH

SEQ ID NO: 15004 - protein, 9 aa, Artificial Sequence
  Description of Artificial Sequence: Synthetic peptide
  XENP018437 vlCDR3
QQDYSSPRT

SEQ ID NO: 15005 - protein, 451 aa, Artificial Sequence; identical to SEQ ID NO: 11545
  Description of Artificial Sequence: Synthetic polypeptide
  XENP018438 1G6_H1_L1.91_IgG1_PVA_/S267K Heavy Chain

SEQ ID NO: 15006 - protein, 122 aa, Artificial Sequence; identical to SEQ ID NO: 6246
  Description of Artificial Sequence: Synthetic polypeptide
  VH of XENP018438

SEQ ID NO: 15007 - protein, 5 aa, Artificial Sequence
  Description of Artificial Sequence: Synthetic peptide
  XENP018438 vhCDR1
NYWMN

SEQ ID NO: 15008 - protein, 19 aa, Artificial Sequence
  Description of Artificial Sequence: Synthetic peptide
  XENP018438 vhCDR2
EIRLKSNNYATHYAEPVKG

SEQ ID NO: 15009 - protein, 11 aa, Artificial Sequence
  Description of Artificial Sequence: Synthetic peptide
  XENP018438 vhCDR3
YYGNYGGYFDV

SEQ ID NO: 15010 - protein, 214 aa, Artificial Sequence
  Description of Artificial Sequence: Synthetic polypeptide
  XENP018438 1G6_H1_L1.91_IgG1_PVA_/S267K Light Chain
SIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15011 - protein, 107 aa, Artificial Sequence; identical to SEQ ID NO: 9313
  Description of Artificial Sequence: Synthetic polypeptide
  VL of XENP018438

SEQ ID NO: 15012 - protein, 11 aa, Artificial Sequence
  Description of Artificial Sequence: Synthetic peptide
  XENP018438 vlCDR1
RASQSVSNDVA

SEQ ID NO: 15013 - protein, 7 aa, Artificial Sequence
  Description of Artificial Sequence: Synthetic peptide
  XENP018438 vlCDR2
YASHRYD

SEQ ID NO: 15014 - protein, 9 aa, Artificial Sequence
  Description of Artificial Sequence: Synthetic peptide
  XENP018438 vlCDR3
QQDYSSPRT

SEQ ID NO: 15015 - protein, 451 aa, Artificial Sequence; identical to SEQ ID NO: 11545
  Description of Artificial Sequence: Synthetic polypeptide
  XENP018439 1G6_H1_L1.92_IgG1_PVA_/S267K Heavy Chain

SEQ ID NO: 15016 - protein, 122 aa, Artificial Sequence; identical to SEQ ID NO: 6246
  Description of Artificial Sequence: Synthetic polypeptide
  VH of XENP018439

SEQ ID NO: 15017 - protein, 5 aa, Artificial Sequence
  Description of Artificial Sequence: Synthetic peptide
  XENP018439 vhCDR1
NYWMN

SEQ ID NO: 15018 - protein, 19 aa, Artificial Sequence
  Description of Artificial Sequence: Synthetic peptide
  XENP018439 vhCDR2
EIRLKSNNYATHYAEPVKG

SEQ ID NO: 15019 - protein, 11 aa, Artificial Sequence
  Description of Artificial Sequence: Synthetic peptide
  XENP018439 vhCDR3
YYGNYGGYFDV

SEQ ID NO: 15020 - protein, 214 aa, Artificial Sequence
  Description of Artificial Sequence: Synthetic polypeptide
  XENP018439 1G6_H1_L1.92_IgG1_PVA_/S267K Light Chain
SIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15021 - protein, 107 aa, Artificial Sequence; identical to SEQ ID NO: 9322
  Description of Artificial Sequence: Synthetic polypeptide
  VL of XENP018439

SEQ ID NO: 15022 - protein, 11 aa, Artificial Sequence
  Description of Artificial Sequence: Synthetic peptide
  XENP018439 vlCDR1
RASQSVSNDVA

SEQ ID NO: 15023 - protein, 7 aa, Artificial Sequence
  Description of Artificial Sequence: Synthetic peptide
  XENP018439 vlCDR2
YASHRYK

SEQ ID NO: 15024 - protein, 9 aa, Artificial Sequence
  Description of Artificial Sequence: Synthetic peptide
  XENP018439 vlCDR3
QQDYSSPRT

SEQ ID NO: 15025 - protein, 451 aa, Artificial Sequence; identical to SEQ ID NO: 11545
  Description of Artificial Sequence: Synthetic polypeptide
  XENP018440 1G6_H1_L1.93_IgG1_PVA_/S267K Heavy Chain

SEQ ID NO: 15026 - protein, 122 aa, Artificial Sequence; identical to SEQ ID NO: 6246
  Description of Artificial Sequence: Synthetic polypeptide
  VH of XENP018440

SEQ ID NO: 15027 - protein, 5 aa, Artificial Sequence
  Description of Artificial Sequence: Synthetic peptide
  XENP018440 vhCDR1
NYWMN

SEQ ID NO: 15028 - protein, 19 aa, Artificial Sequence
  Description of Artificial Sequence: Synthetic peptide
  XENP018440 vhCDR2
EIRLKSNNYATHYAEPVKG

SEQ ID NO: 15029 - protein, 11 aa, Artificial Sequence
  Description of Artificial Sequence: Synthetic peptide
  XENP018440 vhCDR3
YYGNYGGYFDV

SEQ ID NO: 15030 - protein, 214 aa, Artificial Sequence
  Description of Artificial Sequence: Synthetic polypeptide
  XENP018440 1G6_H1_L1.93_IgG1_PVA_/S267K Light Chain
SIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15031 - protein, 107 aa, Artificial Sequence; identical to SEQ ID NO: 9331
  Description of Artificial Sequence: Synthetic polypeptide
  VL of XENP018440

SEQ ID NO: 15032 - protein, 11 aa, Artificial Sequence
  Description of Artificial Sequence: Synthetic peptide
  XENP018440 vlCDR1
RASQSVSNDVA

SEQ ID NO: 15033 - protein, 7 aa, Artificial Sequence
  Description of Artificial Sequence: Synthetic peptide
  XENP018440 vlCDR2
YASHRYY

SEQ ID NO: 15034 - protein, 9 aa, Artificial Sequence
  Description of Artificial Sequence: Synthetic peptide
  XENP018440 vlCDR3
QQDYSSPRT

SEQ ID NO: 15035 - protein, 451 aa, Artificial Sequence; identical to SEQ ID NO: 11545
  Description of Artificial Sequence: Synthetic polypeptide
  XENP018441 1G6_H1_L1.94_IgG1_PVA_/S267K Heavy Chain

SEQ ID NO: 15036 - protein, 122 aa, Artificial Sequence; identical to SEQ ID NO: 6246
  Description of Artificial Sequence: Synthetic polypeptide
  VH of XENP018441

SEQ ID NO: 15037 - protein, 5 aa, Artificial Sequence
  Description of Artificial Sequence: Synthetic peptide
  XENP018441 vhCDR1
NYWMN

SEQ ID NO: 15038 - protein, 19 aa, Artificial Sequence
  Description of Artificial Sequence: Synthetic peptide
  XENP018441 vhCDR2
EIRLKSNNYATHYAEPVKG

SEQ ID NO: 15039 - protein, 11 aa, Artificial Sequence
  Description of Artificial Sequence: Synthetic peptide
  XENP018441 vhCDR3
YYGNYGGYFDV

SEQ ID NO: 15040 - protein, 214 aa, Artificial Sequence
  Description of Artificial Sequence: Synthetic polypeptide
  XENP018441 1G6_H1_L1.94_IgG1_PVA_/S267K Light Chain
SIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15041 - protein, 107 aa, Artificial Sequence; identical to SEQ ID NO: 9340
  Description of Artificial Sequence: Synthetic polypeptide
  VL of XENP018441

SEQ ID NO: 15042 - protein, 11 aa, Artificial Sequence
  Description of Artificial Sequence: Synthetic peptide
  XENP018441 vlCDR1
RASQSVSNDVA

SEQ ID NO: 15043 - protein, 7 aa, Artificial Sequence
  Description of Artificial Sequence: Synthetic peptide
  XENP018441 vlCDR2
YASHRYT

SEQ ID NO: 15044 - protein, 9 aa, Artificial Sequence
  Description of Artificial Sequence: Synthetic peptide
  XENP018441 vlCDR3
QQDYSSPRT

SEQ ID NO: 15045 - protein, 451 aa, Artificial Sequence; identical to SEQ ID NO: 11545
  Description of Artificial Sequence: Synthetic polypeptide
  XENP018442 1G6_H1_L1.95_IgG1_PVA_/S267K Heavy Chain

SEQ ID NO: 15046 - protein, 122 aa, Artificial Sequence; identical to SEQ ID NO: 6246
  Description of Artificial Sequence: Synthetic polypeptide
  VH of XENP018442

SEQ ID NO: 15047 - protein, 5 aa, Artificial Sequence
  Description of Artificial Sequence: Synthetic peptide
  XENP018442 vhCDR1
NYWMN

SEQ ID NO: 15048 - protein, 19 aa, Artificial Sequence
  Description of Artificial Sequence: Synthetic peptide
  XENP018442 vhCDR2
EIRLKSNNYATHYAEPVKG

SEQ ID NO: 15049 - protein, 11 aa, Artificial Sequence
  Description of Artificial Sequence: Synthetic peptide
  XENP018442 vhCDR3
YYGNYGGYFDV

SEQ ID NO: 15050 - protein, 214 aa, Artificial Sequence
  Description of Artificial Sequence: Synthetic polypeptide
  XENP018442 1G6_H1_L1.95_IgG1_PVA_/S267K Light Chain
SIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15051 - protein, 107 aa, Artificial Sequence; identical to SEQ ID NO: 9349
  Description of Artificial Sequence: Synthetic polypeptide
  VL of XENP018442

SEQ ID NO: 15052 - protein, 11 aa, Artificial Sequence
  Description of Artificial Sequence: Synthetic peptide
  XENP018442 vlCDR1
RASQSVSNDVA

SEQ ID NO: 15053 - protein, 7 aa, Artificial Sequence
  Description of Artificial Sequence: Synthetic peptide
  XENP018442 vlCDR2
YASHRYT

SEQ ID NO: 15054 - protein, 9 aa, Artificial Sequence
  Description of Artificial Sequence: Synthetic peptide
  XENP018442 vlCDR3
QQDYSSPRT

SEQ ID NO: 15055 - protein, 451 aa, Artificial Sequence; identical to SEQ ID NO: 11545
  Description of Artificial Sequence: Synthetic polypeptide
  XENP018443 1G6_H1_L1.96_IgG1_PVA_/S267K Heavy Chain

SEQ ID NO: 15056 - protein, 122 aa, Artificial Sequence; identical to SEQ ID NO: 6246
  Description of Artificial Sequence: Synthetic polypeptide
  VH of XENP018443

SEQ ID NO: 15057 - protein, 5 aa, Artificial Sequence
  Description of Artificial Sequence: Synthetic peptide
  XENP018443 vhCDR1
NYWMN

SEQ ID NO: 15058 - protein, 19 aa, Artificial Sequence
  Description of Artificial Sequence: Synthetic peptide
  XENP018443 vhCDR2
EIRLKSNNYATHYAEPVKG

SEQ ID NO: 15059 - protein, 11 aa, Artificial Sequence
  Description of Artificial Sequence: Synthetic peptide
  XENP018443 vhCDR3
YYGNYGGYFDV

SEQ ID NO: 15060 - protein, 214 aa, Artificial Sequence
  Description of Artificial Sequence: Synthetic polypeptide
  XENP018443 1G6_H1_L1.96_IgG1_PVA_/S267K Light Chain
SIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15061 - protein, 107 aa, Artificial Sequence; identical to SEQ ID NO: 9358
  Description of Artificial Sequence: Synthetic polypeptide
  VL of XENP018443

SEQ ID NO: 15062 - protein, 11 aa, Artificial Sequence
  Description of Artificial Sequence: Synthetic peptide
  XENP018443 vlCDR1
RASQSVSNDVA

SEQ ID NO: 15063 - protein, 7 aa, Artificial Sequence
  Description of Artificial Sequence: Synthetic peptide
  XENP018443 vlCDR2
YASHRYT

SEQ ID NO: 15064 - protein, 9 aa, Artificial Sequence
  Description of Artificial Sequence: Synthetic peptide
  XENP018443 vlCDR3
QQDYSSPRT

SEQ ID NO: 15065 - protein, 451 aa, Artificial Sequence; identical to SEQ ID NO: 11545
  Description of Artificial Sequence: Synthetic polypeptide
  XENP018444 1G6_H1_L1.97_IgG1_PVA_/S267K Heavy Chain

SEQ ID NO: 15066 - protein, 122 aa, Artificial Sequence; identical to SEQ ID NO: 6246
  Description of Artificial Sequence: Synthetic polypeptide
  VH of XENP018444

SEQ ID NO: 15067 - protein, 5 aa, Artificial Sequence
  Description of Artificial Sequence: Synthetic peptide
  XENP018444 vhCDR1
NYWMN

SEQ ID NO: 15068 - protein, 19 aa, Artificial Sequence
  Description of Artificial Sequence: Synthetic peptide
  XENP018444 vhCDR2
EIRLKSNNYATHYAEPVKG

SEQ ID NO: 15069 - protein, 11 aa, Artificial Sequence
  Description of Artificial Sequence: Synthetic peptide
  XENP018444 vhCDR3
YYGNYGGYFDV

SEQ ID NO: 15070 - protein, 214 aa, Artificial Sequence
  Description of Artificial Sequence: Synthetic polypeptide
  XENP018444 1G6_H1_L1.97_IgG1_PVA_/S267K Light Chain
SIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15071 - protein, 107 aa, Artificial Sequence; identical to SEQ ID NO: 9367
  Description of Artificial Sequence: Synthetic polypeptide
  VL of XENP018444

SEQ ID NO: 15072 - protein, 11 aa, Artificial Sequence
  Description of Artificial Sequence: Synthetic peptide
  XENP018444 vlCDR1
RASQSVSNDVA

SEQ ID NO: 15073 - protein, 7 aa, Artificial Sequence
  Description of Artificial Sequence: Synthetic peptide
  XENP018444 vlCDR2
YASHRYT

SEQ ID NO: 15074 - protein, 9 aa, Artificial Sequence
  Description of Artificial Sequence: Synthetic peptide
  XENP018444 vlCDR3
QQDYSSPRT

SEQ ID NO: 15075 - protein, 451 aa, Artificial Sequence; identical to SEQ ID NO: 11545
  Description of Artificial Sequence: Synthetic polypeptide
  XENP018445 1G6_H1_L1.98_IgG1_PVA_/S267K Heavy Chain

SEQ ID NO: 15076 - protein, 122 aa, Artificial Sequence; identical to SEQ ID NO: 6246
  Description of Artificial Sequence: Synthetic polypeptide
  VH of XENP018445

SEQ ID NO: 15077 - protein, 5 aa, Artificial Sequence
  Description of Artificial Sequence: Synthetic peptide
  XENP018445 vhCDR1
NYWMN

SEQ ID NO: 15078 - protein, 19 aa, Artificial Sequence
  Description of Artificial Sequence: Synthetic peptide
  XENP018445 vhCDR2
EIRLKSNNYATHYAEPVKG

SEQ ID NO: 15079 - protein, 11 aa, Artificial Sequence
  Description of Artificial Sequence: Synthetic peptide
  XENP018445 vhCDR3
YYGNYGGYFDV

SEQ ID NO: 15080 - protein, 214 aa, Artificial Sequence
  Description of Artificial Sequence: Synthetic polypeptide
  XENP018445 1G6_H1_L1.98_IgG1_PVA_/S267K Light Chain
SIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15081 - protein, 107 aa, Artificial Sequence; identical to SEQ ID NO: 9376
  Description of Artificial Sequence: Synthetic polypeptide
  VL of XENP018445

SEQ ID NO: 15082 - protein, 11 aa, Artificial Sequence
  Description of Artificial Sequence: Synthetic peptide
  XENP018445 vlCDR1
RASQSVSNDVA

SEQ ID NO: 15083 - protein, 7 aa, Artificial Sequence
  Description of Artificial Sequence: Synthetic peptide
  XENP018445 vlCDR2
YASHRYT

SEQ ID NO: 15084 - protein, 9 aa, Artificial Sequence
  Description of Artificial Sequence: Synthetic peptide
  XENP018445 vlCDR3
QQDYSSPRT

SEQ ID NO: 15085 - protein, 451 aa, Artificial Sequence; identical to SEQ ID NO: 11545
  Description of Artificial Sequence: Synthetic polypeptide
  XENP018446 1G6_H1_L1.99_IgG1_PVA_/S267K Heavy Chain

SEQ ID NO: 15086 - protein, 122 aa, Artificial Sequence; identical to SEQ ID NO: 6246
  Description of Artificial Sequence: Synthetic polypeptide
  VH of XENP018446

SEQ ID NO: 15087 - protein, 5 aa, Artificial Sequence
  Description of Artificial Sequence: Synthetic peptide
  XENP018446 vhCDR1
NYWMN

SEQ ID NO: 15088 - protein, 19 aa, Artificial Sequence
  Description of Artificial Sequence: Synthetic peptide
  XENP018446 vhCDR2
EIRLKSNNYATHYAEPVKG

SEQ ID NO: 15089 - protein, 11 aa, Artificial Sequence
  Description of Artificial Sequence: Synthetic peptide
  XENP018446 vhCDR3
YYGNYGGYFDV

SEQ ID NO: 15090 - protein, 214 aa, Artificial Sequence
  Description of Artificial Sequence: Synthetic polypeptide
  XENP018446 1G6_H1_L1.99_IgG1_PVA_/S267K Light Chain
SIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15091 - protein, 107 aa, Artificial Sequence; identical to SEQ ID NO: 9385
  Description of Artificial Sequence: Synthetic polypeptide
  VL of XENP018446

SEQ ID NO: 15092 - protein, 11 aa, Artificial Sequence
  Description of Artificial Sequence: Synthetic peptide
  XENP018446 vlCDR1
RASQSVSNDVA

SEQ ID NO: 15093 - protein, 7 aa, Artificial Sequence
  Description of Artificial Sequence: Synthetic peptide
  XENP018446 vlCDR2
YASHRYT

SEQ ID NO: 15094 - protein, 9 aa, Artificial Sequence
  Description of Artificial Sequence: Synthetic peptide
  XENP018446 vlCDR3
QQDYSSPRT

SEQ ID NO: 15095 - protein, 451 aa, Artificial Sequence; identical to SEQ ID NO: 11545
  Description of Artificial Sequence: Synthetic polypeptide
  XENP018447 1G6_H1_L1.100_IgG1_PVA_/S267K Heavy Chain

SEQ ID NO: 15096 - protein, 122 aa, Artificial Sequence; identical to SEQ ID NO: 6246
  Description of Artificial Sequence: Synthetic polypeptide
  VH of XENP018447

SEQ ID NO: 15097 - protein, 5 aa, Artificial Sequence
  Description of Artificial Sequence: Synthetic peptide
  XENP018447 vhCDR1
NYWMN

SEQ ID NO: 15098 - protein, 19 aa, Artificial Sequence
  Description of Artificial Sequence: Synthetic peptide
  XENP018447 vhCDR2
EIRLKSNNYATHYAEPVKG

SEQ ID NO: 15099 - protein, 11 aa, Artificial Sequence
  Description of Artificial Sequence: Synthetic peptide
  XENP018447 vhCDR3
YYGNYGGYFDV

SEQ ID NO: 15100 - protein, 214 aa, Artificial Sequence
  Description of Artificial Sequence: Synthetic polypeptide
  XENP018447 1G6_H1_L1.100_IgG1_PVA_/S267K Light Chain
SIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15101 - protein, 107 aa, Artificial Sequence; identical to SEQ ID NO: 9394
  Description of Artificial Sequence: Synthetic polypeptide
  VL of XENP018447

SEQ ID NO: 15102 - protein, 11 aa, Artificial Sequence
  Description of Artificial Sequence: Synthetic peptide
  XENP018447 vlCDR1
RASQSVSNDVA

SEQ ID NO: 15103 - protein, 7 aa, Artificial Sequence
  Description of Artificial Sequence: Synthetic peptide
  XENP018447 vlCDR2
YASHRYT

SEQ ID NO: 15104 - protein, 9 aa, Artificial Sequence
  Description of Artificial Sequence: Synthetic peptide
  XENP018447 vlCDR3
QQDYSSPRT

SEQ ID NO: 15105 - protein, 451 aa, Artificial Sequence; identical to SEQ ID NO: 11545
  Description of Artificial Sequence: Synthetic polypeptide
  XENP018448 1G6_H1_L1.101_IgG1_PVA_/S267K Heavy Chain

SEQ ID NO: 15106 - protein, 122 aa, Artificial Sequence; identical to SEQ ID NO: 6246
  Description of Artificial Sequence: Synthetic polypeptide
  VH of XENP018448

SEQ ID NO: 15107 - protein, 5 aa, Artificial Sequence
  Description of Artificial Sequence: Synthetic peptide
  XENP018448 vhCDR1
NYWMN

SEQ ID NO: 15108 - protein, 19 aa, Artificial Sequence
  Description of Artificial Sequence: Synthetic peptide
  XENP018448 vhCDR2
EIRLKSNNYATHYAEPVKG

SEQ ID NO: 15109 - protein, 11 aa, Artificial Sequence
  Description of Artificial Sequence: Synthetic peptide
  XENP018448 vhCDR3
YYGNYGGYFDV

SEQ ID NO: 15110 - protein, 214 aa, Artificial Sequence
  Description of Artificial Sequence: Synthetic polypeptide
  XENP018448 1G6_H1_L1.101_IgG1_PVA_/S267K Light Chain
SIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15111 - protein, 107 aa, Artificial Sequence; identical to SEQ ID NO: 9403
  Description of Artificial Sequence: Synthetic polypeptide
  VL of XENP018448

SEQ ID NO: 15112 - protein, 11 aa, Artificial Sequence
  Description of Artificial Sequence: Synthetic peptide
  XENP018448 vlCDR1
RASQSVSNDVA

SEQ ID NO: 15113 - protein, 7 aa, Artificial Sequence
  Description of Artificial Sequence: Synthetic peptide
  XENP018448 vlCDR2
YASHRYT

SEQ ID NO: 15114 - protein, 9 aa, Artificial Sequence
  Description of Artificial Sequence: Synthetic peptide
  XENP018448 vlCDR3
QQDYSSPRT

SEQ ID NO: 15115 - protein, 451 aa, Artificial Sequence; identical to SEQ ID NO: 11545
  Description of Artificial Sequence: Synthetic polypeptide
  XENP018449 1G6_H1_L1.102_IgG1_PVA_/S267K Heavy Chain

SEQ ID NO: 15116 - protein, 122 aa, Artificial Sequence; identical to SEQ ID NO: 6246
  Description of Artificial Sequence: Synthetic polypeptide
  VH of XENP018449

SEQ ID NO: 15117 - protein, 5 aa, Artificial Sequence
  Description of Artificial Sequence: Synthetic peptide
  XENP018449 vhCDR1
NYWMN

SEQ ID NO: 15118 - protein, 19 aa, Artificial Sequence
  Description of Artificial Sequence: Synthetic peptide
  XENP018449 vhCDR2
EIRLKSNNYATHYAEPVKG

SEQ ID NO: 15119 - protein, 11 aa, Artificial Sequence
  Description of Artificial Sequence: Synthetic peptide
  XENP018449 vhCDR3
YYGNYGGYFDV

SEQ ID NO: 15120 - protein, 214 aa, Artificial Sequence
  Description of Artificial Sequence: Synthetic polypeptide
  XENP018449 1G6_H1_L1.102_IgG1_PVA_/S267K Light Chain
SIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15121 - protein, 107 aa, Artificial Sequence; identical to SEQ ID NO: 9412
  Description of Artificial Sequence: Synthetic polypeptide
  VL of XENP018449

SEQ ID NO: 15122 - protein, 11 aa, Artificial Sequence
  Description of Artificial Sequence: Synthetic peptide
  XENP018449 vlCDR1
RASQSVSNDVA

SEQ ID NO: 15123 - protein, 7 aa, Artificial Sequence
  Description of Artificial Sequence: Synthetic peptide
  XENP018449 vlCDR2
YASHRYT

SEQ ID NO: 15124 - protein, 9 aa, Artificial Sequence
  Description of Artificial Sequence: Synthetic peptide
  XENP018449 vlCDR3
QQDYSSPRT

SEQ ID NO: 15125 - protein, 451 aa, Artificial Sequence; identical to SEQ ID NO: 11545
  Description of Artificial Sequence: Synthetic polypeptide
  XENP018450 1G6_H1_L1.103_IgG1_PVA_/S267K Heavy Chain

SEQ ID NO: 15126 - protein, 122 aa, Artificial Sequence; identical to SEQ ID NO: 6246
  Description of Artificial Sequence: Synthetic polypeptide
  VH of XENP018450

SEQ ID NO: 15127 - protein, 5 aa, Artificial Sequence
  Description of Artificial Sequence: Synthetic peptide
  XENP018450 vhCDR1
NYWMN

SEQ ID NO: 15128 - protein, 19 aa, Artificial Sequence
  Description of Artificial Sequence: Synthetic peptide
  XENP018450 vhCDR2
EIRLKSNNYATHYAEPVKG

SEQ ID NO: 15129 - protein, 11 aa, Artificial Sequence
  Description of Artificial Sequence: Synthetic peptide
  XENP018450 vhCDR3
YYGNYGGYFDV

SEQ ID NO: 15130 - protein, 214 aa, Artificial Sequence
  Description of Artificial Sequence: Synthetic polypeptide
  XENP018450 1G6_H1_L1.103_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15131 - protein, 107 aa, Artificial Sequence; identical to SEQ ID NO: 9421
  Description of Artificial Sequence: Synthetic polypeptide
  VL of XENP018450

SEQ ID NO: 15132 - protein, 11 aa, Artificial Sequence
  Description of Artificial Sequence: Synthetic peptide
  XENP018450 vlCDR1
RASQSVSNDVA

SEQ ID NO: 15133 - protein, 7 aa, Artificial Sequence
  Description of Artificial Sequence: Synthetic peptide
  XENP018450 vlCDR2
YASHRYT

SEQ ID NO: 15134 - protein, 9 aa, Artificial Sequence
  Description of Artificial Sequence: Synthetic peptide
  XENP018450 vlCDR3
QQDYSSPRT

SEQ ID NO: 15135 - protein, 451 aa, Artificial Sequence; identical to SEQ ID NO: 11545
  Description of Artificial Sequence: Synthetic polypeptide
  XENP018451 1G6_H1_L1.104_IgG1_PVA_/S267K Heavy Chain

SEQ ID NO: 15136 - protein, 122 aa, Artificial Sequence; identical to SEQ ID NO: 6246
  Description of Artificial Sequence: Synthetic polypeptide
  VH of XENP018451

SEQ ID NO: 15137 - protein, 5 aa, Artificial Sequence
  Description of Artificial Sequence: Synthetic peptide
  XENP018451 vhCDR1
NYWMN

SEQ ID NO: 15138 - protein, 19 aa, Artificial Sequence
  Description of Artificial Sequence: Synthetic peptide
  XENP018451 vhCDR2
EIRLKSNNYATHYAEPVKG

SEQ ID NO: 15139 - protein, 11 aa, Artificial Sequence
  Description of Artificial Sequence: Synthetic peptide
  XENP018451 vhCDR3
YYGNYGGYFDV

SEQ ID NO: 15140 - protein, 214 aa, Artificial Sequence
  Description of Artificial Sequence: Synthetic polypeptide
  XENP018451 1G6_H1_L1.104_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15141 - protein, 107 aa, Artificial Sequence; identical to SEQ ID NO: 9430
  Description of Artificial Sequence: Synthetic polypeptide
  VL of XENP018451

SEQ ID NO: 15142 - protein, 11 aa, Artificial Sequence
  Description of Artificial Sequence: Synthetic peptide
  XENP018451 vlCDR1
RASQSVSNDVA

SEQ ID NO: 15143 - protein, 7 aa, Artificial Sequence
  Description of Artificial Sequence: Synthetic peptide
  XENP018451 vlCDR2
YASHRYT

SEQ ID NO: 15144 - protein, 9 aa, Artificial Sequence
  Description of Artificial Sequence: Synthetic peptide
  XENP018451 vlCDR3
QQDYSSPRT

SEQ ID NO: 15145 - protein, 451 aa, Artificial Sequence; identical to SEQ ID NO: 11545
  Description of Artificial Sequence: Synthetic polypeptide
  XENP018452 1G6_H1_L1.105_IgG1_PVA_/S267K Heavy Chain

SEQ ID NO: 15146 - protein, 122 aa, Artificial Sequence; identical to SEQ ID NO: 6246
  Description of Artificial Sequence: Synthetic polypeptide
  VH of XENP018452

SEQ ID NO: 15147 - protein, 5 aa, Artificial Sequence
  Description of Artificial Sequence: Synthetic peptide
  XENP018452 vhCDR1
NYWMN

SEQ ID NO: 15148 - protein, 19 aa, Artificial Sequence
  Description of Artificial Sequence: Synthetic peptide
  XENP018452 vhCDR2
EIRLKSNNYATHYAEPVKG

SEQ ID NO: 15149 - protein, 11 aa, Artificial Sequence
  Description of Artificial Sequence: Synthetic peptide
  XENP018452 vhCDR3
YYGNYGGYFDV

SEQ ID NO: 15150 - protein, 214 aa, Artificial Sequence
  Description of Artificial Sequence: Synthetic polypeptide
  XENP018452 1G6_H1_L1.105_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15151 - protein, 107 aa, Artificial Sequence; identical to SEQ ID NO: 9439
  Description of Artificial Sequence: Synthetic polypeptide
  VL of XENP018452

SEQ ID NO: 15152 - protein, 11 aa, Artificial Sequence
  Description of Artificial Sequence: Synthetic peptide
  XENP018452 vlCDR1
RASQSVSNDVA

SEQ ID NO: 15153 - protein, 7 aa, Artificial Sequence
  Description of Artificial Sequence: Synthetic peptide
  XENP018452 vlCDR2
YASHRYT

SEQ ID NO: 15154 - protein, 9 aa, Artificial Sequence
  Description of Artificial Sequence: Synthetic peptide
  XENP018452 vlCDR3
QQDYSSPRT

SEQ ID NO: 15155 - protein, 451 aa, Artificial Sequence; identical to SEQ ID NO: 11545
  Description of Artificial Sequence: Synthetic polypeptide
  XENP018453 1G6_H1_L1.106_IgG1_PVA_/S267K Heavy Chain

SEQ ID NO: 15156 - protein, 122 aa, Artificial Sequence; identical to SEQ ID NO: 6246
  Description of Artificial Sequence: Synthetic polypeptide
  VH of XENP018453

SEQ ID NO: 15157 - protein, 5 aa, Artificial Sequence
  Description of Artificial Sequence: Synthetic peptide
  XENP018453 vhCDR1
NYWMN

SEQ ID NO: 15158 - protein, 19 aa, Artificial Sequence
  Description of Artificial Sequence: Synthetic peptide
  XENP018453 vhCDR2
EIRLKSNNYATHYAEPVKG

SEQ ID NO: 15159 - protein, 11 aa, Artificial Sequence
  Description of Artificial Sequence: Synthetic peptide
  XENP018453 vhCDR3
YYGNYGGYFDV

SEQ ID NO: 15160 - protein, 214 aa, Artificial Sequence
  Description of Artificial Sequence: Synthetic polypeptide
  XENP018453 1G6_H1_L1.106_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15161 - protein, 107 aa, Artificial Sequence; identical to SEQ ID NO: 9448
  Description of Artificial Sequence: Synthetic polypeptide
  VL of XENP018453

SEQ ID NO: 15162 - protein, 11 aa, Artificial Sequence
  Description of Artificial Sequence: Synthetic peptide
  XENP018453 vlCDR1
RASQSVSNDVA

SEQ ID NO: 15163 - protein, 7 aa, Artificial Sequence
  Description of Artificial Sequence: Synthetic peptide
  XENP018453 vlCDR2
YASHRYT

SEQ ID NO: 15164 - protein, 9 aa, Artificial Sequence
  Description of Artificial Sequence: Synthetic peptide
  XENP018453 vlCDR3
QQDYSSPRT

SEQ ID NO: 15165 - protein, 451 aa, Artificial Sequence; identical to SEQ ID NO: 11545
  Description of Artificial Sequence: Synthetic polypeptide
  XENP018454 1G6_H1_L1.107_IgG1_PVA_/S267K Heavy Chain

SEQ ID NO: 15166 - protein, 122 aa, Artificial Sequence; identical to SEQ ID NO: 6246
  Description of Artificial Sequence: Synthetic polypeptide
  VH of XENP018454

SEQ ID NO: 15167 - protein, 5 aa, Artificial Sequence
  Description of Artificial Sequence: Synthetic peptide
  XENP018454 vhCDR1
NYWMN

SEQ ID NO: 15168 - protein, 19 aa, Artificial Sequence
  Description of Artificial Sequence: Synthetic peptide
  XENP018454 vhCDR2
EIRLKSNNYATHYAEPVKG

SEQ ID NO: 15169 - protein, 11 aa, Artificial Sequence
  Description of Artificial Sequence: Synthetic peptide
  XENP018454 vhCDR3
YYGNYGGYFDV

SEQ ID NO: 15170 - protein, 214 aa, Artificial Sequence
  Description of Artificial Sequence: Synthetic polypeptide
  XENP018454 1G6_H1_L1.107_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15171 - protein, 107 aa, Artificial Sequence; identical to SEQ ID NO: 9457
  Description of Artificial Sequence: Synthetic polypeptide
  VL of XENP018454

SEQ ID NO: 15172 - protein, 11 aa, Artificial Sequence
  Description of Artificial Sequence: Synthetic peptide
  XENP018454 vlCDR1
RASQSVSNDVA

SEQ ID NO: 15173 - protein, 7 aa, Artificial Sequence
  Description of Artificial Sequence: Synthetic peptide
  XENP018454 vlCDR2
YASHRYT

SEQ ID NO: 15174 - protein, 9 aa, Artificial Sequence
  Description of Artificial Sequence: Synthetic peptide
  XENP018454 vlCDR3
QQQYSSPRT

SEQ ID NO: 15175 - protein, 451 aa, Artificial Sequence; identical to SEQ ID NO: 11545
  Description of Artificial Sequence: Synthetic polypeptide
  XENP018455 1G6_H1_L1.108_IgG1_PVA_/S267K Heavy Chain

SEQ ID NO: 15176 - protein, 122 aa, Artificial Sequence; identical to SEQ ID NO: 6246
  Description of Artificial Sequence: Synthetic polypeptide
  VH of XENP018455

SEQ ID NO: 15177 - protein, 5 aa, Artificial Sequence
  Description of Artificial Sequence: Synthetic peptide
  XENP018455 vhCDR1
NYWMN

SEQ ID NO: 15178 - protein, 19 aa, Artificial Sequence
  Description of Artificial Sequence: Synthetic peptide
  XENP018455 vhCDR2
EIRLKSNNYATHYAEPVKG

SEQ ID NO: 15179 - protein, 11 aa, Artificial Sequence
  Description of Artificial Sequence: Synthetic peptide
  XENP018455 vhCDR3
YYGNYGGYFDV

SEQ ID NO: 15180 - protein, 214 aa, Artificial Sequence
  Description of Artificial Sequence: Synthetic polypeptide
  XENP018455 1G6_H1_L1.108_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15181 - protein, 107 aa, Artificial Sequence; identical to SEQ ID NO: 9466
  Description of Artificial Sequence: Synthetic polypeptide
  VL of XENP018455

SEQ ID NO: 15182 - protein, 11 aa, Artificial Sequence
  Description of Artificial Sequence: Synthetic peptide
  XENP018455 vlCDR1
RASQSVSNDVA

SEQ ID NO: 15183 - protein, 7 aa, Artificial Sequence
  Description of Artificial Sequence: Synthetic peptide
  XENP018455 vlCDR2
YASHRYT

SEQ ID NO: 15184 - protein, 9 aa, Artificial Sequence
  Description of Artificial Sequence: Synthetic peptide
  XENP018455 vlCDR3
QQEYSSPRT

SEQ ID NO: 15185 - protein, 451 aa, Artificial Sequence; identical to SEQ ID NO: 11545
  Description of Artificial Sequence: Synthetic polypeptide
  XENP018456 1G6_H1_L1.109_IgG1_PVA_/S267K Heavy Chain

SEQ ID NO: 15186 - protein, 122 aa, Artificial Sequence; identical to SEQ ID NO: 6246
  Description of Artificial Sequence: Synthetic polypeptide
  VH of XENP018456

SEQ ID NO: 15187 - protein, 5 aa, Artificial Sequence
  Description of Artificial Sequence: Synthetic peptide
  XENP018456 vhCDR1
NYWMN

SEQ ID NO: 15188 - protein, 19 aa, Artificial Sequence
  Description of Artificial Sequence: Synthetic peptide
  XENP018456 vhCDR2
EIRLKSNNYATHYAEPVKG

SEQ ID NO: 15189 - protein, 11 aa, Artificial Sequence
  Description of Artificial Sequence: Synthetic peptide
  XENP018456 vhCDR3
YYGNYGGYFDV

SEQ ID NO: 15190 - protein, 214 aa, Artificial Sequence
  Description of Artificial Sequence: Synthetic polypeptide
  XENP018456 1G6_H1_L1.109_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15191 - protein, 107 aa, Artificial Sequence; identical to SEQ ID NO: 9475
  Description of Artificial Sequence: Synthetic polypeptide
  VL of XENP018456

SEQ ID NO: 15192 - protein, 11 aa, Artificial Sequence
  Description of Artificial Sequence: Synthetic peptide
  XENP018456 vlCDR1
RASQSVSNDVA

SEQ ID NO: 15193 - protein, 7 aa, Artificial Sequence
  Description of Artificial Sequence: Synthetic peptide
  XENP018456 vlCDR2
YASHRYT

SEQ ID NO: 15194 - protein, 9 aa, Artificial Sequence
  Description of Artificial Sequence: Synthetic peptide
  XENP018456 vlCDR3
QQHYSSPRT

SEQ ID NO: 15195 - protein, 451 aa, Artificial Sequence; identical to SEQ ID NO: 11545
  Description of Artificial Sequence: Synthetic polypeptide
  XENP018457 1G6_H1_L1.110_IgG1_PVA_/S267K Heavy Chain

SEQ ID NO: 15196 - protein, 122 aa, Artificial Sequence; identical to SEQ ID NO: 6246
  Description of Artificial Sequence: Synthetic polypeptide
  VH of XENP018457

SEQ ID NO: 15197 - protein, 5 aa, Artificial Sequence
  Description of Artificial Sequence: Synthetic peptide
  XENP018457 vhCDR1
NYWMN

SEQ ID NO: 15198 - protein, 19 aa, Artificial Sequence
  Description of Artificial Sequence: Synthetic peptide
  XENP018457 vhCDR2
EIRLKSNNYATHYAEPVKG

SEQ ID NO: 15199 - protein, 11 aa, Artificial Sequence
  Description of Artificial Sequence: Synthetic peptide
  XENP018457 vhCDR3
YYGNYGGYFDV

SEQ ID NO: 15200 - protein, 214 aa, Artificial Sequence
  Description of Artificial Sequence: Synthetic polypeptide
  XENP018457 1G6_H1_L1.110_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15201 - protein, 107 aa, Artificial Sequence; identical to SEQ ID NO: 9484
  Description of Artificial Sequence: Synthetic polypeptide
  VL of XENP018457

SEQ ID NO: 15202 - protein, 11 aa, Artificial Sequence
  Description of Artificial Sequence: Synthetic peptide
  XENP018457 vlCDR1
RASQSVSNDVA

SEQ ID NO: 15203 - protein, 7 aa, Artificial Sequence
  Description of Artificial Sequence: Synthetic peptide
  XENP018457 vlCDR2
YASHRYT

SEQ ID NO: 15204 - protein, 9 aa, Artificial Sequence
  Description of Artificial Sequence: Synthetic peptide
  XENP018457 vlCDR3
QQSYSSPRT

SEQ ID NO: 15205 - protein, 451 aa, Artificial Sequence; identical to SEQ ID NO: 11545
  Description of Artificial Sequence: Synthetic polypeptide
  XENP018458 1G6_H1_L1.111_IgG1_PVA_/S267K Heavy Chain

SEQ ID NO: 15206 - protein, 122 aa, Artificial Sequence; identical to SEQ ID NO: 6246
  Description of Artificial Sequence: Synthetic polypeptide
  VH of XENP018458

SEQ ID NO: 15207 - protein, 5 aa, Artificial Sequence
  Description of Artificial Sequence: Synthetic peptide
  XENP018458 vhCDR1
NYWMN

SEQ ID NO: 15208 - protein, 19 aa, Artificial Sequence
  Description of Artificial Sequence: Synthetic peptide
  XENP018458 vhCDR2
EIRLKSNNYATHYAEPVKG

SEQ ID NO: 15209 - protein, 11 aa, Artificial Sequence
  Description of Artificial Sequence: Synthetic peptide
  XENP018458 vhCDR3
YYGNYGGYFDV

SEQ ID NO: 15210 - protein, 214 aa, Artificial Sequence
  Description of Artificial Sequence: Synthetic polypeptide
  XENP018458 1G6_H1_L1.111_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15211 - protein, 107 aa, Artificial Sequence; identical to SEQ ID NO: 9493
  Description of Artificial Sequence: Synthetic polypeptide
  VL of XENP018458

SEQ ID NO: 15212 - protein, 11 aa, Artificial Sequence
  Description of Artificial Sequence: Synthetic peptide
  XENP018458 vlCDR1
RASQSVSNDVA

SEQ ID NO: 15213 - protein, 7 aa, Artificial Sequence
  Description of Artificial Sequence: Synthetic peptide
  XENP018458 vlCDR2
YASHRYT

SEQ ID NO: 15214 - protein, 9 aa, Artificial Sequence
  Description of Artificial Sequence: Synthetic peptide
  XENP018458 vlCDR3
QQRYSSPRT

SEQ ID NO: 15215 - protein, 451 aa, Artificial Sequence; identical to SEQ ID NO: 11545
  Description of Artificial Sequence: Synthetic polypeptide
  XENP018459 1G6_H1_L1.112_IgG1_PVA_/S267K Heavy Chain

SEQ ID NO: 15216 - protein, 122 aa, Artificial Sequence; identical to SEQ ID NO: 6246
  Description of Artificial Sequence: Synthetic polypeptide
  VH of XENP018459

SEQ ID NO: 15217 - protein, 5 aa, Artificial Sequence
  Description of Artificial Sequence: Synthetic peptide
  XENP018459 vhCDR1
NYWMN

SEQ ID NO: 15218 - protein, 19 aa, Artificial Sequence
  Description of Artificial Sequence: Synthetic peptide
  XENP018459 vhCDR2
EIRLKSNNYATHYAEPVKG

SEQ ID NO: 15219 - protein, 11 aa, Artificial Sequence
  Description of Artificial Sequence: Synthetic peptide
  XENP018459 vhCDR3
YYGNYGGYFDV

SEQ ID NO: 15220 - protein, 214 aa, Artificial Sequence
  Description of Artificial Sequence: Synthetic polypeptide
  XENP018459 1G6_H1_L1.112_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15221 - protein, 107 aa, Artificial Sequence; identical to SEQ ID NO: 9502
  Description of Artificial Sequence: Synthetic polypeptide
  VL of XENP018459

SEQ ID NO: 15222 - protein, 11 aa, Artificial Sequence
  Description of Artificial Sequence: Synthetic peptide
  XENP018459 vlCDR1
RASQSVSNDVA

SEQ ID NO: 15223 - protein, 7 aa, Artificial Sequence
  Description of Artificial Sequence: Synthetic peptide
  XENP018459 vlCDR2
YASHRYT

SEQ ID NO: 15224 - protein, 9 aa, Artificial Sequence
  Description of Artificial Sequence: Synthetic peptide
  XENP018459 vlCDR3
QQLYSSPRT

SEQ ID NO: 15225 - protein, 451 aa, Artificial Sequence; identical to SEQ ID NO: 11545
  Description of Artificial Sequence: Synthetic polypeptide
  XENP018460 1G6_H1_L1.113_IgG1_PVA_/S267K Heavy Chain

SEQ ID NO: 15226 - protein, 122 aa, Artificial Sequence; identical to SEQ ID NO: 6246
  Description of Artificial Sequence: Synthetic polypeptide
  VH of XENP018460

SEQ ID NO: 15227 - protein, 5 aa, Artificial Sequence
  Description of Artificial Sequence: Synthetic peptide
  XENP018460 vhCDR1
NYWMN

SEQ ID NO: 15228 - protein, 19 aa, Artificial Sequence
  Description of Artificial Sequence: Synthetic peptide
  XENP018460 vhCDR2
EIRLKSNNYATHYAEPVKG

SEQ ID NO: 15229 - protein, 11 aa, Artificial Sequence
  Description of Artificial Sequence: Synthetic peptide
  XENP018460 vhCDR3
YYGNYGGYFDV

SEQ ID NO: 15230 - protein, 214 aa, Artificial Sequence
  Description of Artificial Sequence: Synthetic polypeptide
  XENP018460 1G6_H1_L1.113_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15231 - protein, 107 aa, Artificial Sequence; identical to SEQ ID NO: 9511
  Description of Artificial Sequence: Synthetic polypeptide
  VL of XENP018460

SEQ ID NO: 15232 - protein, 11 aa, Artificial Sequence
  Description of Artificial Sequence: Synthetic peptide
  XENP018460 vlCDR1
RASQSVSNDVA

SEQ ID NO: 15233 - protein, 7 aa, Artificial Sequence
  Description of Artificial Sequence: Synthetic peptide
  XENP018460 vlCDR2
YASHRYT

SEQ ID NO: 15234 - protein, 9 aa, Artificial Sequence
  Description of Artificial Sequence: Synthetic peptide
  XENP018460 vlCDR3
QQTYSSPRT

SEQ ID NO: 15235 - protein, 451 aa, Artificial Sequence; identical to SEQ ID NO: 11545
  Description of Artificial Sequence: Synthetic polypeptide
  XENP018461 1G6_H1_L1.114_IgG1_PVA_/S267K Heavy Chain

SEQ ID NO: 15236 - protein, 122 aa, Artificial Sequence; identical to SEQ ID NO: 6246
  Description of Artificial Sequence: Synthetic polypeptide
  VH of XENP018461

SEQ ID NO: 15237 - protein, 5 aa, Artificial Sequence
  Description of Artificial Sequence: Synthetic peptide
  XENP018461 vhCDR1
NYWMN

SEQ ID NO: 15238 - protein, 19 aa, Artificial Sequence
  Description of Artificial Sequence: Synthetic peptide
  XENP018461 vhCDR2
EIRLKSNNYATHYAEPVKG

SEQ ID NO: 15239 - protein, 11 aa, Artificial Sequence
  Description of Artificial Sequence: Synthetic peptide
  XENP018461 vhCDR3
YYGNYGGYFDV

SEQ ID NO: 15240 - protein, 214 aa, Artificial Sequence
  Description of Artificial Sequence: Synthetic polypeptide
  XENP018461 1G6_H1_L1.114_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15241 - protein, 107 aa, Artificial Sequence; identical to SEQ ID NO: 9520
  Description of Artificial Sequence: Synthetic polypeptide
  VL of XENP018461

SEQ ID NO: 15242 - protein, 11 aa, Artificial Sequence
  Description of Artificial Sequence: Synthetic peptide
  XENP018461 vlCDR1
RASQSVSNDVA

SEQ ID NO: 15243 - protein, 7 aa, Artificial Sequence
  Description of Artificial Sequence: Synthetic peptide
  XENP018461 vlCDR2
YASHRYT

SEQ ID NO: 15244 - protein, 9 aa, Artificial Sequence
  Description of Artificial Sequence: Synthetic peptide
  XENP018461 vlCDR3
QQGYSSPRT

SEQ ID NO: 15245 - protein, 451 aa, Artificial Sequence; identical to SEQ ID NO: 11545
  Description of Artificial Sequence: Synthetic polypeptide
  XENP018462 1G6_H1_L1.115_IgG1_PVA_/S267K Heavy Chain

SEQ ID NO: 15246 - protein, 122 aa, Artificial Sequence; identical to SEQ ID NO: 6246
  Description of Artificial Sequence: Synthetic polypeptide
  VH of XENP018462

SEQ ID NO: 15247 - protein, 5 aa, Artificial Sequence
  Description of Artificial Sequence: Synthetic peptide
  XENP018462 vhCDR1
NYWMN

SEQ ID NO: 15248 - protein, 19 aa, Artificial Sequence
  Description of Artificial Sequence: Synthetic peptide
  XENP018462 vhCDR2
EIRLKSNNYATHYAEPVKG

SEQ ID NO: 15249 - protein, 11 aa, Artificial Sequence
  Description of Artificial Sequence: Synthetic peptide
  XENP018462 vhCDR3
YYGNYGGYFDV

SEQ ID NO: 15250 - protein, 214 aa, Artificial Sequence
  Description of Artificial Sequence: Synthetic polypeptide
  XENP018462 1G6_H1_L1.115_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15251 - protein, 107 aa, Artificial Sequence; identical to SEQ ID NO: 9529
  Description of Artificial Sequence: Synthetic polypeptide
  VL of XENP018462

SEQ ID NO: 15252 - protein, 11 aa, Artificial Sequence
  Description of Artificial Sequence: Synthetic peptide
  XENP018462 vlCDR1
RASQSVSNDVA

SEQ ID NO: 15253 - protein, 7 aa, Artificial Sequence
  Description of Artificial Sequence: Synthetic peptide
  XENP018462 vlCDR2
YASHRYT

SEQ ID NO: 15254 - protein, 9 aa, Artificial Sequence
  Description of Artificial Sequence: Synthetic peptide
  XENP018462 vlCDR3
QQYYSSPRT

SEQ ID NO: 15255 - protein, 451 aa, Artificial Sequence; identical to SEQ ID NO: 11545
  Description of Artificial Sequence: Synthetic polypeptide
  XENP018463 1G6_H1_L1.116_IgG1_PVA_/S267K Heavy Chain

SEQ ID NO: 15256 - protein, 122 aa, Artificial Sequence; identical to SEQ ID NO: 6246
  Description of Artificial Sequence: Synthetic polypeptide
  VH of XENP018463

SEQ ID NO: 15257 - protein, 5 aa, Artificial Sequence
  Description of Artificial Sequence: Synthetic peptide
  XENP018463 vhCDR1
NYWMN

SEQ ID NO: 15258 - protein, 19 aa, Artificial Sequence
  Description of Artificial Sequence: Synthetic peptide
  XENP018463 vhCDR2
EIRLKSNNYATHYAEPVKG

SEQ ID NO: 15259 - protein, 11 aa, Artificial Sequence
  Description of Artificial Sequence: Synthetic peptide
  XENP018463 vhCDR3
YYGNYGGYFDV

SEQ ID NO: 15260 - protein, 214 aa, Artificial Sequence
  Description of Artificial Sequence: Synthetic polypeptide
  XENP018463 1G6_H1_L1.116_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15261 - protein, 107 aa, Artificial Sequence; identical to SEQ ID NO: 9538
  Description of Artificial Sequence: Synthetic polypeptide
  VL of XENP018463

SEQ ID NO: 15262 - protein, 11 aa, Artificial Sequence
  Description of Artificial Sequence: Synthetic peptide
  XENP018463 vlCDR1
RASQSVSNDVA

SEQ ID NO: 15263 - protein, 7 aa, Artificial Sequence
  Description of Artificial Sequence: Synthetic peptide
  XENP018463 vlCDR2
YASHRYT

SEQ ID NO: 15264 - protein, 9 aa, Artificial Sequence
  Description of Artificial Sequence: Synthetic peptide
  XENP018463 vlCDR3
QQDFSSPRT

SEQ ID NO: 15265 - protein, 451 aa, Artificial Sequence; identical to SEQ ID NO: 11545
  Description of Artificial Sequence: Synthetic polypeptide
  XENP018464 1G6_H1_L1.117_IgG1_PVA_/S267K Heavy Chain

SEQ ID NO: 15266 - protein, 122 aa, Artificial Sequence; identical to SEQ ID NO: 6246
  Description of Artificial Sequence: Synthetic polypeptide
  VH of XENP018464

SEQ ID NO: 15267 - protein, 5 aa, Artificial Sequence
  Description of Artificial Sequence: Synthetic peptide
  XENP018464 vhCDR1
NYWMN

SEQ ID NO: 15268 - protein, 19 aa, Artificial Sequence
  Description of Artificial Sequence: Synthetic peptide
  XENP018464 vhCDR2
EIRLKSNNYATHYAEPVKG

SEQ ID NO: 15269 - protein, 11 aa, Artificial Sequence
  Description of Artificial Sequence: Synthetic peptide
  XENP018464 vhCDR3
YYGNYGGYFDV

SEQ ID NO: 15270 - protein, 214 aa, Artificial Sequence
  Description of Artificial Sequence: Synthetic polypeptide
  XENP018464 1G6_H1_L1.117_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15271 - protein, 107 aa, Artificial Sequence; identical to SEQ ID NO: 9547
  Description of Artificial Sequence: Synthetic polypeptide
  VL of XENP018464

SEQ ID NO: 15272 - protein, 11 aa, Artificial Sequence
  Description of Artificial Sequence: Synthetic peptide
  XENP018464 vlCDR1
RASQSVSNDVA

SEQ ID NO: 15273 - protein, 7 aa, Artificial Sequence
  Description of Artificial Sequence: Synthetic peptide
  XENP018464 vlCDR2
YASHRYT

SEQ ID NO: 15274 - protein, 9 aa, Artificial Sequence
  Description of Artificial Sequence: Synthetic peptide
  XENP018464 vlCDR3
QQDHSSPRT

SEQ ID NO: 15275 - protein, 451 aa, Artificial Sequence; identical to SEQ ID NO: 11545
  Description of Artificial Sequence: Synthetic polypeptide
  XENP018465 1G6_H1_L1.118_IgG1_PVA_/S267K Heavy Chain

SEQ ID NO: 15276 - protein, 122 aa, Artificial Sequence; identical to SEQ ID NO: 6246
  Description of Artificial Sequence: Synthetic polypeptide
  VH of XENP018465

SEQ ID NO: 15277 - protein, 5 aa, Artificial Sequence
  Description of Artificial Sequence: Synthetic peptide
  XENP018465 vhCDR1
NYWMN

SEQ ID NO: 15278 - protein, 19 aa, Artificial Sequence
  Description of Artificial Sequence: Synthetic peptide
  XENP018465 vhCDR2
EIRLKSNNYATHYAEPVKG

SEQ ID NO: 15279 - protein, 11 aa, Artificial Sequence
  Description of Artificial Sequence: Synthetic peptide
  XENP018465 vhCDR3
YYGNYGGYFDV

SEQ ID NO: 15280 - protein, 214 aa, Artificial Sequence
  Description of Artificial Sequence: Synthetic polypeptide
  XENP018465 1G6_H1_L1.118_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15281 - protein, 107 aa, Artificial Sequence; identical to SEQ ID NO: 9556
  Description of Artificial Sequence: Synthetic polypeptide
  VL of XENP018465

SEQ ID NO: 15282 - protein, 11 aa, Artificial Sequence
  Description of Artificial Sequence: Synthetic peptide
  XENP018465 vlCDR1
RASQSVSNDVA

SEQ ID NO: 15283 - protein, 7 aa, Artificial Sequence
  Description of Artificial Sequence: Synthetic peptide
  XENP018465 vlCDR2
YASHRYT

SEQ ID NO: 15284 - protein, 9 aa, Artificial Sequence
  Description of Artificial Sequence: Synthetic peptide
  XENP018465 vlCDR3
QQDLSSPRT

SEQ ID NO: 15285 - protein, 451 aa, Artificial Sequence; identical to SEQ ID NO: 11545
  Description of Artificial Sequence: Synthetic polypeptide
  XENP018466 1G6_H1_L1.119_IgG1_PVA_/S267K Heavy Chain

SEQ ID NO: 15286 - protein, 122 aa, Artificial Sequence; identical to SEQ ID NO: 6246
  Description of Artificial Sequence: Synthetic polypeptide
  VH of XENP018466

SEQ ID NO: 15287 - protein, 5 aa, Artificial Sequence
  Description of Artificial Sequence: Synthetic peptide
  XENP018466 vhCDR1
NYWMN

SEQ ID NO: 15288 - protein, 19 aa, Artificial Sequence
  Description of Artificial Sequence: Synthetic peptide
  XENP018466 vhCDR2
EIRLKSNNYATHYAEPVKG

SEQ ID NO: 15289 - protein, 11 aa, Artificial Sequence
  Description of Artificial Sequence: Synthetic peptide
  XENP018466 vhCDR3
YYGNYGGYFDV

SEQ ID NO: 15290 - protein, 214 aa, Artificial Sequence
  Description of Artificial Sequence: Synthetic polypeptide
  XENP018466 1G6_H1_L1.119_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15291 - protein, 107 aa, Artificial Sequence; identical to SEQ ID NO: 9565
  Description of Artificial Sequence: Synthetic polypeptide
  VL of XENP018466

SEQ ID NO: 15292 - protein, 11 aa, Artificial Sequence
  Description of Artificial Sequence: Synthetic peptide
  XENP018466 vlCDR1
RASQSVSNDVA

SEQ ID NO: 15293 - protein, 7 aa, Artificial Sequence
  Description of Artificial Sequence: Synthetic peptide
  XENP018466 vlCDR2
YASHRYT

SEQ ID NO: 15294 - protein, 9 aa, Artificial Sequence
  Description of Artificial Sequence: Synthetic peptide
  XENP018466 vlCDR3
QQDWSSPRT

SEQ ID NO: 15295 - protein, 451 aa, Artificial Sequence; identical to SEQ ID NO: 11545
  Description of Artificial Sequence: Synthetic polypeptide
  XENP018467 1G6_H1_L1.120_IgG1_PVA_/S267K Heavy Chain

SEQ ID NO: 15296 - protein, 122 aa, Artificial Sequence; identical to SEQ ID NO: 6246
  Description of Artificial Sequence: Synthetic polypeptide
  VH of XENP018467

SEQ ID NO: 15297 - protein, 5 aa, Artificial Sequence
  Description of Artificial Sequence: Synthetic peptide
  XENP018467 vhCDR1
NYWMN

SEQ ID NO: 15298 - protein, 19 aa, Artificial Sequence
  Description of Artificial Sequence: Synthetic peptide
  XENP018467 vhCDR2
EIRLKSNNYATHYAEPVKG

SEQ ID NO: 15299 - protein, 11 aa, Artificial Sequence
  Description of Artificial Sequence: Synthetic peptide
  XENP018467 vhCDR3
YYGNYGGYFDV

SEQ ID NO: 15300 - protein, 214 aa, Artificial Sequence
  Description of Artificial Sequence: Synthetic polypeptide
  XENP018467 1G6_H1_L1.120_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15301 - protein, 107 aa, Artificial Sequence; identical to SEQ ID NO: 9574
  Description of Artificial Sequence: Synthetic polypeptide
  VL of XENP018467

SEQ ID NO: 15302 - protein, 11 aa, Artificial Sequence
  Description of Artificial Sequence: Synthetic peptide
  XENP018467 vlCDR1
RASQSVSNDVA

SEQ ID NO: 15303 - protein, 7 aa, Artificial Sequence
  Description of Artificial Sequence: Synthetic peptide
  XENP018467 vlCDR2
YASHRYT

SEQ ID NO: 15304 - protein, 9 aa, Artificial Sequence
  Description of Artificial Sequence: Synthetic peptide
  XENP018467 vlCDR3
QQDVSSPRT

SEQ ID NO: 15305 - protein, 451 aa, Artificial Sequence; identical to SEQ ID NO: 11545
  Description of Artificial Sequence: Synthetic polypeptide
  XENP018468 1G6_H1_L1.121_IgG1_PVA_/S267K Heavy Chain

SEQ ID NO: 15306 - protein, 122 aa, Artificial Sequence; identical to SEQ ID NO: 6246
  Description of Artificial Sequence: Synthetic polypeptide
  VH of XENP018468

SEQ ID NO: 15307 - protein, 5 aa, Artificial Sequence
  Description of Artificial Sequence: Synthetic peptide
  XENP018468 vhCDR1
NYWMN

SEQ ID NO: 15308 - protein, 19 aa, Artificial Sequence
  Description of Artificial Sequence: Synthetic peptide
  XENP018468 vhCDR2
EIRLKSNNYATHYAEPVKG

SEQ ID NO: 15309 - protein, 11 aa, Artificial Sequence
  Description of Artificial Sequence: Synthetic peptide
  XENP018468 vhCDR3
YYGNYGGYFDV

SEQ ID NO: 15310 - protein, 214 aa, Artificial Sequence
  Description of Artificial Sequence: Synthetic polypeptide
  XENP018468 1G6_H1_L1.121_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15311 - protein, 107 aa, Artificial Sequence; identical to SEQ ID NO: 9583
  Description of Artificial Sequence: Synthetic polypeptide
  VL of XENP018468

SEQ ID NO: 15312 - protein, 11 aa, Artificial Sequence
  Description of Artificial Sequence: Synthetic peptide
  XENP018468 vlCDR1
RASQSVSNDVA

SEQ ID NO: 15313 - protein, 7 aa, Artificial Sequence
  Description of Artificial Sequence: Synthetic peptide
  XENP018468 vlCDR2
YASHRYT

SEQ ID NO: 15314 - protein, 9 aa, Artificial Sequence
  Description of Artificial Sequence: Synthetic peptide
  XENP018468 vlCDR3
QQDASSPRT

SEQ ID NO: 15315 - protein, 451 aa, Artificial Sequence; identical to SEQ ID NO: 11545
  Description of Artificial Sequence: Synthetic polypeptide
  XENP018469 1G6_H1_L1.122_IgG1_PVA_/S267K Heavy Chain

SEQ ID NO: 15316 - protein, 122 aa, Artificial Sequence; identical to SEQ ID NO: 6246
  Description of Artificial Sequence: Synthetic polypeptide
  VH of XENP018469

SEQ ID NO: 15317 - protein, 5 aa, Artificial Sequence
  Description of Artificial Sequence: Synthetic peptide
  XENP018469 vhCDR1
NYWMN

SEQ ID NO: 15318 - protein, 19 aa, Artificial Sequence
  Description of Artificial Sequence: Synthetic peptide
  XENP018469 vhCDR2
EIRLKSNNYATHYAEPVKG

SEQ ID NO: 15319 - protein, 11 aa, Artificial Sequence
  Description of Artificial Sequence: Synthetic peptide
  XENP018469 vhCDR3
YYGNYGGYFDV

SEQ ID NO: 15320 - protein, 214 aa, Artificial Sequence
  Description of Artificial Sequence: Synthetic polypeptide
  XENP018469 1G6_H1_L1.122_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15321 - protein, 107 aa, Artificial Sequence; identical to SEQ ID NO: 9592
  Description of Artificial Sequence: Synthetic polypeptide
  VL of XENP018469

SEQ ID NO: 15322 - protein, 11 aa, Artificial Sequence
  Description of Artificial Sequence: Synthetic peptide
  XENP018469 vlCDR1
RASQSVSNDVA

SEQ ID NO: 15323 - protein, 7 aa, Artificial Sequence
  Description of Artificial Sequence: Synthetic peptide
  XENP018469 vlCDR2
YASHRYT

SEQ ID NO: 15324 - protein, 9 aa, Artificial Sequence
  Description of Artificial Sequence: Synthetic peptide
  XENP018469 vlCDR3
QQDQSSPRT

SEQ ID NO: 15325 - protein, 451 aa, Artificial Sequence; identical to SEQ ID NO: 11545
  Description of Artificial Sequence: Synthetic polypeptide
  XENP018470 1G6_H1_L1.123_IgG1_PVA_/S267K Heavy Chain

SEQ ID NO: 15326 - protein, 122 aa, Artificial Sequence; identical to SEQ ID NO: 6246
  Description of Artificial Sequence: Synthetic polypeptide
  VH of XENP018470

SEQ ID NO: 15327 - protein, 5 aa, Artificial Sequence
  Description of Artificial Sequence: Synthetic peptide
  XENP018470 vhCDR1
NYWMN

SEQ ID NO: 15328 - protein, 19 aa, Artificial Sequence
  Description of Artificial Sequence: Synthetic peptide
  XENP018470 vhCDR2
EIRLKSNNYATHYAEPVKG

SEQ ID NO: 15329 - protein, 11 aa, Artificial Sequence
  Description of Artificial Sequence: Synthetic peptide
  XENP018470 vhCDR3
YYGNYGGYFDV

SEQ ID NO: 15330 - protein, 214 aa, Artificial Sequence
  Description of Artificial Sequence: Synthetic polypeptide
  XENP018470 1G6_H1_L1.123_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15331 - protein, 107 aa, Artificial Sequence; identical to SEQ ID NO: 9601
  Description of Artificial Sequence: Synthetic polypeptide
  VL of XENP018470

SEQ ID NO: 15332 - protein, 11 aa, Artificial Sequence
  Description of Artificial Sequence: Synthetic peptide
  XENP018470 vlCDR1
RASQSVSNDVA

SEQ ID NO: 15333 - protein, 7 aa, Artificial Sequence
  Description of Artificial Sequence: Synthetic peptide
  XENP018470 vlCDR2
YASHRYT

SEQ ID NO: 15334 - protein, 9 aa, Artificial Sequence
  Description of Artificial Sequence: Synthetic peptide
  XENP018470 vlCDR3
QQDDSSPRT

SEQ ID NO: 15335 - protein, 451 aa, Artificial Sequence; identical to SEQ ID NO: 11545
  Description of Artificial Sequence: Synthetic polypeptide
  XENP018471 1G6_H1_L1.124_IgG1_PVA_/S267K Heavy Chain

SEQ ID NO: 15336 - protein, 122 aa, Artificial Sequence; identical to SEQ ID NO: 6246
  Description of Artificial Sequence: Synthetic polypeptide
  VH of XENP018471

SEQ ID NO: 15337 - protein, 5 aa, Artificial Sequence
  Description of Artificial Sequence: Synthetic peptide
  XENP018471 vhCDR1
NYWMN

SEQ ID NO: 15338 - protein, 19 aa, Artificial Sequence
  Description of Artificial Sequence: Synthetic peptide
  XENP018471 vhCDR2
EIRLKSNNYATHYAEPVKG

SEQ ID NO: 15339 - protein, 11 aa, Artificial Sequence
  Description of Artificial Sequence: Synthetic peptide
  XENP018471 vhCDR3
YYGNYGGYFDV

SEQ ID NO: 15340 - protein, 214 aa, Artificial Sequence
  Description of Artificial Sequence: Synthetic polypeptide
  XENP018471 1G6_H1_L1.124_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15341 - protein, 107 aa, Artificial Sequence; identical to SEQ ID NO: 9610
  Description of Artificial Sequence: Synthetic polypeptide
  VL of XENP018471

SEQ ID NO: 15342 - protein, 11 aa, Artificial Sequence
  Description of Artificial Sequence: Synthetic peptide
  XENP018471 vlCDR1
RASQSVSNDVA

SEQ ID NO: 15343 - protein, 7 aa, Artificial Sequence
  Description of Artificial Sequence: Synthetic peptide
  XENP018471 vlCDR2
YASHRYT

SEQ ID NO: 15344 - protein, 9 aa, Artificial Sequence
  Description of Artificial Sequence: Synthetic peptide
  XENP018471 vlCDR3
QQDKSSPRT

SEQ ID NO: 15345 - protein, 451 aa, Artificial Sequence; identical to SEQ ID NO: 11545
  Description of Artificial Sequence: Synthetic polypeptide
  XENP018472 1G6_H1_L1.125_IgG1_PVA_/S267K Heavy Chain

SEQ ID NO: 15346 - protein, 122 aa, Artificial Sequence; identical to SEQ ID NO: 6246
  Description of Artificial Sequence: Synthetic polypeptide
  VH of XENP018472

SEQ ID NO: 15347 - protein, 5 aa, Artificial Sequence
  Description of Artificial Sequence: Synthetic peptide
  XENP018472 vhCDR1
NYWMN

SEQ ID NO: 15348 - protein, 19 aa, Artificial Sequence
  Description of Artificial Sequence: Synthetic peptide
  XENP018472 vhCDR2
EIRLKSNNYATHYAEPVKG

SEQ ID NO: 15349 - protein, 11 aa, Artificial Sequence
  Description of Artificial Sequence: Synthetic peptide
  XENP018472 vhCDR3
YYGNYGGYFDV

SEQ ID NO: 15350 - protein, 214 aa, Artificial Sequence
  Description of Artificial Sequence: Synthetic polypeptide
  XENP018472 1G6_H1_L1.125_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15351 - protein, 107 aa, Artificial Sequence; identical to SEQ ID NO: 9619
  Description of Artificial Sequence: Synthetic polypeptide
  VL of XENP018472

SEQ ID NO: 15352 - protein, 11 aa, Artificial Sequence
  Description of Artificial Sequence: Synthetic peptide
  XENP018472 vlCDR1
RASQSVSNDVA

SEQ ID NO: 15353 - protein, 7 aa, Artificial Sequence
  Description of Artificial Sequence: Synthetic peptide
  XENP018472 vlCDR2
YASHRYT

SEQ ID NO: 15354 - protein, 9 aa, Artificial Sequence
  Description of Artificial Sequence: Synthetic peptide
  XENP018472 vlCDR3
QQDSSSPRT

SEQ ID NO: 15355 - protein, 451 aa, Artificial Sequence; identical to SEQ ID NO: 11545
  Description of Artificial Sequence: Synthetic polypeptide
  XENP018473 1G6_H1_L1.126_IgG1_PVA_/S267K Heavy Chain

SEQ ID NO: 15356 - protein, 122 aa, Artificial Sequence; identical to SEQ ID NO: 6246
  Description of Artificial Sequence: Synthetic polypeptide
  VH of XENP018473

SEQ ID NO: 15357 - protein, 5 aa, Artificial Sequence
  Description of Artificial Sequence: Synthetic peptide
  XENP018473 vhCDR1
NYWMN

SEQ ID NO: 15358 - protein, 19 aa, Artificial Sequence
  Description of Artificial Sequence: Synthetic peptide
  XENP018473 vhCDR2
EIRLKSNNYATHYAEPVKG

SEQ ID NO: 15359 - protein, 11 aa, Artificial Sequence
  Description of Artificial Sequence: Synthetic peptide
  XENP018473 vhCDR3
YYGNYGGYFDV

SEQ ID NO: 15360 - protein, 214 aa, Artificial Sequence
  Description of Artificial Sequence: Synthetic polypeptide
  XENP018473 1G6_H1_L1.126_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15361 - protein, 107 aa, Artificial Sequence; identical to SEQ ID NO: 9628
  Description of Artificial Sequence: Synthetic polypeptide
  VL of XENP018473

SEQ ID NO: 15362 - protein, 11 aa, Artificial Sequence
  Description of Artificial Sequence: Synthetic peptide
  XENP018473 vlCDR1
RASQSVSNDVA

SEQ ID NO: 15363 - protein, 7 aa, Artificial Sequence
  Description of Artificial Sequence: Synthetic peptide
  XENP018473 vlCDR2
YASHRYT

SEQ ID NO: 15364 - protein, 9 aa, Artificial Sequence
  Description of Artificial Sequence: Synthetic peptide
  XENP018473 vlCDR3
QQDGSSPRT

SEQ ID NO: 15365 - protein, 451 aa, Artificial Sequence; identical to SEQ ID NO: 11545
  Description of Artificial Sequence: Synthetic polypeptide
  XENP018474 1G6_H1_L1.127_IgG1_PVA_/S267K Heavy Chain

SEQ ID NO: 15366 - protein, 122 aa, Artificial Sequence; identical to SEQ ID NO: 6246
  Description of Artificial Sequence: Synthetic polypeptide
  VH of XENP018474

SEQ ID NO: 15367 - protein, 5 aa, Artificial Sequence
  Description of Artificial Sequence: Synthetic peptide
  XENP018474 vhCDR1
NYWMN

SEQ ID NO: 15368 - protein, 19 aa, Artificial Sequence
  Description of Artificial Sequence: Synthetic peptide
  XENP018474 vhCDR2
EIRLKSNNYATHYAEPVKG

SEQ ID NO: 15369 - protein, 11 aa, Artificial Sequence
  Description of Artificial Sequence: Synthetic peptide
  XENP018474 vhCDR3
YYGNYGGYFDV

SEQ ID NO: 15370 - protein, 214 aa, Artificial Sequence
  Description of Artificial Sequence: Synthetic polypeptide
  XENP018474 1G6_H1_L1.127_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15371 - protein, 107 aa, Artificial Sequence; identical to SEQ ID NO: 9637
  Description of Artificial Sequence: Synthetic polypeptide
  VL of XENP018474

SEQ ID NO: 15372 - protein, 11 aa, Artificial Sequence
  Description of Artificial Sequence: Synthetic peptide
  XENP018474 vlCDR1
RASQSVSNDVA

SEQ ID NO: 15373 - protein, 7 aa, Artificial Sequence
  Description of Artificial Sequence: Synthetic peptide
  XENP018474 vlCDR2
YASHRYT

SEQ ID NO: 15374 - protein, 9 aa, Artificial Sequence
  Description of Artificial Sequence: Synthetic peptide
  XENP018474 vlCDR3
QQDYTSPRT

SEQ ID NO: 15375 - protein, 451 aa, Artificial Sequence; identical to SEQ ID NO: 11545
  Description of Artificial Sequence: Synthetic polypeptide
  XENP018475 1G6_H1_L1.128_IgG1_PVA_/S267K Heavy Chain

SEQ ID NO: 15376 - protein, 122 aa, Artificial Sequence; identical to SEQ ID NO: 6246
  Description of Artificial Sequence: Synthetic polypeptide
  VH of XENP018475

SEQ ID NO: 15377 - protein, 5 aa, Artificial Sequence
  Description of Artificial Sequence: Synthetic peptide
  XENP018475 vhCDR1
NYWMN

SEQ ID NO: 15378 - protein, 19 aa, Artificial Sequence
  Description of Artificial Sequence: Synthetic peptide
  XENP018475 vhCDR2
EIRLKSNNYATHYAEPVKG

SEQ ID NO: 15379 - protein, 11 aa, Artificial Sequence
  Description of Artificial Sequence: Synthetic peptide
  XENP018475 vhCDR3
YYGNYGGYFDV

SEQ ID NO: 15380 - protein, 214 aa, Artificial Sequence
  Description of Artificial Sequence: Synthetic polypeptide
  XENP018475 1G6_H1_L1.128_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15381 - protein, 107 aa, Artificial Sequence; identical to SEQ ID NO: 9646
  Description of Artificial Sequence: Synthetic polypeptide
  VL of XENP018475

SEQ ID NO: 15382 - protein, 11 aa, Artificial Sequence
  Description of Artificial Sequence: Synthetic peptide
  XENP018475 vlCDR1
RASQSVSNDVA

SEQ ID NO: 15383 - protein, 7 aa, Artificial Sequence
  Description of Artificial Sequence: Synthetic peptide
  XENP018475 vlCDR2
YASHRYT

SEQ ID NO: 15384 - protein, 9 aa, Artificial Sequence
  Description of Artificial Sequence: Synthetic peptide
  XENP018475 vlCDR3
QQDYASPRT

SEQ ID NO: 15385 - protein, 451 aa, Artificial Sequence; identical to SEQ ID NO: 11545
  Description of Artificial Sequence: Synthetic polypeptide
  XENP018476 1G6_H1_L1.129_IgG1_PVA_/S267K Heavy Chain

SEQ ID NO: 15386 - protein, 122 aa, Artificial Sequence; identical to SEQ ID NO: 6246
  Description of Artificial Sequence: Synthetic polypeptide
  VH of XENP018476

SEQ ID NO: 15387 - protein, 5 aa, Artificial Sequence
  Description of Artificial Sequence: Synthetic peptide
  XENP018476 vhCDR1
NYWMN

SEQ ID NO: 15388 - protein, 19 aa, Artificial Sequence
  Description of Artificial Sequence: Synthetic peptide
  XENP018476 vhCDR2
EIRLKSNNYATHYAEPVKG

SEQ ID NO: 15389 - protein, 11 aa, Artificial Sequence
  Description of Artificial Sequence: Synthetic peptide
  XENP018476 vhCDR3
YYGNYGGYFDV

SEQ ID NO: 15390 - protein, 214 aa, Artificial Sequence
  Description of Artificial Sequence: Synthetic polypeptide
  XENP018476 1G6_H1_L1.129_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15391 - protein, 107 aa, Artificial Sequence; identical to SEQ ID NO: 9655
  Description of Artificial Sequence: Synthetic polypeptide
  VL of XENP018476

SEQ ID NO: 15392 - protein, 11 aa, Artificial Sequence
  Description of Artificial Sequence: Synthetic peptide
  XENP018476 vlCDR1
RASQSVSNDVA

SEQ ID NO: 15393 - protein, 7 aa, Artificial Sequence
  Description of Artificial Sequence: Synthetic peptide
  XENP018476 vlCDR2
YASHRYT

SEQ ID NO: 15394 - protein, 9 aa, Artificial Sequence
  Description of Artificial Sequence: Synthetic peptide
  XENP018476 vlCDR3
QQDYQSPRT

SEQ ID NO: 15395 - protein, 451 aa, Artificial Sequence; identical to SEQ ID NO: 11545
  Description of Artificial Sequence: Synthetic polypeptide
  XENP018477 1G6_H1_L1.130_IgG1_PVA_/S267K Heavy Chain

SEQ ID NO: 15396 - protein, 122 aa, Artificial Sequence; identical to SEQ ID NO: 6246
  Description of Artificial Sequence: Synthetic polypeptide
  VH of XENP018477

SEQ ID NO: 15397 - protein, 5 aa, Artificial Sequence
  Description of Artificial Sequence: Synthetic peptide
  XENP018477 vhCDR1
NYWMN

SEQ ID NO: 15398 - protein, 19 aa, Artificial Sequence
  Description of Artificial Sequence: Synthetic peptide
  XENP018477 vhCDR2
EIRLKSNNYATHYAEPVKG

SEQ ID NO: 15399 - protein, 11 aa, Artificial Sequence
  Description of Artificial Sequence: Synthetic peptide
  XENP018477 vhCDR3
YYGNYGGYFDV

SEQ ID NO: 15400 - protein, 214 aa, Artificial Sequence
  Description of Artificial Sequence: Synthetic polypeptide
  XENP018477 1G6_H1_L1.130_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15401 - protein, 107 aa, Artificial Sequence; identical to SEQ ID NO: 9664
  Description of Artificial Sequence: Synthetic polypeptide
  VL of XENP018477

SEQ ID NO: 15402 - protein, 11 aa, Artificial Sequence
  Description of Artificial Sequence: Synthetic peptide
  XENP018477 vlCDR1
RASQSVSNDVA

SEQ ID NO: 15403 - protein, 7 aa, Artificial Sequence
  Description of Artificial Sequence: Synthetic peptide
  XENP018477 vlCDR2
YASHRYT

SEQ ID NO: 15404 - protein, 9 aa, Artificial Sequence
  Description of Artificial Sequence: Synthetic peptide
  XENP018477 vlCDR3
QQDYGSPRT

SEQ ID NO: 15405 - protein, 451 aa, Artificial Sequence; identical to SEQ ID NO: 11545
  Description of Artificial Sequence: Synthetic polypeptide
  XENP018478 1G6_H1_L1.131_IgG1_PVA_/S267K Heavy Chain

SEQ ID NO: 15406 - protein, 122 aa, Artificial Sequence; identical to SEQ ID NO: 6246
  Description of Artificial Sequence: Synthetic polypeptide
  VH of XENP018478

SEQ ID NO: 15407 - protein, 5 aa, Artificial Sequence
  Description of Artificial Sequence: Synthetic peptide
  XENP018478 vhCDR1
NYWMN

SEQ ID NO: 15408 - protein, 19 aa, Artificial Sequence
  Description of Artificial Sequence: Synthetic peptide
  XENP018478 vhCDR2
EIRLKSNNYATHYAEPVKG

SEQ ID NO: 15409 - protein, 11 aa, Artificial Sequence
  Description of Artificial Sequence: Synthetic peptide
  XENP018478 vhCDR3
YYGNYGGYFDV

SEQ ID NO: 15410 - protein, 214 aa, Artificial Sequence
  Description of Artificial Sequence: Synthetic polypeptide
  XENP018478 1G6_H1_L1.131_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15411 - protein, 107 aa, Artificial Sequence; identical to SEQ ID NO: 9673
  Description of Artificial Sequence: Synthetic polypeptide
  VL of XENP018478

SEQ ID NO: 15412 - protein, 11 aa, Artificial Sequence
  Description of Artificial Sequence: Synthetic peptide
  XENP018478 vlCDR1
RASQSVSNDVA

SEQ ID NO: 15413 - protein, 7 aa, Artificial Sequence
  Description of Artificial Sequence: Synthetic peptide
  XENP018478 vlCDR2
YASHRYT

SEQ ID NO: 15414 - protein, 9 aa, Artificial Sequence
  Description of Artificial Sequence: Synthetic peptide
  XENP018478 vlCDR3
QQDYVSPRT

SEQ ID NO: 15415 - protein, 451 aa, Artificial Sequence; identical to SEQ ID NO: 11545
  Description of Artificial Sequence: Synthetic polypeptide
  XENP018479 1G6_H1_L1.132_IgG1_PVA_/S267K Heavy Chain

SEQ ID NO: 15416 - protein, 122 aa, Artificial Sequence; identical to SEQ ID NO: 6246
  Description of Artificial Sequence: Synthetic polypeptide
  VH of XENP018479

SEQ ID NO: 15417 - protein, 5 aa, Artificial Sequence
  Description of Artificial Sequence: Synthetic peptide
  XENP018479 vhCDR1
NYWMN

SEQ ID NO: 15418 - protein, 19 aa, Artificial Sequence
  Description of Artificial Sequence: Synthetic peptide
  XENP018479 vhCDR2
EIRLKSNNYATHYAEPVKG

SEQ ID NO: 15419 - protein, 11 aa, Artificial Sequence
  Description of Artificial Sequence: Synthetic peptide
  XENP018479 vhCDR3
YYGNYGGYFDV

SEQ ID NO: 15420 - protein, 214 aa, Artificial Sequence
  Description of Artificial Sequence: Synthetic polypeptide
  XENP018479 1G6_H1_L1.132_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15421 - protein, 107 aa, Artificial Sequence; identical to SEQ ID NO: 9682
  Description of Artificial Sequence: Synthetic polypeptide
  VL of XENP018479

SEQ ID NO: 15422 - protein, 11 aa, Artificial Sequence
  Description of Artificial Sequence: Synthetic peptide
  XENP018479 vlCDR1
RASQSVSNDVA

SEQ ID NO: 15423 - protein, 7 aa, Artificial Sequence
  Description of Artificial Sequence: Synthetic peptide
  XENP018479 vlCDR2
YASHRYT

SEQ ID NO: 15424 - protein, 9 aa, Artificial Sequence
  Description of Artificial Sequence: Synthetic peptide
  XENP018479 vlCDR3
QQDYHSPRT

SEQ ID NO: 15425 - protein, 451 aa, Artificial Sequence; identical to SEQ ID NO: 11545
  Description of Artificial Sequence: Synthetic polypeptide
  XENP018480 1G6_H1_L1.133_IgG1_PVA_/S267K Heavy Chain

SEQ ID NO: 15426 - protein, 122 aa, Artificial Sequence; identical to SEQ ID NO: 6246
  Description of Artificial Sequence: Synthetic polypeptide
  VH of XENP018480

SEQ ID NO: 15427 - protein, 5 aa, Artificial Sequence
  Description of Artificial Sequence: Synthetic peptide
  XENP018480 vhCDR1
NYWMN

SEQ ID NO: 15428 - protein, 19 aa, Artificial Sequence
  Description of Artificial Sequence: Synthetic peptide
  XENP018480 vhCDR2
EIRLKSNNYATHYAEPVKG

SEQ ID NO: 15429 - protein, 11 aa, Artificial Sequence
  Description of Artificial Sequence: Synthetic peptide
  XENP018480 vhCDR3
YYGNYGGYFDV

SEQ ID NO: 15430 - protein, 214 aa, Artificial Sequence
  Description of Artificial Sequence: Synthetic polypeptide
  XENP018480 1G6_H1_L1.133_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15431 - protein, 107 aa, Artificial Sequence; identical to SEQ ID NO: 9691
  Description of Artificial Sequence: Synthetic polypeptide
  VL of XENP018480

SEQ ID NO: 15432 - protein, 11 aa, Artificial Sequence
  Description of Artificial Sequence: Synthetic peptide
  XENP018480 vlCDR1
RASQSVSNDVA

SEQ ID NO: 15433 - protein, 7 aa, Artificial Sequence
  Description of Artificial Sequence: Synthetic peptide
  XENP018480 vlCDR2
YASHRYT

SEQ ID NO: 15434 - protein, 9 aa, Artificial Sequence
  Description of Artificial Sequence: Synthetic peptide
  XENP018480 vlCDR3
QQDYDSPRT

SEQ ID NO: 15435 - protein, 451 aa, Artificial Sequence; identical to SEQ ID NO: 11545
  Description of Artificial Sequence: Synthetic polypeptide
  XENP018481 1G6_H1_L1.134_IgG1_PVA_/S267K Heavy Chain

SEQ ID NO: 15436 - protein, 122 aa, Artificial Sequence; identical to SEQ ID NO: 6246
  Description of Artificial Sequence: Synthetic polypeptide
  VH of XENP018481

SEQ ID NO: 15437 - protein, 5 aa, Artificial Sequence
  Description of Artificial Sequence: Synthetic peptide
  XENP018481 vhCDR1
NYWMN

SEQ ID NO: 15438 - protein, 19 aa, Artificial Sequence
  Description of Artificial Sequence: Synthetic peptide
  XENP018481 vhCDR2
EIRLKSNNYATHYAEPVKG

SEQ ID NO: 15439 - protein, 11 aa, Artificial Sequence
  Description of Artificial Sequence: Synthetic peptide
  XENP018481 vhCDR3
YYGNYGGYFDV

SEQ ID NO: 15440 - protein, 214 aa, Artificial Sequence
  Description of Artificial Sequence: Synthetic polypeptide
  XENP018481 1G6_H1_L1.134_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15441 - protein, 107 aa, Artificial Sequence; identical to SEQ ID NO: 9700
  Description of Artificial Sequence: Synthetic polypeptide
  VL of XENP018481

SEQ ID NO: 15442 - protein, 11 aa, Artificial Sequence
  Description of Artificial Sequence: Synthetic peptide
  XENP018481 vlCDR1
RASQSVSNDVA

SEQ ID NO: 15443 - protein, 7 aa, Artificial Sequence
  Description of Artificial Sequence: Synthetic peptide
  XENP018481 vlCDR2
YASHRYT

SEQ ID NO: 15444 - protein, 9 aa, Artificial Sequence
  Description of Artificial Sequence: Synthetic peptide
  XENP018481 vlCDR3
QQDYKSPRT

SEQ ID NO: 15445 - protein, 451 aa, Artificial Sequence; identical to SEQ ID NO: 11545
  Description of Artificial Sequence: Synthetic polypeptide
  XENP018482 1G6_H1_L1.135_IgG1_PVA_/S267K Heavy Chain

SEQ ID NO: 15446 - protein, 122 aa, Artificial Sequence; identical to SEQ ID NO: 6246
  Description of Artificial Sequence: Synthetic polypeptide
  VH of XENP018482

SEQ ID NO: 15447 - protein, 5 aa, Artificial Sequence
  Description of Artificial Sequence: Synthetic peptide
  XENP018482 vhCDR1
NYWMN

SEQ ID NO: 15448 - protein, 19 aa, Artificial Sequence
  Description of Artificial Sequence: Synthetic peptide
  XENP018482 vhCDR2
EIRLKSNNYATHYAEPVKG

SEQ ID NO: 15449 - protein, 11 aa, Artificial Sequence
  Description of Artificial Sequence: Synthetic peptide
  XENP018482 vhCDR3
YYGNYGGYFDV

SEQ ID NO: 15450 - protein, 214 aa, Artificial Sequence
  Description of Artificial Sequence: Synthetic polypeptide
  XENP018482 1G6_H1_L1.135_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15451 - protein, 107 aa, Artificial Sequence; identical to SEQ ID NO: 9709
  Description of Artificial Sequence: Synthetic polypeptide
  VL of XENP018482

SEQ ID NO: 15452 - protein, 11 aa, Artificial Sequence
  Description of Artificial Sequence: Synthetic peptide
  XENP018482 vlCDR1
RASQSVSNDVA

SEQ ID NO: 15453 - protein, 7 aa, Artificial Sequence
  Description of Artificial Sequence: Synthetic peptide
  XENP018482 vlCDR2
YASHRYT

SEQ ID NO: 15454 - protein, 9 aa, Artificial Sequence
  Description of Artificial Sequence: Synthetic peptide
  XENP018482 vlCDR3
QQDYFSPRT

SEQ ID NO: 15455 - protein, 451 aa, Artificial Sequence; identical to SEQ ID NO: 11545
  Description of Artificial Sequence: Synthetic polypeptide
  XENP018483 1G6_H1_L1.136_IgG1_PVA_/S267K Heavy Chain

SEQ ID NO: 15456 - protein, 122 aa, Artificial Sequence; identical to SEQ ID NO: 6246
  Description of Artificial Sequence: Synthetic polypeptide
  VH of XENP018483

SEQ ID NO: 15457 - protein, 5 aa, Artificial Sequence
  Description of Artificial Sequence: Synthetic peptide
  XENP018483 vhCDR1
NYWMN

SEQ ID NO: 15458 - protein, 19 aa, Artificial Sequence
  Description of Artificial Sequence: Synthetic peptide
  XENP018483 vhCDR2
EIRLKSNNYATHYAEPVKG

SEQ ID NO: 15459 - protein, 11 aa, Artificial Sequence
  Description of Artificial Sequence: Synthetic peptide
  XENP018483 vhCDR3
YYGNYGGYFDV

SEQ ID NO: 15460 - protein, 214 aa, Artificial Sequence
  Description of Artificial Sequence: Synthetic polypeptide
  XENP018483 1G6_H1_L1.136_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15461 - protein, 107 aa, Artificial Sequence; identical to SEQ ID NO: 9718
  Description of Artificial Sequence: Synthetic polypeptide
  VL of XENP018483

SEQ ID NO: 15462 - protein, 11 aa, Artificial Sequence
  Description of Artificial Sequence: Synthetic peptide
  XENP018483 vlCDR1
RASQSVSNDVA

SEQ ID NO: 15463 - protein, 7 aa, Artificial Sequence
  Description of Artificial Sequence: Synthetic peptide
  XENP018483 vlCDR2
YASHRYT

SEQ ID NO: 15464 - protein, 9 aa, Artificial Sequence
  Description of Artificial Sequence: Synthetic peptide
  XENP018483 vlCDR3
QQDYSTPRT

SEQ ID NO: 15465 - protein, 451 aa, Artificial Sequence; identical to SEQ ID NO: 11545
  Description of Artificial Sequence: Synthetic polypeptide
  XENP018484 1G6_H1_L1.137_IgG1_PVA_/S267K Heavy Chain

SEQ ID NO: 15466 - protein, 122 aa, Artificial Sequence; identical to SEQ ID NO: 6246
  Description of Artificial Sequence: Synthetic polypeptide
  VH of XENP018484

SEQ ID NO: 15467 - protein, 5 aa, Artificial Sequence
  Description of Artificial Sequence: Synthetic peptide
  XENP018484 vhCDR1
NYWMN

SEQ ID NO: 15468 - protein, 19 aa, Artificial Sequence
  Description of Artificial Sequence: Synthetic peptide
  XENP018484 vhCDR2
EIRLKSNNYATHYAEPVKG

SEQ ID NO: 15469 - protein, 11 aa, Artificial Sequence
  Description of Artificial Sequence: Synthetic peptide
  XENP018484 vhCDR3
YYGNYGGYFDV

SEQ ID NO: 15470 - protein, 214 aa, Artificial Sequence
  Description of Artificial Sequence: Synthetic polypeptide
  XENP018484 1G6_H1_L1.137_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15471 - protein, 107 aa, Artificial Sequence; identical to SEQ ID NO: 9727
  Description of Artificial Sequence: Synthetic polypeptide
  VL of XENP018484

SEQ ID NO: 15472 - protein, 11 aa, Artificial Sequence
  Description of Artificial Sequence: Synthetic peptide
  XENP018484 vlCDR1
RASQSVSNDVA

SEQ ID NO: 15473 - protein, 7 aa, Artificial Sequence
  Description of Artificial Sequence: Synthetic peptide
  XENP018484 vlCDR2
YASHRYT

SEQ ID NO: 15474 - protein, 9 aa, Artificial Sequence
  Description of Artificial Sequence: Synthetic peptide
  XENP018484 vlCDR3
QQDYSAPRT

SEQ ID NO: 15475 - protein, 451 aa, Artificial Sequence; identical to SEQ ID NO: 11545
  Description of Artificial Sequence: Synthetic polypeptide
  XENP018485 1G6_H1_L1.138_IgG1_PVA_/S267K Heavy Chain

SEQ ID NO: 15476 - protein, 122 aa, Artificial Sequence; identical to SEQ ID NO: 6246
  Description of Artificial Sequence: Synthetic polypeptide
  VH of XENP018485

SEQ ID NO: 15477 - protein, 5 aa, Artificial Sequence
  Description of Artificial Sequence: Synthetic peptide
  XENP018485 vhCDR1
NYWMN

SEQ ID NO: 15478 - protein, 19 aa, Artificial Sequence
  Description of Artificial Sequence: Synthetic peptide
  XENP018485 vhCDR2
EIRLKSNNYATHYAEPVKG

SEQ ID NO: 15479 - protein, 11 aa, Artificial Sequence
  Description of Artificial Sequence: Synthetic peptide
  XENP018485 vhCDR3
YYGNYGGYFDV

SEQ ID NO: 15480 - protein, 214 aa, Artificial Sequence
  Description of Artificial Sequence: Synthetic polypeptide
  XENP018485 1G6_H1_L1.138_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15481 - protein, 107 aa, Artificial Sequence; identical to SEQ ID NO: 9736
  Description of Artificial Sequence: Synthetic polypeptide
  VL of XENP018485

SEQ ID NO: 15482 - protein, 11 aa, Artificial Sequence
  Description of Artificial Sequence: Synthetic peptide
  XENP018485 vlCDR1
RASQSVSNDVA

SEQ ID NO: 15483 - protein, 7 aa, Artificial Sequence
  Description of Artificial Sequence: Synthetic peptide
  XENP018485 vlCDR2
YASHRYT

SEQ ID NO: 15484 - protein, 9 aa, Artificial Sequence
  Description of Artificial Sequence: Synthetic peptide
  XENP018485 vlCDR3
QQDYSNPRT

SEQ ID NO: 15485 - protein, 451 aa, Artificial Sequence; identical to SEQ ID NO: 11545
  Description of Artificial Sequence: Synthetic polypeptide
  XENP018486 1G6_H1_L1.139_IgG1_PVA_/S267K Heavy Chain

SEQ ID NO: 15486 - protein, 122 aa, Artificial Sequence; identical to SEQ ID NO: 6246
  Description of Artificial Sequence: Synthetic polypeptide
  VH of XENP018486

SEQ ID NO: 15487 - protein, 5 aa, Artificial Sequence
  Description of Artificial Sequence: Synthetic peptide
  XENP018486 vhCDR1
NYWMN

SEQ ID NO: 15488 - protein, 19 aa, Artificial Sequence
  Description of Artificial Sequence: Synthetic peptide
  XENP018486 vhCDR2
EIRLKSNNYATHYAEPVKG

SEQ ID NO: 15489 - protein, 11 aa, Artificial Sequence
  Description of Artificial Sequence: Synthetic peptide
  XENP018486 vhCDR3
YYGNYGGYFDV

SEQ ID NO: 15490 - protein, 214 aa, Artificial Sequence
  Description of Artificial Sequence: Synthetic polypeptide
  XENP018486 1G6_H1_L1.139_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15491 - protein, 107 aa, Artificial Sequence; identical to SEQ ID NO: 9745
  Description of Artificial Sequence: Synthetic polypeptide
  VL of XENP018486

SEQ ID NO: 15492 - protein, 11 aa, Artificial Sequence
  Description of Artificial Sequence: Synthetic peptide
  XENP018486 vlCDR1
RASQSVSNDVA

SEQ ID NO: 15493 - protein, 7 aa, Artificial Sequence
  Description of Artificial Sequence: Synthetic peptide
  XENP018486 vlCDR2
YASHRYT

SEQ ID NO: 15494 - protein, 9 aa, Artificial Sequence
  Description of Artificial Sequence: Synthetic peptide
  XENP018486 vlCDR3
QQDYSGPRT

SEQ ID NO: 15495 - protein, 451 aa, Artificial Sequence; identical to SEQ ID NO: 11545
  Description of Artificial Sequence: Synthetic polypeptide
  XENP018487 1G6_H1_L1.140_IgG1_PVA_/S267K Heavy Chain

SEQ ID NO: 15496 - protein, 122 aa, Artificial Sequence; identical to SEQ ID NO: 6246
  Description of Artificial Sequence: Synthetic polypeptide
  VH of XENP018487

SEQ ID NO: 15497 - protein, 5 aa, Artificial Sequence
  Description of Artificial Sequence: Synthetic peptide
  XENP018487 vhCDR1
NYWMN

SEQ ID NO: 15498 - protein, 19 aa, Artificial Sequence
  Description of Artificial Sequence: Synthetic peptide
  XENP018487 vhCDR2
EIRLKSNNYATHYAEPVKG

SEQ ID NO: 15499 - protein, 11 aa, Artificial Sequence
  Description of Artificial Sequence: Synthetic peptide
  XENP018487 vhCDR3
YYGNYGGYFDV

SEQ ID NO: 15500 - protein, 214 aa, Artificial Sequence
  Description of Artificial Sequence: Synthetic polypeptide
  XENP018487 1G6_H1_L1.140_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15501 - protein, 107 aa, Artificial Sequence; identical to SEQ ID NO: 9754
  Description of Artificial Sequence: Synthetic polypeptide
  VL of XENP018487

SEQ ID NO: 15502 - protein, 11 aa, Artificial Sequence
  Description of Artificial Sequence: Synthetic peptide
  XENP018487 vlCDR1
RASQSVSNDVA

SEQ ID NO: 15503 - protein, 7 aa, Artificial Sequence
  Description of Artificial Sequence: Synthetic peptide
  XENP018487 vlCDR2
YASHRYT

SEQ ID NO: 15504 - protein, 9 aa, Artificial Sequence
  Description of Artificial Sequence: Synthetic peptide
  XENP018487 vlCDR3
QQDYSVPRT

SEQ ID NO: 15505 - protein, 451 aa, Artificial Sequence; identical to SEQ ID NO: 11545
  Description of Artificial Sequence: Synthetic polypeptide
  XENP018488 1G6_H1_L1.141_IgG1_PVA_/S267K Heavy Chain

SEQ ID NO: 15506 - protein, 122 aa, Artificial Sequence; identical to SEQ ID NO: 6246
  Description of Artificial Sequence: Synthetic polypeptide
  VH of XENP018488

SEQ ID NO: 15507 - protein, 5 aa, Artificial Sequence
  Description of Artificial Sequence: Synthetic peptide
  XENP018488 vhCDR1
NYWMN

SEQ ID NO: 15508 - protein, 19 aa, Artificial Sequence
  Description of Artificial Sequence: Synthetic peptide
  XENP018488 vhCDR2
EIRLKSNNYATHYAEPVKG

SEQ ID NO: 15509 - protein, 11 aa, Artificial Sequence
  Description of Artificial Sequence: Synthetic peptide
  XENP018488 vhCDR3
YYGNYGGYFDV

SEQ ID NO: 15510 - protein, 214 aa, Artificial Sequence
  Description of Artificial Sequence: Synthetic polypeptide
  XENP018488 1G6_H1_L1.141_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15511 - protein, 107 aa, Artificial Sequence; identical to SEQ ID NO: 9763
  Description of Artificial Sequence: Synthetic polypeptide
  VL of XENP018488

SEQ ID NO: 15512 - protein, 11 aa, Artificial Sequence
  Description of Artificial Sequence: Synthetic peptide
  XENP018488 vlCDR1
RASQSVSNDVA

SEQ ID NO: 15513 - protein, 7 aa, Artificial Sequence
  Description of Artificial Sequence: Synthetic peptide
  XENP018488 vlCDR2
YASHRYT

SEQ ID NO: 15514 - protein, 9 aa, Artificial Sequence
  Description of Artificial Sequence: Synthetic peptide
  XENP018488 vlCDR3
QQDYSHPRT

SEQ ID NO: 15515 - protein, 451 aa, Artificial Sequence; identical to SEQ ID NO: 11545
  Description of Artificial Sequence: Synthetic polypeptide
  XENP018489 1G6_H1_L1.142_IgG1_PVA_/S267K Heavy Chain

SEQ ID NO: 15516 - protein, 122 aa, Artificial Sequence; identical to SEQ ID NO: 6246
  Description of Artificial Sequence: Synthetic polypeptide
  VH of XENP018489

SEQ ID NO: 15517 - protein, 5 aa, Artificial Sequence
  Description of Artificial Sequence: Synthetic peptide
  XENP018489 vhCDR1
NYWMN

SEQ ID NO: 15518 - protein, 19 aa, Artificial Sequence
  Description of Artificial Sequence: Synthetic peptide
  XENP018489 vhCDR2
EIRLKSNNYATHYAEPVKG

SEQ ID NO: 15519 - protein, 11 aa, Artificial Sequence
  Description of Artificial Sequence: Synthetic peptide
  XENP018489 vhCDR3
YYGNYGGYFDV

SEQ ID NO: 15520 - protein, 214 aa, Artificial Sequence
  Description of Artificial Sequence: Synthetic polypeptide
  XENP018489 1G6_H1_L1.142_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15521 - protein, 107 aa, Artificial Sequence; identical to SEQ ID NO: 9772
  Description of Artificial Sequence: Synthetic polypeptide
  VL of XENP018489

SEQ ID NO: 15522 - protein, 11 aa, Artificial Sequence
  Description of Artificial Sequence: Synthetic peptide
  XENP018489 vlCDR1
RASQSVSNDVA

SEQ ID NO: 15523 - protein, 7 aa, Artificial Sequence
  Description of Artificial Sequence: Synthetic peptide
  XENP018489 vlCDR2
YASHRYT

SEQ ID NO: 15524 - protein, 9 aa, Artificial Sequence
  Description of Artificial Sequence: Synthetic peptide
  XENP018489 vlCDR3
QQDYSDPRT

SEQ ID NO: 15525 - protein, 451 aa, Artificial Sequence; identical to SEQ ID NO: 11545
  Description of Artificial Sequence: Synthetic polypeptide
  XENP018490 1G6_H1_L1.143_IgG1_PVA_/S267K Heavy Chain

SEQ ID NO: 15526 - protein, 122 aa, Artificial Sequence; identical to SEQ ID NO: 6246
  Description of Artificial Sequence: Synthetic polypeptide
  VH of XENP018490

SEQ ID NO: 15527 - protein, 5 aa, Artificial Sequence
  Description of Artificial Sequence: Synthetic peptide
  XENP018490 vhCDR1
NYWMN

SEQ ID NO: 15528 - protein, 19 aa, Artificial Sequence
  Description of Artificial Sequence: Synthetic peptide
  XENP018490 vhCDR2
EIRLKSNNYATHYAEPVKG

SEQ ID NO: 15529 - protein, 11 aa, Artificial Sequence
  Description of Artificial Sequence: Synthetic peptide
  XENP018490 vhCDR3
YYGNYGGYFDV

SEQ ID NO: 15530 - protein, 214 aa, Artificial Sequence
  Description of Artificial Sequence: Synthetic polypeptide
  XENP018490 1G6_H1_L1.143_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15531 - protein, 107 aa, Artificial Sequence; identical to SEQ ID NO: 9781
  Description of Artificial Sequence: Synthetic polypeptide
  VL of XENP018490

SEQ ID NO: 15532 - protein, 11 aa, Artificial Sequence
  Description of Artificial Sequence: Synthetic peptide
  XENP018490 vlCDR1
RASQSVSNDVA

SEQ ID NO: 15533 - protein, 7 aa, Artificial Sequence
  Description of Artificial Sequence: Synthetic peptide
  XENP018490 vlCDR2
YASHRYT

SEQ ID NO: 15534 - protein, 9 aa, Artificial Sequence
  Description of Artificial Sequence: Synthetic peptide
  XENP018490 vlCDR3
QQDYSKPRT

SEQ ID NO: 15535 - protein, 451 aa, Artificial Sequence; identical to SEQ ID NO: 11545
  Description of Artificial Sequence: Synthetic polypeptide
  XENP018491 1G6_H1_L1.144_IgG1_PVA_/S267K Heavy Chain

SEQ ID NO: 15536 - protein, 122 aa, Artificial Sequence; identical to SEQ ID NO: 6246
  Description of Artificial Sequence: Synthetic polypeptide
  VH of XENP018491

SEQ ID NO: 15537 - protein, 5 aa, Artificial Sequence
  Description of Artificial Sequence: Synthetic peptide
  XENP018491 vhCDR1
NYWMN

SEQ ID NO: 15538 - protein, 19 aa, Artificial Sequence
  Description of Artificial Sequence: Synthetic peptide
  XENP018491 vhCDR2
EIRLKSNNYATHYAEPVKG

SEQ ID NO: 15539 - protein, 11 aa, Artificial Sequence
  Description of Artificial Sequence: Synthetic peptide
  XENP018491 vhCDR3
YYGNYGGYFDV

SEQ ID NO: 15540 - protein, 214 aa, Artificial Sequence
  Description of Artificial Sequence: Synthetic polypeptide
  XENP018491 1G6_H1_L1.144_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15541 - protein, 107 aa, Artificial Sequence; identical to SEQ ID NO: 9790
  Description of Artificial Sequence: Synthetic polypeptide
  VL of XENP018491

SEQ ID NO: 15542 - protein, 11 aa, Artificial Sequence
  Description of Artificial Sequence: Synthetic peptide
  XENP018491 vlCDR1
RASQSVSNDVA

SEQ ID NO: 15543 - protein, 7 aa, Artificial Sequence
  Description of Artificial Sequence: Synthetic peptide
  XENP018491 vlCDR2
YASHRYT

SEQ ID NO: 15544 - protein, 9 aa, Artificial Sequence
  Description of Artificial Sequence: Synthetic peptide
  XENP018491 vlCDR3
QQDYSFPRT

SEQ ID NO: 15545 - protein, 451 aa, Artificial Sequence; identical to SEQ ID NO: 11545
  Description of Artificial Sequence: Synthetic polypeptide
  XENP018492 1G6_H1_L1.145_IgG1_PVA_/S267K Heavy Chain

SEQ ID NO: 15546 - protein, 122 aa, Artificial Sequence; identical to SEQ ID NO: 6246
  Description of Artificial Sequence: Synthetic polypeptide
  VH of XENP018492

SEQ ID NO: 15547 - protein, 5 aa, Artificial Sequence
  Description of Artificial Sequence: Synthetic peptide
  XENP018492 vhCDR1
NYWMN

SEQ ID NO: 15548 - protein, 19 aa, Artificial Sequence
  Description of Artificial Sequence: Synthetic peptide
  XENP018492 vhCDR2
EIRLKSNNYATHYAEPVKG

SEQ ID NO: 15549 - protein, 11 aa, Artificial Sequence
  Description of Artificial Sequence: Synthetic peptide
  XENP018492 vhCDR3
YYGNYGGYFDV

SEQ ID NO: 15550 - protein, 214 aa, Artificial Sequence
  Description of Artificial Sequence: Synthetic polypeptide
  XENP018492 1G6_H1_L1.145_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15551 - protein, 107 aa, Artificial Sequence; identical to SEQ ID NO: 9799
  Description of Artificial Sequence: Synthetic polypeptide
  VL of XENP018492

SEQ ID NO: 15552 - protein, 11 aa, Artificial Sequence
  Description of Artificial Sequence: Synthetic peptide
  XENP018492 vlCDR1
RASQSVSNDVA

SEQ ID NO: 15553 - protein, 7 aa, Artificial Sequence
  Description of Artificial Sequence: Synthetic peptide
  XENP018492 vlCDR2
YASHRYT

SEQ ID NO: 15554 - protein, 9 aa, Artificial Sequence
  Description of Artificial Sequence: Synthetic peptide
  XENP018492 vlCDR3
QQDYSSPRT

SEQ ID NO: 15555 - protein, 451 aa, Artificial Sequence
  Description of Artificial Sequence: Synthetic polypeptide
  XENP018892 1G6_H0L0_IgG1_PVA_/S267K Heavy Chain
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15556 - protein, 122 aa, Artificial Sequence; identical to SEQ ID NO: 9807
  Description of Artificial Sequence: Synthetic polypeptide
  VH of XENP018892

SEQ ID NO: 15557 - protein, 5 aa, Artificial Sequence
  Description of Artificial Sequence: Synthetic peptide
  XENP018892 vhCDR1
NYWMN

SEQ ID NO: 15558 - protein, 19 aa, Artificial Sequence
  Description of Artificial Sequence: Synthetic peptide
  XENP018892 vhCDR2
EIRLKSNNYATHYAESVKG

SEQ ID NO: 15559 - protein, 11 aa, Artificial Sequence
  Description of Artificial Sequence: Synthetic peptide
  XENP018892 vhCDR3
YYGNYGGYFDV

SEQ ID NO: 15560 - protein, 214 aa, Artificial Sequence
  Description of Artificial Sequence: Synthetic polypeptide
  XENP018892 1G6_H0L0_IgG1_PVA_/S267K Light Chain
SIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15561 - protein, 107 aa, Artificial Sequence; identical to SEQ ID NO: 9808
  Description of Artificial Sequence: Synthetic polypeptide
  VL of XENP018892

SEQ ID NO: 15562 - protein, 11 aa, Artificial Sequence
  Description of Artificial Sequence: Synthetic peptide
  XENP018892 vlCDR1
KASQSVSNDVA

SEQ ID NO: 15563 - protein, 7 aa, Artificial Sequence
  Description of Artificial Sequence: Synthetic peptide
  XENP018892 vlCDR2
YASHRYT

SEQ ID NO: 15564 - protein, 9 aa, Artificial Sequence
  Description of Artificial Sequence: Synthetic peptide
  XENP018892 vlCDR3
QQDYSSPRT

SEQ ID NO: 15565 - protein, 449 aa, Artificial Sequence
  Description of Artificial Sequence: Synthetic polypeptide
  XENP018893 4C11_H0L0_IgG1_PVA_/S267K Heavy Chain
EIHLQQSGTVLAKPGASVKMSCTASGYTFTSYWMHWVKQRPGQGLEWIGAIYPGNSDTSYNQKFKGKAKLTAVTSASTAYMELSSLTNEDSAVYYCTNLYYGSSFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15566 - protein, 120 aa, Artificial Sequence
  Description of Artificial Sequence: Synthetic polypeptide
  VH of XENP018893
EIHLQQSGTVLAKPGASVKMSCTASGYTFTSYWMHWVKQRPGQGLEWIGAIYPGNSDTSYNQKFKGKAKLTAVTSASTAYMELSSLTNEDSAVYYCTNLYYGSSFAMDYWGQGTSVTVSS

SEQ ID NO: 15567 - protein, 5 aa, Artificial Sequence
  Description of Artificial Sequence: Synthetic peptide
  XENP018893 vhCDR1
SYWMH

SEQ ID NO: 15568 - protein, 17 aa, Artificial Sequence
  Description of Artificial Sequence: Synthetic peptide
  XENP018893 vhCDR2
AIYPGNSDTSYNQKFKG

SEQ ID NO: 15569 - protein, 11 aa, Artificial Sequence
  Description of Artificial Sequence: Synthetic peptide
  XENP018893 vhCDR3
LYYGSSFAMDY

SEQ ID NO: 15570 - protein, 214 aa, Artificial Sequence
  Description of Artificial Sequence: Synthetic polypeptide
  XENP018893 4C11_H0L0_IgG1_PVA_/S267K Light Chain
DIKMTQSPSSIYASLGERVTVTCRASQDINTYLSWFQQLPGKSPKTLIYRANRLVDGVPSRFSGSGSGQDYSLTISSLEYEDMGIYYCLHYDDFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15571 - protein, 107 aa, Artificial Sequence
  Description of Artificial Sequence: Synthetic polypeptide
  VL of XENP018893
DIKMTQSPSSIYASLGERVTVTCRASQDINTYLSWFQQLPGKSPKTLIYRANRLVDGVPSRFSGSGSGQDYSLTISSLEYEDMGIYYCLHYDDFPYTFGGGTKLEIK

SEQ ID NO: 15572 - protein, 11 aa, Artificial Sequence
  Description of Artificial Sequence: Synthetic peptide
  XENP018893 vlCDR1
RASQDINTYLS

SEQ ID NO: 15573 - protein, 7 aa, Artificial Sequence
  Description of Artificial Sequence: Synthetic peptide
  XENP018893 vlCDR2
RANRLVD

SEQ ID NO: 15574 - protein, 9 aa, Artificial Sequence
  Description of Artificial Sequence: Synthetic peptide
  XENP018893 vlCDR3
LHYDDFPYT

SEQ ID NO: 15575 - protein, 446 aa, Artificial Sequence
  Description of Artificial Sequence: Synthetic polypeptide
  XENP018894 6A3_H0L0_IgG1_PVA_/S267K Heavy Chain
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15576 - protein, 117 aa, Artificial Sequence; identical to SEQ ID NO: 9825
  Description of Artificial Sequence: Synthetic polypeptide
  VH of XENP018894

SEQ ID NO: 15577 - protein, 5 aa, Artificial Sequence
  Description of Artificial Sequence: Synthetic peptide
  XENP018894 vhCDR1
SYGMS

SEQ ID NO: 15578 - protein, 17 aa, Artificial Sequence
  Description of Artificial Sequence: Synthetic peptide
  XENP018894 vhCDR2
TISGGGRYTYYPDSVKG

SEQ ID NO: 15579 - protein, 8 aa, Artificial Sequence
  Description of Artificial Sequence: Synthetic peptide
  XENP018894 vhCDR3
YYDSSFDY

SEQ ID NO: 15580 - protein, 214 aa, Artificial Sequence
  Description of Artificial Sequence: Synthetic polypeptide
  XENP018894 6A3_H0L0_IgG1_PVA_/S267K Light Chain
DIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15581 - protein, 107 aa, Artificial Sequence; identical to SEQ ID NO: 9826
  Description of Artificial Sequence: Synthetic polypeptide
  VL of XENP018894

SEQ ID NO: 15582 - protein, 11 aa, Artificial Sequence
  Description of Artificial Sequence: Synthetic peptide
  XENP018894 vlCDR1
KASQDVGTAVA

SEQ ID NO: 15583 - protein, 7 aa, Artificial Sequence
  Description of Artificial Sequence: Synthetic peptide
  XENP018894 vlCDR2
WASTRHT

SEQ ID NO: 15584 - protein, 9 aa, Artificial Sequence
  Description of Artificial Sequence: Synthetic peptide
  XENP018894 vlCDR3
QHYSIYPWT

SEQ ID NO: 15585 - protein, 451 aa, Artificial Sequence; identical to SEQ ID NO: 12615
  Description of Artificial Sequence: Synthetic polypeptide
  XENP018910 1G6_H1.90_L1.119_IgG1_PVA_/S267K Heavy Chain

SEQ ID NO: 15586 - protein, 122 aa, Artificial Sequence; identical to SEQ ID NO: 7161
  Description of Artificial Sequence: Synthetic polypeptide
  VH of XENP018910

SEQ ID NO: 15587 - protein, 5 aa, Artificial Sequence
  Description of Artificial Sequence: Synthetic peptide
  XENP018910 vhCDR1
NYWMN

SEQ ID NO: 15588 - protein, 19 aa, Artificial Sequence
  Description of Artificial Sequence: Synthetic peptide
  XENP018910 vhCDR2
EIRLYSNNYATHYAEPVKG

SEQ ID NO: 15589 - protein, 11 aa, Artificial Sequence
  Description of Artificial Sequence: Synthetic peptide
  XENP018910 vhCDR3
YYGNYGGYFDV

SEQ ID NO: 15590 - protein, 214 aa, Artificial Sequence; identical to SEQ ID NO: 15290
  Description of Artificial Sequence: Synthetic polypeptide
  XENP018910 1G6_H1.90_L1.119_IgG1_PVA_/S267K Light Chain

SEQ ID NO: 15591 - protein, 107 aa, Artificial Sequence; identical to SEQ ID NO: 9565
  Description of Artificial Sequence: Synthetic polypeptide
  VL of XENP018910

SEQ ID NO: 15592 - protein, 11 aa, Artificial Sequence
  Description of Artificial Sequence: Synthetic peptide
  XENP018910 vlCDR1
RASQSVSNDVA

SEQ ID NO: 15593 - protein, 7 aa, Artificial Sequence
  Description of Artificial Sequence: Synthetic peptide
  XENP018910 vlCDR2
YASHRYT

SEQ ID NO: 15594 - protein, 9 aa, Artificial Sequence
  Description of Artificial Sequence: Synthetic peptide
  XENP018910 vlCDR3
QQDWSSPRT

SEQ ID NO: 15595 - protein, 451 aa, Artificial Sequence; identical to SEQ ID NO: 12615
  Description of Artificial Sequence: Synthetic polypeptide
  XENP018911 1G6_H1.90_L1.23_IgG1_PVA_/S267K Heavy Chain

SEQ ID NO: 15596 - protein, 122 aa, Artificial Sequence; identical to SEQ ID NO: 7161
  Description of Artificial Sequence: Synthetic polypeptide
  VH of XENP018911

SEQ ID NO: 15597 - protein, 5 aa, Artificial Sequence
  Description of Artificial Sequence: Synthetic peptide
  XENP018911 vhCDR1
NYWMN

SEQ ID NO: 15598 - protein, 19 aa, Artificial Sequence
  Description of Artificial Sequence: Synthetic peptide
  XENP018911 vhCDR2
EIRLYSNNYATHYAEPVKG

SEQ ID NO: 15599 - protein, 11 aa, Artificial Sequence
  Description of Artificial Sequence: Synthetic peptide
  XENP018911 vhCDR3
YYGNYGGYFDV

SEQ ID NO: 15600 - protein, 214 aa, Artificial Sequence; identical to SEQ ID NO: 14330
  Description of Artificial Sequence: Synthetic polypeptide
  XENP018911 1G6_H1.90_L1.23_IgG1_PVA_/S267K Light Chain

SEQ ID NO: 15601 - protein, 107 aa, Artificial Sequence; identical to SEQ ID NO: 8701
  Description of Artificial Sequence: Synthetic polypeptide
  VL of XENP018911

SEQ ID NO: 15602 - protein, 11 aa, Artificial Sequence
  Description of Artificial Sequence: Synthetic peptide
  XENP018911 vlCDR1
RASQSVGNDVA

SEQ ID NO: 15603 - protein, 7 aa, Artificial Sequence
  Description of Artificial Sequence: Synthetic peptide
  XENP018911 vlCDR2
YASHRYT

SEQ ID NO: 15604 - protein, 9 aa, Artificial Sequence
  Description of Artificial Sequence: Synthetic peptide
  XENP018911 vlCDR3
QQDYSSPRT

SEQ ID NO: 15605 - protein, 451 aa, Artificial Sequence; identical to SEQ ID NO: 12615
  Description of Artificial Sequence: Synthetic polypeptide
  XENP018912 1G6_H1.90_L1.67_IgG1_PVA_/S267K Heavy Chain

SEQ ID NO: 15606 - protein, 122 aa, Artificial Sequence; identical to SEQ ID NO: 7161
  Description of Artificial Sequence: Synthetic polypeptide
  VH of XENP018912

SEQ ID NO: 15607 - protein, 5 aa, Artificial Sequence
  Description of Artificial Sequence: Synthetic peptide
  XENP018912 vhCDR1
NYWMN

SEQ ID NO: 15608 - protein, 19 aa, Artificial Sequence
  Description of Artificial Sequence: Synthetic peptide
  XENP018912 vhCDR2
EIRLYSNNYATHYAEPVKG

SEQ ID NO: 15609 - protein, 11 aa, Artificial Sequence
  Description of Artificial Sequence: Synthetic peptide
  XENP018912 vhCDR3
YYGNYGGYFDV

SEQ ID NO: 15610 - protein, 214 aa, Artificial Sequence; identical to SEQ ID NO: 14770
  Description of Artificial Sequence: Synthetic polypeptide
  XENP018912 1G6_H1.90_L1.67_IgG1_PVA_/S267K Light Chain

SEQ ID NO: 15611 - protein, 107 aa, Artificial Sequence; identical to SEQ ID NO: 9097
  Description of Artificial Sequence: Synthetic polypeptide
  VL of XENP018912

SEQ ID NO: 15612 - protein, 11 aa, Artificial Sequence
  Description of Artificial Sequence: Synthetic peptide
  XENP018912 vlCDR1
RASQSVSNDVA

SEQ ID NO: 15613 - protein, 7 aa, Artificial Sequence
  Description of Artificial Sequence: Synthetic peptide
  XENP018912 vlCDR2
YASWRYT

SEQ ID NO: 15614 - protein, 9 aa, Artificial Sequence
  Description of Artificial Sequence: Synthetic peptide
  XENP018912 vlCDR3
QQDYSSPRT

SEQ ID NO: 15615 - protein, 451 aa, Artificial Sequence; identical to SEQ ID NO: 12615
  Description of Artificial Sequence: Synthetic polypeptide
  XENP018913 1G6_H1.90_L1.94_IgG1_PVA_/S267K Heavy Chain

SEQ ID NO: 15616 - protein, 122 aa, Artificial Sequence; identical to SEQ ID NO: 7161
  Description of Artificial Sequence: Synthetic polypeptide
  VH of XENP018913

SEQ ID NO: 15617 - protein, 5 aa, Artificial Sequence
  Description of Artificial Sequence: Synthetic peptide
  XENP018913 vhCDR1
NYWMN

SEQ ID NO: 15618 - protein, 19 aa, Artificial Sequence
  Description of Artificial Sequence: Synthetic peptide
  XENP018913 vhCDR2
EIRLYSNNYATHYAEPVKG

SEQ ID NO: 15619 - protein, 11 aa, Artificial Sequence
  Description of Artificial Sequence: Synthetic peptide
  XENP018913 vhCDR3
YYGNYGGYFDV

SEQ ID NO: 15620 - protein, 214 aa, Artificial Sequence; identical to SEQ ID NO: 15040
  Description of Artificial Sequence: Synthetic polypeptide
  XENP018913 1G6_H1.90_L1.94_IgG1_PVA_/S267K Light Chain

SEQ ID NO: 15621 - protein, 107 aa, Artificial Sequence; identical to SEQ ID NO: 9340
  Description of Artificial Sequence: Synthetic polypeptide
  VL of XENP018913

SEQ ID NO: 15622 - protein, 11 aa, Artificial Sequence
  Description of Artificial Sequence: Synthetic peptide
  XENP018913 vlCDR1
RASQSVSNDVA

SEQ ID NO: 15623 - protein, 7 aa, Artificial Sequence
  Description of Artificial Sequence: Synthetic peptide
  XENP018913 vlCDR2
YASHRYT

SEQ ID NO: 15624 - protein, 9 aa, Artificial Sequence
  Description of Artificial Sequence: Synthetic peptide
  XENP018913 vlCDR3
QQDYSSPRT

SEQ ID NO: 15625 - protein, 451 aa, Artificial Sequence; identical to SEQ ID NO: 12615
  Description of Artificial Sequence: Synthetic polypeptide
  XENP018914 1G6_H1.90_L1.116_IgG1_PVA_/S267K Heavy Chain

SEQ ID NO: 15626 - protein, 122 aa, Artificial Sequence; identical to SEQ ID NO: 7161
  Description of Artificial Sequence: Synthetic polypeptide
  VH of XENP018914

SEQ ID NO: 15627 - protein, 5 aa, Artificial Sequence
  Description of Artificial Sequence: Synthetic peptide
  XENP018914 vhCDR1
NYWMN

SEQ ID NO: 15628 - protein, 19 aa, Artificial Sequence
  Description of Artificial Sequence: Synthetic peptide
  XENP018914 vhCDR2
EIRLYSNNYATHYAEPVKG

SEQ ID NO: 15629 - protein, 11 aa, Artificial Sequence
  Description of Artificial Sequence: Synthetic peptide
  XENP018914 vhCDR3
YYGNYGGYFDV

SEQ ID NO: 15630 - protein, 214 aa, Artificial Sequence; identical to SEQ ID NO: 15260
  Description of Artificial Sequence: Synthetic polypeptide
  XENP018914 1G6_H1.90_L1.116_IgG1_PVA_/S267K Light Chain

SEQ ID NO: 15631 - protein, 107 aa, Artificial Sequence; identical to SEQ ID NO: 9538
  Description of Artificial Sequence: Synthetic polypeptide
  VL of XENP018914

SEQ ID NO: 15632 - protein, 11 aa, Artificial Sequence
  Description of Artificial Sequence: Synthetic peptide
  XENP018914 vlCDR1
RASQSVSNDVA

SEQ ID NO: 15633 - protein, 7 aa, Artificial Sequence
  Description of Artificial Sequence: Synthetic peptide
  XENP018914 vlCDR2
YASHRYT

SEQ ID NO: 15634 - protein, 9 aa, Artificial Sequence
  Description of Artificial Sequence: Synthetic peptide
  XENP018914 vlCDR3
QQDFSSPRT

SEQ ID NO: 15635 - protein, 451 aa, Artificial Sequence; identical to SEQ ID NO: 13265
  Description of Artificial Sequence: Synthetic polypeptide
  XENP018915 1G6_H1.155_L1.119_IgG1_PVA_/S267K Heavy Chain

SEQ ID NO: 15636 - protein, 122 aa, Artificial Sequence; identical to SEQ ID NO: 7746
  Description of Artificial Sequence: Synthetic polypeptide
  VH of XENP018915

SEQ ID NO: 15637 - protein, 5 aa, Artificial Sequence
  Description of Artificial Sequence: Synthetic peptide
  XENP018915 vhCDR1
NYWMN

SEQ ID NO: 15638 - protein, 19 aa, Artificial Sequence
  Description of Artificial Sequence: Synthetic peptide
  XENP018915 vhCDR2
EIRLKSNNYATHYAEPVKG

SEQ ID NO: 15639 - protein, 11 aa, Artificial Sequence
  Description of Artificial Sequence: Synthetic peptide
  XENP018915 vhCDR3
YYGNYGGYFDV

SEQ ID NO: 15640 - protein, 214 aa, Artificial Sequence; identical to SEQ ID NO: 15290
  Description of Artificial Sequence: Synthetic polypeptide
  XENP018915 1G6_H1.155_L1.119_IgG1_PVA_/S267K Light Chain

SEQ ID NO: 15641 - protein, 107 aa, Artificial Sequence; identical to SEQ ID NO: 9565
  Description of Artificial Sequence: Synthetic polypeptide
  VL of XENP018915

SEQ ID NO: 15642 - protein, 11 aa, Artificial Sequence
  Description of Artificial Sequence: Synthetic peptide
  XENP018915 vlCDR1
RASQSVSNDVA

SEQ ID NO: 15643 - protein, 7 aa, Artificial Sequence
  Description of Artificial Sequence: Synthetic peptide
  XENP018915 vlCDR2
YASHRYT

SEQ ID NO: 15644 - protein, 9 aa, Artificial Sequence
  Description of Artificial Sequence: Synthetic peptide
  XENP018915 vlCDR3
QQDWSSPRT

SEQ ID NO: 15645 - protein, 451 aa, Artificial Sequence
  Description of Artificial Sequence: Synthetic polypeptide
  XENP018980 1G6_H1.239_L1_IgG1_PVA_/S267K Heavy Chain
EVQLKESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15646 - protein, 122 aa, Artificial Sequence; identical to SEQ ID NO: 10005
  Description of Artificial Sequence: Synthetic polypeptide
  VH of XENP018980

SEQ ID NO: 15647 - protein, 5 aa, Artificial Sequence
  Description of Artificial Sequence: Synthetic peptide
  XENP018980 vhCDR1
NYWMN

SEQ ID NO: 15648 - protein, 19 aa, Artificial Sequence
  Description of Artificial Sequence: Synthetic peptide
  XENP018980 vhCDR2
EIRLKSNNYATHYAEPVKG

SEQ ID NO: 15649 - protein, 11 aa, Artificial Sequence
  Description of Artificial Sequence: Synthetic peptide
  XENP018980 vhCDR3
YYGNYGGYFDV

SEQ ID NO: 15650 - protein, 214 aa, Artificial Sequence; identical to SEQ ID NO: 11550
  Description of Artificial Sequence: Synthetic polypeptide
  XENP018980 1G6_H1.239_L1_IgG1_PVA_/S267K Light Chain

SEQ ID NO: 15651 - protein, 107 aa, Artificial Sequence; identical to SEQ ID NO: 6247
  Description of Artificial Sequence: Synthetic polypeptide
  VL of XENP018980

SEQ ID NO: 15652 - protein, 11 aa, Artificial Sequence
  Description of Artificial Sequence: Synthetic peptide
  XENP018980 vlCDR1
RASQSVSNDVA

SEQ ID NO: 15653 - protein, 7 aa, Artificial Sequence
  Description of Artificial Sequence: Synthetic peptide
  XENP018980 vlCDR2
YASHRYT

SEQ ID NO: 15654 - protein, 9 aa, Artificial Sequence
  Description of Artificial Sequence: Synthetic peptide
  XENP018980 vlCDR3
QQDYSSPRT

SEQ ID NO: 15655 - protein, 451 aa, Artificial Sequence
  Description of Artificial Sequence: Synthetic polypeptide
  XENP018981 1G6_H1.240_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15656 - protein, 122 aa, Artificial Sequence; identical to SEQ ID NO: 10014
  Description of Artificial Sequence: Synthetic polypeptide
  VH of XENP018981

SEQ ID NO: 15657 - protein, 5 aa, Artificial Sequence
  Description of Artificial Sequence: Synthetic peptide
  XENP018981 vhCDR1
NYWMN

SEQ ID NO: 15658 - protein, 19 aa, Artificial Sequence
  Description of Artificial Sequence: Synthetic peptide
  XENP018981 vhCDR2
EIRLKSNNYATHYAEPVKG

SEQ ID NO: 15659 - protein, 11 aa, Artificial Sequence
  Description of Artificial Sequence: Synthetic peptide
  XENP018981 vhCDR3
YYGNYGGYFDV

SEQ ID NO: 15660 - protein, 214 aa, Artificial Sequence; identical to SEQ ID NO: 11550
  Description of Artificial Sequence: Synthetic polypeptide
  XENP018981 1G6_H1.240_L1_IgG1_PVA_/S267K Light Chain

SEQ ID NO: 15661 - protein, 107 aa, Artificial Sequence; identical to SEQ ID NO: 6247
  Description of Artificial Sequence: Synthetic polypeptide
  VL of XENP018981

SEQ ID NO: 15662 - protein, 11 aa, Artificial Sequence
  Description of Artificial Sequence: Synthetic peptide
  XENP018981 vlCDR1
RASQSVSNDVA

SEQ ID NO: 15663 - protein, 7 aa, Artificial Sequence
  Description of Artificial Sequence: Synthetic peptide
  XENP018981 vlCDR2
YASHRYT

SEQ ID NO: 15664 - protein, 9 aa, Artificial Sequence
  Description of Artificial Sequence: Synthetic peptide
  XENP018981 vlCDR3
QQDYSSPRT

SEQ ID NO: 15665 - protein, 451 aa, Artificial Sequence
  Description of Artificial Sequence: Synthetic polypeptide
  XENP018982 1G6_H1.241_L1_IgG1_PVA_/S267K Heavy Chain
EVQLVESGGGLVKPGGSLRLTCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15666 - protein, 122 aa, Artificial Sequence; identical to SEQ ID NO: 10023
  Description of Artificial Sequence: Synthetic polypeptide
  VH of XENP018982

SEQ ID NO: 15667 - protein, 5 aa, Artificial Sequence
  Description of Artificial Sequence: Synthetic peptide
  XENP018982 vhCDR1
NYWMN

SEQ ID NO: 15668 - protein, 19 aa, Artificial Sequence
  Description of Artificial Sequence: Synthetic peptide
  XENP018982 vhCDR2
EIRLKSNNYATHYAEPVKG

SEQ ID NO: 15669 - protein, 11 aa, Artificial Sequence
  Description of Artificial Sequence: Synthetic peptide
  XENP018982 vhCDR3
YYGNYGGYFDV

SEQ ID NO: 15670 - protein, 214 aa, Artificial Sequence; identical to SEQ ID NO: 11550
  Description of Artificial Sequence: Synthetic polypeptide
  XENP018982 1G6_H1.241_L1_IgG1_PVA_/S267K Light Chain

SEQ ID NO: 15671 - protein, 107 aa, Artificial Sequence; identical to SEQ ID NO: 6247
  Description of Artificial Sequence: Synthetic polypeptide
  VL of XENP018982

SEQ ID NO: 15672 - protein, 11 aa, Artificial Sequence
  Description of Artificial Sequence: Synthetic peptide
  XENP018982 vlCDR1
RASQSVSNDVA

SEQ ID NO: 15673 - protein, 7 aa, Artificial Sequence
  Description of Artificial Sequence: Synthetic peptide
  XENP018982 vlCDR2
YASHRYT

SEQ ID NO: 15674 - protein, 9 aa, Artificial Sequence
  Description of Artificial Sequence: Synthetic peptide
  XENP018982 vlCDR3
QQDYSSPRT

SEQ ID NO: 15675 - protein, 451 aa, Artificial Sequence
  Description of Artificial Sequence: Synthetic polypeptide
  XENP018983 1G6_H1.242_L1_IgG1_PVA_/S267K Heavy Chain
EVQLVESGGGLVKPGGSLRLVCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15676 - protein, 122 aa, Artificial Sequence; identical to SEQ ID NO: 10032
  Description of Artificial Sequence: Synthetic polypeptide
  VH of XENP018983

SEQ ID NO: 15677 - protein, 5 aa, Artificial Sequence
  Description of Artificial Sequence: Synthetic peptide
  XENP018983 vhCDR1
NYWMN

SEQ ID NO: 15678 - protein, 19 aa, Artificial Sequence
  Description of Artificial Sequence: Synthetic peptide
  XENP018983 vhCDR2
EIRLKSNNYATHYAEPVKG

SEQ ID NO: 15679 - protein, 11 aa, Artificial Sequence
  Description of Artificial Sequence: Synthetic peptide
  XENP018983 vhCDR3
YYGNYGGYFDV

SEQ ID NO: 15680 - protein, 214 aa, Artificial Sequence; identical to SEQ ID NO: 11550
  Description of Artificial Sequence: Synthetic polypeptide
  XENP018983 1G6_H1.242_L1_IgG1_PVA_/S267K Light Chain

SEQ ID NO: 15681 - protein, 107 aa, Artificial Sequence; identical to SEQ ID NO: 6247
  Description of Artificial Sequence: Synthetic polypeptide
  VL of XENP018983

SEQ ID NO: 15682 - protein, 11 aa, Artificial Sequence
  Description of Artificial Sequence: Synthetic peptide
  XENP018983 vlCDR1
RASQSVSNDVA

SEQ ID NO: 15683 - protein, 7 aa, Artificial Sequence
  Description of Artificial Sequence: Synthetic peptide
  XENP018983 vlCDR2
YASHRYT

SEQ ID NO: 15684 - protein, 9 aa, Artificial Sequence
  Description of Artificial Sequence: Synthetic peptide
  XENP018983 vlCDR3
QQDYSSPRT

SEQ ID NO: 15685 - protein, 451 aa, Artificial Sequence
  Description of Artificial Sequence: Synthetic polypeptide
  XENP018984 1G6_H1.243_L1_IgG1_PVA_/S267K Heavy Chain
EVQLVESGGGLVKPGGSLRLSCAASGFTLSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15686 - protein, 122 aa, Artificial Sequence; identical to SEQ ID NO: 10041
  Description of Artificial Sequence: Synthetic polypeptide
  VH of XENP018984

SEQ ID NO: 15687 - protein, 5 aa, Artificial Sequence
  Description of Artificial Sequence: Synthetic peptide
  XENP018984 vhCDR1
NYWMN

SEQ ID NO: 15688 - protein, 19 aa, Artificial Sequence
  Description of Artificial Sequence: Synthetic peptide
  XENP018984 vhCDR2
EIRLKSNNYATHYAEPVKG

SEQ ID NO: 15689 - protein, 11 aa, Artificial Sequence
  Description of Artificial Sequence: Synthetic peptide
  XENP018984 vhCDR3
YYGNYGGYFDV

SEQ ID NO: 15690 - protein, 214 aa, Artificial Sequence; identical to SEQ ID NO: 11550
  Description of Artificial Sequence: Synthetic polypeptide
  XENP018984 1G6_H1.243_L1_IgG1_PVA_/S267K Light Chain

SEQ ID NO: 15691 - protein, 107 aa, Artificial Sequence; identical to SEQ ID NO: 6247
  Description of Artificial Sequence: Synthetic polypeptide
  VL of XENP018984

SEQ ID NO: 15692 - protein, 11 aa, Artificial Sequence
  Description of Artificial Sequence: Synthetic peptide
  XENP018984 vlCDR1
RASQSVSNDVA

SEQ ID NO: 15693 - protein, 7 aa, Artificial Sequence
  Description of Artificial Sequence: Synthetic peptide
  XENP018984 vlCDR2
YASHRYT

SEQ ID NO: 15694 - protein, 9 aa, Artificial Sequence
  Description of Artificial Sequence: Synthetic peptide
  XENP018984 vlCDR3
QQDYSSPRT

SEQ ID NO: 15695 - protein, 451 aa, Artificial Sequence
  Description of Artificial Sequence: Synthetic polypeptide
  XENP018985 1G6_H1.244_L1_IgG1_PVA_/S267K Heavy Chain
EVQLVESGGGLVKPGGSLRLSCAASGFTFSNYWMNWVRQAPGKGLQWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15696 - protein, 122 aa, Artificial Sequence; identical to SEQ ID NO: 10050
  Description of Artificial Sequence: Synthetic polypeptide
  VH of XENP018985

SEQ ID NO: 15697 - protein, 5 aa, Artificial Sequence
  Description of Artificial Sequence: Synthetic peptide
  XENP018985 vhCDR1
NYWMN

SEQ ID NO: 15698 - protein, 19 aa, Artificial Sequence
  Description of Artificial Sequence: Synthetic peptide
  XENP018985 vhCDR2
EIRLKSNNYATHYAEPVKG

SEQ ID NO: 15699 - protein, 11 aa, Artificial Sequence
  Description of Artificial Sequence: Synthetic peptide
  XENP018985 vhCDR3
YYGNYGGYFDV

SEQ ID NO: 15700 - protein, 214 aa, Artificial Sequence; identical to SEQ ID NO: 11550
  Description of Artificial Sequence: Synthetic polypeptide
  XENP018985 1G6_H1.244_L1_IgG1_PVA_/S267K Light Chain

SEQ ID NO: 15701 - protein, 107 aa, Artificial Sequence; identical to SEQ ID NO: 6247
  Description of Artificial Sequence: Synthetic polypeptide
  VL of XENP018985

SEQ ID NO: 15702 - protein, 11 aa, Artificial Sequence
  Description of Artificial Sequence: Synthetic peptide
  XENP018985 vlCDR1
RASQSVSNDVA

SEQ ID NO: 15703 - protein, 7 aa, Artificial Sequence
  Description of Artificial Sequence: Synthetic peptide
  XENP018985 vlCDR2
YASHRYT

SEQ ID NO: 15704 - protein, 9 aa, Artificial Sequence
  Description of Artificial Sequence: Synthetic peptide
  XENP018985 vlCDR3
QQDYSSPRT

SEQ ID NO: 15705 - protein, 451 aa, Artificial Sequence
  Description of Artificial Sequence: Synthetic polypeptide
  XENP018986 1G6_H1.245_L1_IgG1_PVA_/S267K Heavy Chain
EVQLVESGGGLVKPGGSLRLSCAASGFTFSNYWMNWVRQAPGKGLEWIGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15706 - protein, 122 aa, Artificial Sequence; identical to SEQ ID NO: 10059
  Description of Artificial Sequence: Synthetic polypeptide
  VH of XENP018986

SEQ ID NO: 15707 - protein, 5 aa, Artificial Sequence
  Description of Artificial Sequence: Synthetic peptide
  XENP018986 vhCDR1
NYWMN

SEQ ID NO: 15708 - protein, 19 aa, Artificial Sequence
  Description of Artificial Sequence: Synthetic peptide
  XENP018986 vhCDR2
EIRLKSNNYATHYAEPVKG

SEQ ID NO: 15709 - protein, 11 aa, Artificial Sequence
  Description of Artificial Sequence: Synthetic peptide
  XENP018986 vhCDR3
YYGNYGGYFDV

SEQ ID NO: 15710 - protein, 214 aa, Artificial Sequence; identical to SEQ ID NO: 11550
  Description of Artificial Sequence: Synthetic polypeptide
  XENP018986 1G6_H1.245_L1_IgG1_PVA_/S267K Light Chain

SEQ ID NO: 15711 - protein, 107 aa, Artificial Sequence; identical to SEQ ID NO: 6247
  Description of Artificial Sequence: Synthetic polypeptide
  VL of XENP018986

SEQ ID NO: 15712 - protein, 11 aa, Artificial Sequence
  Description of Artificial Sequence: Synthetic peptide
  XENP018986 vlCDR1
RASQSVSNDVA

SEQ ID NO: 15713 - protein, 7 aa, Artificial Sequence
  Description of Artificial Sequence: Synthetic peptide
  XENP018986 vlCDR2
YASHRYT

SEQ ID NO: 15714 - protein, 9 aa, Artificial Sequence
  Description of Artificial Sequence: Synthetic peptide
  XENP018986 vlCDR3
QQDYSSPRT

SEQ ID NO: 15715 - protein, 451 aa, Artificial Sequence
  Description of Artificial Sequence: Synthetic polypeptide
  XENP018987 1G6_H1.246_L1_IgG1_PVA_/S267K Heavy Chain
EVQLVESGGGLVKPGGSLRLSCAASGFTFSNYWMNWVRQAPGKGLEWMGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15716 - protein, 122 aa, Artificial Sequence; identical to SEQ ID NO: 10068
  Description of Artificial Sequence: Synthetic polypeptide
  VH of XENP018987

SEQ ID NO: 15717 - protein, 5 aa, Artificial Sequence
  Description of Artificial Sequence: Synthetic peptide
  XENP018987 vhCDR1
NYWMN

SEQ ID NO: 15718 - protein, 19 aa, Artificial Sequence
  Description of Artificial Sequence: Synthetic peptide
  XENP018987 vhCDR2
EIRLKSNNYATHYAEPVKG

SEQ ID NO: 15719 - protein, 11 aa, Artificial Sequence
  Description of Artificial Sequence: Synthetic peptide
  XENP018987 vhCDR3
YYGNYGGYFDV

SEQ ID NO: 15720 - protein, 214 aa, Artificial Sequence; identical to SEQ ID NO: 11550
  Description of Artificial Sequence: Synthetic polypeptide
  XENP018987 1G6_H1.246_L1_IgG1_PVA_/S267K Light Chain

SEQ ID NO: 15721 - protein, 107 aa, Artificial Sequence; identical to SEQ ID NO: 6247
  Description of Artificial Sequence: Synthetic polypeptide
  VL of XENP018987

SEQ ID NO: 15722 - protein, 11 aa, Artificial Sequence
  Description of Artificial Sequence: Synthetic peptide
  XENP018987 vlCDR1
RASQSVSNDVA

SEQ ID NO: 15723 - protein, 7 aa, Artificial Sequence
  Description of Artificial Sequence: Synthetic peptide
  XENP018987 vlCDR2
YASHRYT

SEQ ID NO: 15724 - protein, 9 aa, Artificial Sequence
  Description of Artificial Sequence: Synthetic peptide
  XENP018987 vlCDR3
QQDYSSPRT

SEQ ID NO: 15725 - protein, 451 aa, Artificial Sequence
  Description of Artificial Sequence: Synthetic polypeptide
  XENP018988 1G6_H1.247_L1_IgG1_PVA_/S267K Heavy Chain
EVQLVESGGGLVKPGGSLRLSCAASGFTFSNYWMNWVRQAPGKGLEWVGEIRLKSNNYATHYAEPFKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15726 - protein, 122 aa, Artificial Sequence; identical to SEQ ID NO: 10077
  Description of Artificial Sequence: Synthetic polypeptide
  VH of XENP018988

SEQ ID NO: 15727 - protein, 5 aa, Artificial Sequence
  Description of Artificial Sequence: Synthetic peptide
  XENP018988 vhCDR1
NYWMN

SEQ ID NO: 15728 - protein, 19 aa, Artificial Sequence
  Description of Artificial Sequence: Synthetic peptide
  XENP018988 vhCDR2
EIRLKSNNYATHYAEPFKG

SEQ ID NO: 15729 - protein, 11 aa, Artificial Sequence
  Description of Artificial Sequence: Synthetic peptide
  XENP018988 vhCDR3
YYGNYGGYFDV

SEQ ID NO: 15730 - protein, 214 aa, Artificial Sequence; identical to SEQ ID NO: 11550
  Description of Artificial Sequence: Synthetic polypeptide
  XENP018988 1G6_H1.247_L1_IgG1_PVA_/S267K Light Chain

SEQ ID NO: 15731 - protein, 107 aa, Artificial Sequence; identical to SEQ ID NO: 6247
  Description of Artificial Sequence: Synthetic polypeptide
  VL of XENP018988

SEQ ID NO: 15732 - protein, 11 aa, Artificial Sequence
  Description of Artificial Sequence: Synthetic peptide
  XENP018988 vlCDR1
RASQSVSNDVA

SEQ ID NO: 15733 - protein, 7 aa, Artificial Sequence
  Description of Artificial Sequence: Synthetic peptide
  XENP018988 vlCDR2
YASHRYT

SEQ ID NO: 15734 - protein, 9 aa, Artificial Sequence
  Description of Artificial Sequence: Synthetic peptide
  XENP018988 vlCDR3
QQDYSSPRT

SEQ ID NO: 15735 - protein, 451 aa, Artificial Sequence
  Description of Artificial Sequence: Synthetic polypeptide
  XENP018989 1G6_H1.248_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRATISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15736 - protein, 122 aa, Artificial Sequence; identical to SEQ ID NO: 10086
  Description of Artificial Sequence: Synthetic polypeptide
  VH of XENP018989

SEQ ID NO: 15737 - protein, 5 aa, Artificial Sequence
  Description of Artificial Sequence: Synthetic peptide
  XENP018989 vhCDR1
NYWMN

SEQ ID NO: 15738 - protein, 19 aa, Artificial Sequence
  Description of Artificial Sequence: Synthetic peptide
  XENP018989 vhCDR2
EIRLKSNNYATHYAEPVKG

SEQ ID NO: 15739 - protein, 11 aa, Artificial Sequence
  Description of Artificial Sequence: Synthetic peptide
  XENP018989 vhCDR3
YYGNYGGYFDV

SEQ ID NO: 15740 - protein, 214 aa, Artificial Sequence; identical to SEQ ID NO: 11550
  Description of Artificial Sequence: Synthetic polypeptide
  XENP018989 1G6_H1.248_L1_IgG1_PVA_/S267K Light Chain

SEQ ID NO: 15741 - protein, 107 aa, Artificial Sequence; identical to SEQ ID NO: 6247
  Description of Artificial Sequence: Synthetic polypeptide
  VL of XENP018989

SEQ ID NO: 15742 - protein, 11 aa, Artificial Sequence
  Description of Artificial Sequence: Synthetic peptide
  XENP018989 vlCDR1
RASQSVSNDVA

SEQ ID NO: 15743 - protein, 7 aa, Artificial Sequence
  Description of Artificial Sequence: Synthetic peptide
  XENP018989 vlCDR2
YASHRYT

SEQ ID NO: 15744 - protein, 9 aa, Artificial Sequence
  Description of Artificial Sequence: Synthetic peptide
  XENP018989 vlCDR3
QQDYSSPRT

SEQ ID NO: 15745 - protein, 451 aa, Artificial Sequence
  Description of Artificial Sequence: Synthetic polypeptide
  XENP018990 1G6_H1.249_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRVTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15746 - protein, 122 aa, Artificial Sequence; identical to SEQ ID NO: 10095
  Description of Artificial Sequence: Synthetic polypeptide
  VH of XENP018990

SEQ ID NO: 15747 - protein, 5 aa, Artificial Sequence
  Description of Artificial Sequence: Synthetic peptide
  XENP018990 vhCDR1
NYWMN

SEQ ID NO: 15748 - protein, 19 aa, Artificial Sequence
  Description of Artificial Sequence: Synthetic peptide
  XENP018990 vhCDR2
EIRLKSNNYATHYAEPVKG

SEQ ID NO: 15749 - protein, 11 aa, Artificial Sequence
  Description of Artificial Sequence: Synthetic peptide
  XENP018990 vhCDR3
YYGNYGGYFDV

SEQ ID NO: 15750 - protein, 214 aa, Artificial Sequence; identical to SEQ ID NO: 11550
  Description of Artificial Sequence: Synthetic polypeptide
  XENP018990 1G6_H1.249_L1_IgG1_PVA_/S267K Light Chain

SEQ ID NO: 15751 - protein, 107 aa, Artificial Sequence; identical to SEQ ID NO: 6247
  Description of Artificial Sequence: Synthetic polypeptide
  VL of XENP018990

SEQ ID NO: 15752 - protein, 11 aa, Artificial Sequence
  Description of Artificial Sequence: Synthetic peptide
  XENP018990 vlCDR1
RASQSVSNDVA

SEQ ID NO: 15753 - protein, 7 aa, Artificial Sequence
  Description of Artificial Sequence: Synthetic peptide
  XENP018990 vlCDR2
YASHRYT

SEQ ID NO: 15754 - protein, 9 aa, Artificial Sequence
  Description of Artificial Sequence: Synthetic peptide
  XENP018990 vlCDR3
QQDYSSPRT

SEQ ID NO: 15755 - protein, 451 aa, Artificial Sequence
  Description of Artificial Sequence: Synthetic polypeptide
  XENP018991 1G6_H1.250_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSSSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15756 - protein, 122 aa, Artificial Sequence; identical to SEQ ID NO: 10104
  Description of Artificial Sequence: Synthetic polypeptide
  VH of XENP018991

SEQ ID NO: 15757 - protein, 5 aa, Artificial Sequence
  Description of Artificial Sequence: Synthetic peptide
  XENP018991 vhCDR1
NYWMN

SEQ ID NO: 15758 - protein, 19 aa, Artificial Sequence
  Description of Artificial Sequence: Synthetic peptide
  XENP018991 vhCDR2
EIRLKSNNYATHYAEPVKG

SEQ ID NO: 15759 - protein, 11 aa, Artificial Sequence
  Description of Artificial Sequence: Synthetic peptide
  XENP018991 vhCDR3
YYGNYGGYFDV

SEQ ID NO: 15760 - protein, 214 aa, Artificial Sequence; identical to SEQ ID NO: 11550
  Description of Artificial Sequence: Synthetic polypeptide
  XENP018991 1G6_H1.250_L1_IgG1_PVA_/S267K Light Chain

SEQ ID NO: 15761 - protein, 107 aa, Artificial Sequence; identical to SEQ ID NO: 6247
  Description of Artificial Sequence: Synthetic polypeptide
  VL of XENP018991

SEQ ID NO: 15762 - protein, 11 aa, Artificial Sequence
  Description of Artificial Sequence: Synthetic peptide
  XENP018991 vlCDR1
RASQSVSNDVA

SEQ ID NO: 15763 - protein, 7 aa, Artificial Sequence
  Description of Artificial Sequence: Synthetic peptide
  XENP018991 vlCDR2
YASHRYT

SEQ ID NO: 15764 - protein, 9 aa, Artificial Sequence
  Description of Artificial Sequence: Synthetic peptide
  XENP018991 vlCDR3
QQDYSSPRT

SEQ ID NO: 15765 - protein, 451 aa, Artificial Sequence
  Description of Artificial Sequence: Synthetic polypeptide
  XENP018992 1G6_H1.251_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSMVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15766 - protein, 122 aa, Artificial Sequence; identical to SEQ ID NO: 10113
  Description of Artificial Sequence: Synthetic polypeptide
  VH of XENP018992

SEQ ID NO: 15767 - protein, 5 aa, Artificial Sequence
  Description of Artificial Sequence: Synthetic peptide
  XENP018992 vhCDR1
NYWMN

SEQ ID NO: 15768 - protein, 19 aa, Artificial Sequence
  Description of Artificial Sequence: Synthetic peptide
  XENP018992 vhCDR2
EIRLKSNNYATHYAEPVKG

SEQ ID NO: 15769 - protein, 11 aa, Artificial Sequence
  Description of Artificial Sequence: Synthetic peptide
  XENP018992 vhCDR3
YYGNYGGYFDV

SEQ ID NO: 15770 - protein, 214 aa, Artificial Sequence; identical to SEQ ID NO: 11550
  Description of Artificial Sequence: Synthetic polypeptide
  XENP018992 1G6_H1.251_L1_IgG1_PVA_/S267K Light Chain

SEQ ID NO: 15771 - protein, 107 aa, Artificial Sequence; identical to SEQ ID NO: 6247
  Description of Artificial Sequence: Synthetic polypeptide
  VL of XENP018992

SEQ ID NO: 15772 - protein, 11 aa, Artificial Sequence
  Description of Artificial Sequence: Synthetic peptide
  XENP018992 vlCDR1
RASQSVSNDVA

SEQ ID NO: 15773 - protein, 7 aa, Artificial Sequence
  Description of Artificial Sequence: Synthetic peptide
  XENP018992 vlCDR2
YASHRYT

SEQ ID NO: 15774 - protein, 9 aa, Artificial Sequence
  Description of Artificial Sequence: Synthetic peptide
  XENP018992 vlCDR3
QQDYSSPRT

SEQ ID NO: 15775 - protein, 451 aa, Artificial Sequence
  Description of Artificial Sequence: Synthetic polypeptide
  XENP018993 1G6_H1.252_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSQVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15776 - protein, 122 aa, Artificial Sequence; identical to SEQ ID NO: 10122
  Description of Artificial Sequence: Synthetic polypeptide
  VH of XENP018993

SEQ ID NO: 15777 - protein, 5 aa, Artificial Sequence
  Description of Artificial Sequence: Synthetic peptide
  XENP018993 vhCDR1
NYWMN

SEQ ID NO: 15778 - protein, 19 aa, Artificial Sequence
  Description of Artificial Sequence: Synthetic peptide
  XENP018993 vhCDR2
EIRLKSNNYATHYAEPVKG

SEQ ID NO: 15779 - protein, 11 aa, Artificial Sequence
  Description of Artificial Sequence: Synthetic peptide
  XENP018993 vhCDR3
YYGNYGGYFDV

SEQ ID NO: 15780 - protein, 214 aa, Artificial Sequence; identical to SEQ ID NO: 11550
  Description of Artificial Sequence: Synthetic polypeptide
  XENP018993 1G6_H1.252_L1_IgG1_PVA_/S267K Light Chain

SEQ ID NO: 15781 - protein, 107 aa, Artificial Sequence; identical to SEQ ID NO: 6247
  Description of Artificial Sequence: Synthetic polypeptide
  VL of XENP018993

SEQ ID NO: 15782 - protein, 11 aa, Artificial Sequence
  Description of Artificial Sequence: Synthetic peptide
  XENP018993 vlCDR1
RASQSVSNDVA

SEQ ID NO: 15783 - protein, 7 aa, Artificial Sequence
  Description of Artificial Sequence: Synthetic peptide
  XENP018993 vlCDR2
YASHRYT

SEQ ID NO: 15784 - protein, 9 aa, Artificial Sequence
  Description of Artificial Sequence: Synthetic peptide
  XENP018993 vlCDR3
QQDYSSPRT

SEQ ID NO: 15785 - protein, 451 aa, Artificial Sequence
  Description of Artificial Sequence: Synthetic polypeptide
  XENP018994 1G6_H1.253_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVVLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15786 - protein, 122 aa, Artificial Sequence; identical to SEQ ID NO: 10131
  Description of Artificial Sequence: Synthetic polypeptide
  VH of XENP018994

SEQ ID NO: 15787 - protein, 5 aa, Artificial Sequence
  Description of Artificial Sequence: Synthetic peptide
  XENP018994 vhCDR1
NYWMN

SEQ ID NO: 15788 - protein, 19 aa, Artificial Sequence
  Description of Artificial Sequence: Synthetic peptide
  XENP018994 vhCDR2
EIRLKSNNYATHYAEPVKG

SEQ ID NO: 15789 - protein, 11 aa, Artificial Sequence
  Description of Artificial Sequence: Synthetic peptide
  XENP018994 vhCDR3
YYGNYGGYFDV

SEQ ID NO: 15790 - protein, 214 aa, Artificial Sequence; identical to SEQ ID NO: 11550
  Description of Artificial Sequence: Synthetic polypeptide
  XENP018994 1G6_H1.253_L1_IgG1_PVA_/S267K Light Chain

SEQ ID NO: 15791 - protein, 107 aa, Artificial Sequence; identical to SEQ ID NO: 6247
  Description of Artificial Sequence: Synthetic polypeptide
  VL of XENP018994

SEQ ID NO: 15792 - protein, 11 aa, Artificial Sequence
  Description of Artificial Sequence: Synthetic peptide
  XENP018994 vlCDR1
RASQSVSNDVA

SEQ ID NO: 15793 - protein, 7 aa, Artificial Sequence
  Description of Artificial Sequence: Synthetic peptide
  XENP018994 vlCDR2
YASHRYT

SEQ ID NO: 15794 - protein, 9 aa, Artificial Sequence
  Description of Artificial Sequence: Synthetic peptide
  XENP018994 vlCDR3
QQDYSSPRT

SEQ ID NO: 15795 - protein, 451 aa, Artificial Sequence
  Description of Artificial Sequence: Synthetic polypeptide
  XENP018995 1G6_H1.254_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLEMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15796 - protein, 122 aa, Artificial Sequence; identical to SEQ ID NO: 10140
  Description of Artificial Sequence: Synthetic polypeptide
  VH of XENP018995

SEQ ID NO: 15797 - protein, 5 aa, Artificial Sequence
  Description of Artificial Sequence: Synthetic peptide
  XENP018995 vhCDR1
NYWMN

SEQ ID NO: 15798 - protein, 19 aa, Artificial Sequence
  Description of Artificial Sequence: Synthetic peptide
  XENP018995 vhCDR2
EIRLKSNNYATHYAEPVKG

SEQ ID NO: 15799 - protein, 11 aa, Artificial Sequence
  Description of Artificial Sequence: Synthetic peptide
  XENP018995 vhCDR3
YYGNYGGYFDV

SEQ ID NO: 15800 - protein, 214 aa, Artificial Sequence; identical to SEQ ID NO: 11550
  Description of Artificial Sequence: Synthetic polypeptide
  XENP018995 1G6_H1.254_L1_IgG1_PVA_/S267K Light Chain

SEQ ID NO: 15801 - protein, 107 aa, Artificial Sequence; identical to SEQ ID NO: 6247
  Description of Artificial Sequence: Synthetic polypeptide
  VL of XENP018995

SEQ ID NO: 15802 - protein, 11 aa, Artificial Sequence
  Description of Artificial Sequence: Synthetic peptide
  XENP018995 vlCDR1
RASQSVSNDVA

SEQ ID NO: 15803 - protein, 7 aa, Artificial Sequence
  Description of Artificial Sequence: Synthetic peptide
  XENP018995 vlCDR2
YASHRYT

SEQ ID NO: 15804 - protein, 9 aa, Artificial Sequence
  Description of Artificial Sequence: Synthetic peptide
  XENP018995 vlCDR3
QQDYSSPRT

SEQ ID NO: 15805 - protein, 451 aa, Artificial Sequence
  Description of Artificial Sequence: Synthetic polypeptide
  XENP018996 1G6_H1.255_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSEKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15806 - protein, 122 aa, Artificial Sequence; identical to SEQ ID NO: 10149
  Description of Artificial Sequence: Synthetic polypeptide
  VH of XENP018996

SEQ ID NO: 15807 - protein, 5 aa, Artificial Sequence
  Description of Artificial Sequence: Synthetic peptide
  XENP018996 vhCDR1
NYWMN

SEQ ID NO: 15808 - protein, 19 aa, Artificial Sequence
  Description of Artificial Sequence: Synthetic peptide
  XENP018996 vhCDR2
EIRLKSNNYATHYAEPVKG

SEQ ID NO: 15809 - protein, 11 aa, Artificial Sequence
  Description of Artificial Sequence: Synthetic peptide
  XENP018996 vhCDR3
YYGNYGGYFDV

SEQ ID NO: 15810 - protein, 214 aa, Artificial Sequence; identical to SEQ ID NO: 11550
  Description of Artificial Sequence: Synthetic polypeptide
  XENP018996 1G6_H1.255_L1_IgG1_PVA_/S267K Light Chain

SEQ ID NO: 15811 - protein, 107 aa, Artificial Sequence; identical to SEQ ID NO: 6247
  Description of Artificial Sequence: Synthetic polypeptide
  VL of XENP018996

SEQ ID NO: 15812 - protein, 11 aa, Artificial Sequence
  Description of Artificial Sequence: Synthetic peptide
  XENP018996 vlCDR1
RASQSVSNDVA

SEQ ID NO: 15813 - protein, 7 aa, Artificial Sequence
  Description of Artificial Sequence: Synthetic peptide
  XENP018996 vlCDR2
YASHRYT

SEQ ID NO: 15814 - protein, 9 aa, Artificial Sequence
  Description of Artificial Sequence: Synthetic peptide
  XENP018996 vlCDR3
QQDYSSPRT

SEQ ID NO: 15815 - protein, 451 aa, Artificial Sequence
  Description of Artificial Sequence: Synthetic polypeptide
  XENP019001 1G6_H1.256_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSVKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15816 - protein, 122 aa, Artificial Sequence; identical to SEQ ID NO: 10158
  Description of Artificial Sequence: Synthetic polypeptide
  VH of XENP019001

SEQ ID NO: 15817 - protein, 5 aa, Artificial Sequence
  Description of Artificial Sequence: Synthetic peptide
  XENP019001 vhCDR1
NYWMN

SEQ ID NO: 15818 - protein, 19 aa, Artificial Sequence
  Description of Artificial Sequence: Synthetic peptide
  XENP019001 vhCDR2
EIRLKSNNYATHYAEPVKG

SEQ ID NO: 15819 - protein, 11 aa, Artificial Sequence
  Description of Artificial Sequence: Synthetic peptide
  XENP019001 vhCDR3
YYGNYGGYFDV

SEQ ID NO: 15820 - protein, 214 aa, Artificial Sequence; identical to SEQ ID NO: 11550
  Description of Artificial Sequence: Synthetic polypeptide
  XENP019001 1G6_H1.256_L1_IgG1_PVA_/S267K Light Chain

SEQ ID NO: 15821 - protein, 107 aa, Artificial Sequence; identical to SEQ ID NO: 6247
  Description of Artificial Sequence: Synthetic polypeptide
  VL of XENP019001

SEQ ID NO: 15822 - protein, 11 aa, Artificial Sequence
  Description of Artificial Sequence: Synthetic peptide
  XENP019001 vlCDR1
RASQSVSNDVA

SEQ ID NO: 15823 - protein, 7 aa, Artificial Sequence
  Description of Artificial Sequence: Synthetic peptide
  XENP019001 vlCDR2
YASHRYT

SEQ ID NO: 15824 - protein, 9 aa, Artificial Sequence
  Description of Artificial Sequence: Synthetic peptide
  XENP019001 vlCDR3
QQDYSSPRT

SEQ ID NO: 15825 - protein, 451 aa, Artificial Sequence
  Description of Artificial Sequence: Synthetic polypeptide
  XENP019002 1G6_H1.257_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15826 - protein, 122 aa, Artificial Sequence; identical to SEQ ID NO: 10167
  Description of Artificial Sequence: Synthetic polypeptide
  VH of XENP019002

SEQ ID NO: 15827 - protein, 5 aa, Artificial Sequence
  Description of Artificial Sequence: Synthetic peptide
  XENP019002 vhCDR1
NYWMN

SEQ ID NO: 15828 - protein, 19 aa, Artificial Sequence
  Description of Artificial Sequence: Synthetic peptide
  XENP019002 vhCDR2
EIRLKSNNYATHYAEPVKG

SEQ ID NO: 15829 - protein, 11 aa, Artificial Sequence
  Description of Artificial Sequence: Synthetic peptide
  XENP019002 vhCDR3
YYGNYGGYFDV

SEQ ID NO: 15830 - protein, 214 aa, Artificial Sequence; identical to SEQ ID NO: 11550
  Description of Artificial Sequence: Synthetic polypeptide
  XENP019002 1G6_H1.257_L1_IgG1_PVA_/S267K Light Chain

SEQ ID NO: 15831 - protein, 107 aa, Artificial Sequence; identical to SEQ ID NO: 6247
  Description of Artificial Sequence: Synthetic polypeptide
  VL of XENP019002

SEQ ID NO: 15832 - protein, 11 aa, Artificial Sequence
  Description of Artificial Sequence: Synthetic peptide
  XENP019002 vlCDR1
RASQSVSNDVA

SEQ ID NO: 15833 - protein, 7 aa, Artificial Sequence
  Description of Artificial Sequence: Synthetic peptide
  XENP019002 vlCDR2
YASHRYT

SEQ ID NO: 15834 - protein, 9 aa, Artificial Sequence
  Description of Artificial Sequence: Synthetic peptide
  XENP019002 vlCDR3
QQDYSSPRT

SEQ ID NO: 15835 - protein, 451 aa, Artificial Sequence
  Description of Artificial Sequence: Synthetic polypeptide
  XENP019003 1G6_H1.258_L1_IgG1_PVA_/S267K Heavy Chain
EVQLVESGGGLKKPGESLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15836 - protein, 122 aa, Artificial Sequence; identical to SEQ ID NO: 10176
  Description of Artificial Sequence: Synthetic polypeptide
  VH of XENP019003

SEQ ID NO: 15837 - protein, 5 aa, Artificial Sequence
  Description of Artificial Sequence: Synthetic peptide
  XENP019003 vhCDR1
NYWMN

SEQ ID NO: 15838 - protein, 19 aa, Artificial Sequence
  Description of Artificial Sequence: Synthetic peptide
  XENP019003 vhCDR2
EIRLKSNNYATHYAEPVKG

SEQ ID NO: 15839 - protein, 11 aa, Artificial Sequence
  Description of Artificial Sequence: Synthetic peptide
  XENP019003 vhCDR3
YYGNYGGYFDV

SEQ ID NO: 15840 - protein, 214 aa, Artificial Sequence; identical to SEQ ID NO: 11550
  Description of Artificial Sequence: Synthetic polypeptide
  XENP019003 1G6_H1.258_L1_IgG1_PVA_/S267K Light Chain

SEQ ID NO: 15841 - protein, 107 aa, Artificial Sequence; identical to SEQ ID NO: 6247
  Description of Artificial Sequence: Synthetic polypeptide
  VL of XENP019003

SEQ ID NO: 15842 - protein, 11 aa, Artificial Sequence
  Description of Artificial Sequence: Synthetic peptide
  XENP019003 vlCDR1
RASQSVSNDVA

SEQ ID NO: 15843 - protein, 7 aa, Artificial Sequence
  Description of Artificial Sequence: Synthetic peptide
  XENP019003 vlCDR2
YASHRYT

SEQ ID NO: 15844 - protein, 9 aa, Artificial Sequence
  Description of Artificial Sequence: Synthetic peptide
  XENP019003 vlCDR3
QQDYSSPRT

SEQ ID NO: 15845 - protein, 451 aa, Artificial Sequence
  Description of Artificial Sequence: Synthetic polypeptide
  XENP019004 1G6_H1.259_L1_IgG1_PVA_/S267K Heavy Chain
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCKRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15846 - protein, 122 aa, Artificial Sequence; identical to SEQ ID NO: 10185
  Description of Artificial Sequence: Synthetic polypeptide
  VH of XENP019004

SEQ ID NO: 15847 - protein, 5 aa, Artificial Sequence
  Description of Artificial Sequence: Synthetic peptide
  XENP019004 vhCDR1
NYWMD

SEQ ID NO: 15848 - protein, 19 aa, Artificial Sequence
  Description of Artificial Sequence: Synthetic peptide
  XENP019004 vhCDR2
EIRLKSNNYATHYAEPVKG

SEQ ID NO: 15849 - protein, 11 aa, Artificial Sequence
  Description of Artificial Sequence: Synthetic peptide
  XENP019004 vhCDR3
YYGNYGGYFDV

SEQ ID NO: 15850 - protein, 214 aa, Artificial Sequence; identical to SEQ ID NO: 11550
  Description of Artificial Sequence: Synthetic polypeptide
  XENP019004 1G6_H1.259_L1_IgG1_PVA_/S267K Light Chain

SEQ ID NO: 15851 - protein, 107 aa, Artificial Sequence; identical to SEQ ID NO: 6247
  Description of Artificial Sequence: Synthetic polypeptide
  VL of XENP019004

SEQ ID NO: 15852 - protein, 11 aa, Artificial Sequence
  Description of Artificial Sequence: Synthetic peptide
  XENP019004 vlCDR1
RASQSVSNDVA

SEQ ID NO: 15853 - protein, 7 aa, Artificial Sequence
  Description of Artificial Sequence: Synthetic peptide
  XENP019004 vlCDR2
YASHRYT

SEQ ID NO: 15854 - protein, 9 aa, Artificial Sequence
  Description of Artificial Sequence: Synthetic peptide
  XENP019004 vlCDR3
QQDYSSPRT

SEQ ID NO: 15855 - protein, 451 aa, Artificial Sequence
  Description of Artificial Sequence: Synthetic polypeptide
  XENP019005 1G6_H1.260_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMNSRKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15856 - protein, 122 aa, Artificial Sequence; identical to SEQ ID NO: 10194
  Description of Artificial Sequence: Synthetic polypeptide
  VH of XENP019005

SEQ ID NO: 15857 - protein, 5 aa, Artificial Sequence
  Description of Artificial Sequence: Synthetic peptide
  XENP019005 vhCDR1
NYWMN

SEQ ID NO: 15858 - protein, 19 aa, Artificial Sequence
  Description of Artificial Sequence: Synthetic peptide
  XENP019005 vhCDR2
EIRLKSNNYATHYAEPVKG

SEQ ID NO: 15859 - protein, 11 aa, Artificial Sequence
  Description of Artificial Sequence: Synthetic peptide
  XENP019005 vhCDR3
YYGNYGGYFDV

SEQ ID NO: 15860 - protein, 214 aa, Artificial Sequence; identical to SEQ ID NO: 11550
  Description of Artificial Sequence: Synthetic polypeptide
  XENP019005 1G6_H1.260_L1_IgG1_PVA_/S267K Light Chain

SEQ ID NO: 15861 - protein, 107 aa, Artificial Sequence; identical to SEQ ID NO: 6247
  Description of Artificial Sequence: Synthetic polypeptide
  VL of XENP019005

SEQ ID NO: 15862 - protein, 11 aa, Artificial Sequence
  Description of Artificial Sequence: Synthetic peptide
  XENP019005 vlCDR1
RASQSVSNDVA

SEQ ID NO: 15863 - protein, 7 aa, Artificial Sequence
  Description of Artificial Sequence: Synthetic peptide
  XENP019005 vlCDR2
YASHRYT

SEQ ID NO: 15864 - protein, 9 aa, Artificial Sequence
  Description of Artificial Sequence: Synthetic peptide
  XENP019005 vlCDR3
QQDYSSPRT

SEQ ID NO: 15865 - protein, 451 aa, Artificial Sequence
  Description of Artificial Sequence: Synthetic polypeptide
  XENP019006 1G6_H1.261_L1_IgG1_PVA_/S267K Heavy Chain
EVQLVESGGGLVKPGGSLRLSCKASGFTFSNYWMNWVRQAPGKGLEWVGEIRLKSNNYATHYAEPVKGRFTISRDDSKDTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15866 - protein, 122 aa, Artificial Sequence; identical to SEQ ID NO: 10203
  Description of Artificial Sequence: Synthetic polypeptide
  VH of XENP019006

SEQ ID NO: 15867 - protein, 5 aa, Artificial Sequence
  Description of Artificial Sequence: Synthetic peptide
  XENP019006 vhCDR1
NYWMN

SEQ ID NO: 15868 - protein, 19 aa, Artificial Sequence
  Description of Artificial Sequence: Synthetic peptide
  XENP019006 vhCDR2
EIRLKSNNYATHYAEPVKG

SEQ ID NO: 15869 - protein, 11 aa, Artificial Sequence
  Description of Artificial Sequence: Synthetic peptide
  XENP019006 vhCDR3
YYGNYGGYFDV

SEQ ID NO: 15870 - protein, 214 aa, Artificial Sequence; identical to SEQ ID NO: 11550
  Description of Artificial Sequence: Synthetic polypeptide
  XENP019006 1G6_H1.261_L1_IgG1_PVA_/S267K Light Chain

SEQ ID NO: 15871 - protein, 107 aa, Artificial Sequence; identical to SEQ ID NO: 6247
  Description of Artificial Sequence: Synthetic polypeptide
  VL of XENP019006

SEQ ID NO: 15872 - protein, 11 aa, Artificial Sequence
  Description of Artificial Sequence: Synthetic peptide
  XENP019006 vlCDR1
RASQSVSNDVA

SEQ ID NO: 15873 - protein, 7 aa, Artificial Sequence
  Description of Artificial Sequence: Synthetic peptide
  XENP019006 vlCDR2
YASHRYT

SEQ ID NO: 15874 - protein, 9 aa, Artificial Sequence
  Description of Artificial Sequence: Synthetic peptide
  XENP019006 vlCDR3
QQDYSSPRT

SEQ ID NO: 15875 - protein, 451 aa, Artificial Sequence
  Description of Artificial Sequence: Synthetic polypeptide
  XENP019007 1G6_H1.262_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMNRLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15876 - protein, 122 aa, Artificial Sequence; identical to SEQ ID NO: 10212
  Description of Artificial Sequence: Synthetic polypeptide
  VH of XENP019007

SEQ ID NO: 15877 - protein, 5 aa, Artificial Sequence
  Description of Artificial Sequence: Synthetic peptide
  XENP019007 vhCDR1
NYWMN

SEQ ID NO: 15878 - protein, 19 aa, Artificial Sequence
  Description of Artificial Sequence: Synthetic peptide
  XENP019007 vhCDR2
EIRLKSNNYATHYAEPVKG

SEQ ID NO: 15879 - protein, 11 aa, Artificial Sequence
  Description of Artificial Sequence: Synthetic peptide
  XENP019007 vhCDR3
YYGNYGGYFDV

SEQ ID NO: 15880 - protein, 214 aa, Artificial Sequence; identical to SEQ ID NO: 11550
  Description of Artificial Sequence: Synthetic polypeptide
  XENP019007 1G6_H1.262_L1_IgG1_PVA_/S267K Light Chain

SEQ ID NO: 15881 - protein, 107 aa, Artificial Sequence; identical to SEQ ID NO: 6247
  Description of Artificial Sequence: Synthetic polypeptide
  VL of XENP019007

SEQ ID NO: 15882 - protein, 11 aa, Artificial Sequence
  Description of Artificial Sequence: Synthetic peptide
  XENP019007 vlCDR1
RASQSVSNDVA

SEQ ID NO: 15883 - protein, 7 aa, Artificial Sequence
  Description of Artificial Sequence: Synthetic peptide
  XENP019007 vlCDR2
YASHRYT

SEQ ID NO: 15884 - protein, 9 aa, Artificial Sequence
  Description of Artificial Sequence: Synthetic peptide
  XENP019007 vlCDR3
QQDYSSPRT

SEQ ID NO: 15885 - protein, 451 aa, Artificial Sequence
  Description of Artificial Sequence: Synthetic polypeptide
  XENP019008 1G6_H1.263_L1_IgG1_PVA_/S267K Heavy Chain
EVQLVESGGGLVKPGGSLRLSCAASGFTFSNYWMNWVRQAPGKGLEWVGEIRLKSNNYATHYAEKVKGLFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15886 - protein, 122 aa, Artificial Sequence; identical to SEQ ID NO: 10221
  Description of Artificial Sequence: Synthetic polypeptide
  VH of XENP019008

SEQ ID NO: 15887 - protein, 5 aa, Artificial Sequence
  Description of Artificial Sequence: Synthetic peptide
  XENP019008 vhCDR1
NYWMN

SEQ ID NO: 15888 - protein, 19 aa, Artificial Sequence
  Description of Artificial Sequence: Synthetic peptide
  XENP019008 vhCDR2
EIRLKSNNYATHYAEKVKG

SEQ ID NO: 15889 - protein, 11 aa, Artificial Sequence
  Description of Artificial Sequence: Synthetic peptide
  XENP019008 vhCDR3
YYGNYGGYFDV

SEQ ID NO: 15890 - protein, 214 aa, Artificial Sequence; identical to SEQ ID NO: 11550
  Description of Artificial Sequence: Synthetic polypeptide
  XENP019008 1G6_H1.263_L1_IgG1_PVA_/S267K Light Chain

SEQ ID NO: 15891 - protein, 107 aa, Artificial Sequence; identical to SEQ ID NO: 6247
  Description of Artificial Sequence: Synthetic polypeptide
  VL of XENP019008

SEQ ID NO: 15892 - protein, 11 aa, Artificial Sequence
  Description of Artificial Sequence: Synthetic peptide
  XENP019008 vlCDR1
RASQSVSNDVA

SEQ ID NO: 15893 - protein, 7 aa, Artificial Sequence
  Description of Artificial Sequence: Synthetic peptide
  XENP019008 vlCDR2
YASHRYT

SEQ ID NO: 15894 - protein, 9 aa, Artificial Sequence
  Description of Artificial Sequence: Synthetic peptide
  XENP019008 vlCDR3
QQDYSSPRT

SEQ ID NO: 15895 - protein, 451 aa, Artificial Sequence
  Description of Artificial Sequence: Synthetic polypeptide
  XENP019009 1G6_H1.264_L1_IgG1_PVA_/S267K Heavy Chain
EVQLVESGGGLVKPGGSLRLSCKASGDTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15896 - protein, 122 aa, Artificial Sequence; identical to SEQ ID NO: 10230
  Description of Artificial Sequence: Synthetic polypeptide
  VH of XENP019009

SEQ ID NO: 15897 - protein, 5 aa, Artificial Sequence
  Description of Artificial Sequence: Synthetic peptide
  XENP019009 vhCDR1
NYWMN

SEQ ID NO: 15898 - protein, 19 aa, Artificial Sequence
  Description of Artificial Sequence: Synthetic peptide
  XENP019009 vhCDR2
EIRLKSNNYATHYAEPVKG

SEQ ID NO: 15899 - protein, 11 aa, Artificial Sequence
  Description of Artificial Sequence: Synthetic peptide
  XENP019009 vhCDR3
YYGNYGGYFDV

SEQ ID NO: 15900 - protein, 214 aa, Artificial Sequence; identical to SEQ ID NO: 11550
  Description of Artificial Sequence: Synthetic polypeptide
  XENP019009 1G6_H1.264_L1_IgG1_PVA_/S267K Light Chain

SEQ ID NO: 15901 - protein, 107 aa, Artificial Sequence; identical to SEQ ID NO: 6247
  Description of Artificial Sequence: Synthetic polypeptide
  VL of XENP019009

SEQ ID NO: 15902 - protein, 11 aa, Artificial Sequence
  Description of Artificial Sequence: Synthetic peptide
  XENP019009 vlCDR1
RASQSVSNDVA

SEQ ID NO: 15903 - protein, 7 aa, Artificial Sequence
  Description of Artificial Sequence: Synthetic peptide
  XENP019009 vlCDR2
YASHRYT

SEQ ID NO: 15904 - protein, 9 aa, Artificial Sequence
  Description of Artificial Sequence: Synthetic peptide
  XENP019009 vlCDR3
QQDYSSPRT

SEQ ID NO: 15905 - protein, 451 aa, Artificial Sequence
  Description of Artificial Sequence: Synthetic polypeptide
  XENP019010 1G6_H1.265_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLKMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15906 - protein, 122 aa, Artificial Sequence; identical to SEQ ID NO: 10239
  Description of Artificial Sequence: Synthetic polypeptide
  VH of XENP019010

SEQ ID NO: 15907 - protein, 5 aa, Artificial Sequence
  Description of Artificial Sequence: Synthetic peptide
  XENP019010 vhCDR1
NYWMN

SEQ ID NO: 15908 - protein, 19 aa, Artificial Sequence
  Description of Artificial Sequence: Synthetic peptide
  XENP019010 vhCDR2
EIRLKSNNYATHYAEPVKG

SEQ ID NO: 15909 - protein, 11 aa, Artificial Sequence
  Description of Artificial Sequence: Synthetic peptide
  XENP019010 vhCDR3
YYGNYGGYFDV

SEQ ID NO: 15910 - protein, 214 aa, Artificial Sequence; identical to SEQ ID NO: 11550
  Description of Artificial Sequence: Synthetic polypeptide
  XENP019010 1G6_H1.265_L1_IgG1_PVA_/S267K Light Chain

SEQ ID NO: 15911 - protein, 107 aa, Artificial Sequence; identical to SEQ ID NO: 6247
  Description of Artificial Sequence: Synthetic polypeptide
  VL of XENP019010

SEQ ID NO: 15912 - protein, 11 aa, Artificial Sequence
  Description of Artificial Sequence: Synthetic peptide
  XENP019010 vlCDR1
RASQSVSNDVA

SEQ ID NO: 15913 - protein, 7 aa, Artificial Sequence
  Description of Artificial Sequence: Synthetic peptide
  XENP019010 vlCDR2
YASHRYT

SEQ ID NO: 15914 - protein, 9 aa, Artificial Sequence
  Description of Artificial Sequence: Synthetic peptide
  XENP019010 vlCDR3
QQDYSSPRT

SEQ ID NO: 15915 - protein, 451 aa, Artificial Sequence
  Description of Artificial Sequence: Synthetic polypeptide
  XENP019011 1G6_H1.266_L1_IgG1_PVA_/S267K Heavy Chain
EVQLVESGGGLVKPGGSLRLSCAASGFTFSNYWMNWVRQAPGKGLEWVGEIRLKSNNYATHYAQPVKDRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15916 - protein, 122 aa, Artificial Sequence; identical to SEQ ID NO: 10248
  Description of Artificial Sequence: Synthetic polypeptide
  VH of XENP019011

SEQ ID NO: 15917 - protein, 5 aa, Artificial Sequence
  Description of Artificial Sequence: Synthetic peptide
  XENP019011 vhCDR1
NYWMN

SEQ ID NO: 15918 - protein, 19 aa, Artificial Sequence
  Description of Artificial Sequence: Synthetic peptide
  XENP019011 vhCDR2
EIRLKSNNYATHYAQPVKD

SEQ ID NO: 15919 - protein, 11 aa, Artificial Sequence
  Description of Artificial Sequence: Synthetic peptide
  XENP019011 vhCDR3
YYGNYGGYFDV

SEQ ID NO: 15920 - protein, 214 aa, Artificial Sequence; identical to SEQ ID NO: 11550
  Description of Artificial Sequence: Synthetic polypeptide
  XENP019011 1G6_H1.266_L1_IgG1_PVA_/S267K Light Chain

SEQ ID NO: 15921 - protein, 107 aa, Artificial Sequence; identical to SEQ ID NO: 6247
  Description of Artificial Sequence: Synthetic polypeptide
  VL of XENP019011

SEQ ID NO: 15922 - protein, 11 aa, Artificial Sequence
  Description of Artificial Sequence: Synthetic peptide
  XENP019011 vlCDR1
RASQSVSNDVA

SEQ ID NO: 15923 - protein, 7 aa, Artificial Sequence
  Description of Artificial Sequence: Synthetic peptide
  XENP019011 vlCDR2
YASHRYT

SEQ ID NO: 15924 - protein, 9 aa, Artificial Sequence
  Description of Artificial Sequence: Synthetic peptide
  XENP019011 vlCDR3
QQDYSSPRT

SEQ ID NO: 15925 - protein, 451 aa, Artificial Sequence
  Description of Artificial Sequence: Synthetic polypeptide
  XENP019012 1G6_H1.267_L1_IgG1_PVA_/S267K Heavy Chain
EVQLVESGGGLVKPGGSLRLSCAASGFTFSNYWMNWVRQAPGKGLEWVGEIRLKSNNYATHYAEPVKGRFTISRDDSKSTVYLEMNSRKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15926 - protein, 122 aa, Artificial Sequence; identical to SEQ ID NO: 10257
  Description of Artificial Sequence: Synthetic polypeptide
  VH of XENP019012

SEQ ID NO: 15927 - protein, 5 aa, Artificial Sequence
  Description of Artificial Sequence: Synthetic peptide
  XENP019012 vhCDR1
NYWMN

SEQ ID NO: 15928 - protein, 19 aa, Artificial Sequence
  Description of Artificial Sequence: Synthetic peptide
  XENP019012 vhCDR2
EIRLKSNNYATHYAEPVKG

SEQ ID NO: 15929 - protein, 11 aa, Artificial Sequence
  Description of Artificial Sequence: Synthetic peptide
  XENP019012 vhCDR3
YYGNYGGYFDV

SEQ ID NO: 15930 - protein, 214 aa, Artificial Sequence; identical to SEQ ID NO: 11550
  Description of Artificial Sequence: Synthetic polypeptide
  XENP019012 1G6_H1.267_L1_IgG1_PVA_/S267K Light Chain

SEQ ID NO: 15931 - protein, 107 aa, Artificial Sequence; identical to SEQ ID NO: 6247
  Description of Artificial Sequence: Synthetic polypeptide
  VL of XENP019012

SEQ ID NO: 15932 - protein, 11 aa, Artificial Sequence
  Description of Artificial Sequence: Synthetic peptide
  XENP019012 vlCDR1
RASQSVSNDVA

SEQ ID NO: 15933 - protein, 7 aa, Artificial Sequence
  Description of Artificial Sequence: Synthetic peptide
  XENP019012 vlCDR2
YASHRYT

SEQ ID NO: 15934 - protein, 9 aa, Artificial Sequence
  Description of Artificial Sequence: Synthetic peptide
  XENP019012 vlCDR3
QQDYSSPRT

SEQ ID NO: 15935 - protein, 451 aa, Artificial Sequence
  Description of Artificial Sequence: Synthetic polypeptide
  XENP019013 1G6_H1.268_L1_IgG1_PVA_/S267K Heavy Chain
EVQLVESGGGLVKPGESLRLSCAASGFTFSNYWMNWVRQAPGKGLEWVGEIRLKSNNYATHYAEPVKGRFTISRDDSKSTVYLQMRSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15936 - protein, 122 aa, Artificial Sequence; identical to SEQ ID NO: 10266
  Description of Artificial Sequence: Synthetic polypeptide
  VH of XENP019013

SEQ ID NO: 15937 - protein, 5 aa, Artificial Sequence
  Description of Artificial Sequence: Synthetic peptide
  XENP019013 vhCDR1
NYWMN

SEQ ID NO: 15938 - protein, 19 aa, Artificial Sequence
  Description of Artificial Sequence: Synthetic peptide
  XENP019013 vhCDR2
EIRLKSNNYATHYAEPVKG

SEQ ID NO: 15939 - protein, 11 aa, Artificial Sequence
  Description of Artificial Sequence: Synthetic peptide
  XENP019013 vhCDR3
YYGNYGGYFDV

SEQ ID NO: 15940 - protein, 214 aa, Artificial Sequence; identical to SEQ ID NO: 11550
  Description of Artificial Sequence: Synthetic polypeptide
  XENP019013 1G6_H1.268_L1_IgG1_PVA_/S267K Light Chain

SEQ ID NO: 15941 - protein, 107 aa, Artificial Sequence; identical to SEQ ID NO: 6247
  Description of Artificial Sequence: Synthetic polypeptide
  VL of XENP019013

SEQ ID NO: 15942 - protein, 11 aa, Artificial Sequence
  Description of Artificial Sequence: Synthetic peptide
  XENP019013 vlCDR1
RASQSVSNDVA

SEQ ID NO: 15943 - protein, 7 aa, Artificial Sequence
  Description of Artificial Sequence: Synthetic peptide
  XENP019013 vlCDR2
YASHRYT

SEQ ID NO: 15944 - protein, 9 aa, Artificial Sequence
  Description of Artificial Sequence: Synthetic peptide
  XENP019013 vlCDR3
QQDYSSPRT

SEQ ID NO: 15945 - protein, 451 aa, Artificial Sequence
  Description of Artificial Sequence: Synthetic polypeptide
  XENP019014 1G6_H1.269_L1_IgG1_PVA_/S267K Heavy Chain
EVQLVESGGGLVKPGGSLRLSCAASGFTFSNFWMNWVRQAPGKGLEWVGEIRLYSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15946 - protein, 122 aa, Artificial Sequence; identical to SEQ ID NO: 10275
  Description of Artificial Sequence: Synthetic polypeptide
  VH of XENP019014

SEQ ID NO: 15947 - protein, 5 aa, Artificial Sequence
  Description of Artificial Sequence: Synthetic peptide
  XENP019014 vhCDR1
NFWMN

SEQ ID NO: 15948 - protein, 19 aa, Artificial Sequence
  Description of Artificial Sequence: Synthetic peptide
  XENP019014 vhCDR2
EIRLYSNNYATHYAEPVKG

SEQ ID NO: 15949 - protein, 11 aa, Artificial Sequence
  Description of Artificial Sequence: Synthetic peptide
  XENP019014 vhCDR3
YYGNYGGYFDV

SEQ ID NO: 15950 - protein, 214 aa, Artificial Sequence; identical to SEQ ID NO: 11550
  Description of Artificial Sequence: Synthetic polypeptide
  XENP019014 1G6_H1.269_L1_IgG1_PVA_/S267K Light Chain

SEQ ID NO: 15951 - protein, 107 aa, Artificial Sequence; identical to SEQ ID NO: 6247
  Description of Artificial Sequence: Synthetic polypeptide
  VL of XENP019014

SEQ ID NO: 15952 - protein, 11 aa, Artificial Sequence
  Description of Artificial Sequence: Synthetic peptide
  XENP019014 vlCDR1
RASQSVSNDVA

SEQ ID NO: 15953 - protein, 7 aa, Artificial Sequence
  Description of Artificial Sequence: Synthetic peptide
  XENP019014 vlCDR2
YASHRYT

SEQ ID NO: 15954 - protein, 9 aa, Artificial Sequence
  Description of Artificial Sequence: Synthetic peptide
  XENP019014 vlCDR3
QQDYSSPRT

SEQ ID NO: 15955 - protein, 451 aa, Artificial Sequence
  Description of Artificial Sequence: Synthetic polypeptide
  XENP019015 1G6_H1.270_L1_IgG1_PVA_/S267K Heavy Chain
EVQLVESGGGLVKPGGSLRLSCAASGFTFSNYWMNWVRQAPGKGLEWVGEIRWYSNNYATHYAEPVKGRFTISRDDSKSTVYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15956 - protein, 122 aa, Artificial Sequence; identical to SEQ ID NO: 10284
  Description of Artificial Sequence: Synthetic polypeptide
  VH of XENP019015

SEQ ID NO: 15957 - protein, 5 aa, Artificial Sequence
  Description of Artificial Sequence: Synthetic peptide
  XENP019015 vhCDR1
NYWMN

SEQ ID NO: 15958 - protein, 19 aa, Artificial Sequence
  Description of Artificial Sequence: Synthetic peptide
  XENP019015 vhCDR2
EIRWYSNNYATHYAEPVKG

SEQ ID NO: 15959 - protein, 11 aa, Artificial Sequence
  Description of Artificial Sequence: Synthetic peptide
  XENP019015 vhCDR3
YYGNYGGYFDV

SEQ ID NO: 15960 - protein, 214 aa, Artificial Sequence; identical to SEQ ID NO: 11550
  Description of Artificial Sequence: Synthetic polypeptide
  XENP019015 1G6_H1.270_L1_IgG1_PVA_/S267K Light Chain

SEQ ID NO: 15961 - protein, 107 aa, Artificial Sequence; identical to SEQ ID NO: 6247
  Description of Artificial Sequence: Synthetic polypeptide
  VL of XENP019015

SEQ ID NO: 15962 - protein, 11 aa, Artificial Sequence
  Description of Artificial Sequence: Synthetic peptide
  XENP019015 vlCDR1
RASQSVSNDVA

SEQ ID NO: 15963 - protein, 7 aa, Artificial Sequence
  Description of Artificial Sequence: Synthetic peptide
  XENP019015 vlCDR2
YASHRYT

SEQ ID NO: 15964 - protein, 9 aa, Artificial Sequence
  Description of Artificial Sequence: Synthetic peptide
  XENP019015 vlCDR3
QQDYSSPRT

SEQ ID NO: 15965 - protein, 451 aa, Artificial Sequence
  Description of Artificial Sequence: Synthetic polypeptide
  XENP019016 1G6_H1.271_L1_IgG1_PVA_/S267K Heavy Chain
EVQLVESGGGLVKPGGSLRLSCAASGFTFSNYWMNWVRQAPGKGLEWVGEIRLYSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15966 - protein, 122 aa, Artificial Sequence; identical to SEQ ID NO: 10293
  Description of Artificial Sequence: Synthetic polypeptide
  VH of XENP019016

SEQ ID NO: 15967 - protein, 5 aa, Artificial Sequence
  Description of Artificial Sequence: Synthetic peptide
  XENP019016 vhCDR1
NYWMN

SEQ ID NO: 15968 - protein, 19 aa, Artificial Sequence
  Description of Artificial Sequence: Synthetic peptide
  XENP019016 vhCDR2
EIRLYSNNYATHYAEPVKG

SEQ ID NO: 15969 - protein, 11 aa, Artificial Sequence
  Description of Artificial Sequence: Synthetic peptide
  XENP019016 vhCDR3
YYGNYGGYFDV

SEQ ID NO: 15970 - protein, 214 aa, Artificial Sequence; identical to SEQ ID NO: 11550
  Description of Artificial Sequence: Synthetic polypeptide
  XENP019016 1G6_H1.271_L1_IgG1_PVA_/S267K Light Chain

SEQ ID NO: 15971 - protein, 107 aa, Artificial Sequence; identical to SEQ ID NO: 6247
  Description of Artificial Sequence: Synthetic polypeptide
  VL of XENP019016

SEQ ID NO: 15972 - protein, 11 aa, Artificial Sequence
  Description of Artificial Sequence: Synthetic peptide
  XENP019016 vlCDR1
RASQSVSNDVA

SEQ ID NO: 15973 - protein, 7 aa, Artificial Sequence
  Description of Artificial Sequence: Synthetic peptide
  XENP019016 vlCDR2
YASHRYT

SEQ ID NO: 15974 - protein, 9 aa, Artificial Sequence
  Description of Artificial Sequence: Synthetic peptide
  XENP019016 vlCDR3
QQDYSSPRT

SEQ ID NO: 15975 - protein, 451 aa, Artificial Sequence
  Description of Artificial Sequence: Synthetic polypeptide
  XENP019017 1G6_H1.272_L1_IgG1_PVA_/S267K Heavy Chain
EVQLVESGGGLVKPGGSLRLSCAASGFTFSNFWMNWVRQAPGKGLEWVGEIRLYSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15976 - protein, 122 aa, Artificial Sequence; identical to SEQ ID NO: 10302
  Description of Artificial Sequence: Synthetic polypeptide
  VH of XENP019017

SEQ ID NO: 15977 - protein, 5 aa, Artificial Sequence
  Description of Artificial Sequence: Synthetic peptide
  XENP019017 vhCDR1
NFWMN

SEQ ID NO: 15978 - protein, 19 aa, Artificial Sequence
  Description of Artificial Sequence: Synthetic peptide
  XENP019017 vhCDR2
EIRLYSNNYATHYAEPVKG

SEQ ID NO: 15979 - protein, 11 aa, Artificial Sequence
  Description of Artificial Sequence: Synthetic peptide
  XENP019017 vhCDR3
YYGNYGGYFDV

SEQ ID NO: 15980 - protein, 214 aa, Artificial Sequence; identical to SEQ ID NO: 11550
  Description of Artificial Sequence: Synthetic polypeptide
  XENP019017 1G6_H1.272_L1_IgG1_PVA_/S267K Light Chain

SEQ ID NO: 15981 - protein, 107 aa, Artificial Sequence; identical to SEQ ID NO: 6247
  Description of Artificial Sequence: Synthetic polypeptide
  VL of XENP019017

SEQ ID NO: 15982 - protein, 11 aa, Artificial Sequence
  Description of Artificial Sequence: Synthetic peptide
  XENP019017 vlCDR1
RASQSVSNDVA

SEQ ID NO: 15983 - protein, 7 aa, Artificial Sequence
  Description of Artificial Sequence: Synthetic peptide
  XENP019017 vlCDR2
YASHRYT

SEQ ID NO: 15984 - protein, 9 aa, Artificial Sequence
  Description of Artificial Sequence: Synthetic peptide
  XENP019017 vlCDR3
QQDYSSPRT

SEQ ID NO: 15985 - protein, 451 aa, Artificial Sequence
  Description of Artificial Sequence: Synthetic polypeptide
  XENP019018 1G6_H1.273_L1_IgG1_PVA_/S267K Heavy Chain
EVQLVESGGGLVKPGGSLRLSCAASGFTFSNFWMNWVRQAPGKGLEWVGEIRWKSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15986 - protein, 122 aa, Artificial Sequence; identical to SEQ ID NO: 10311
  Description of Artificial Sequence: Synthetic polypeptide
  VH of XENP019018

SEQ ID NO: 15987 - protein, 5 aa, Artificial Sequence
  Description of Artificial Sequence: Synthetic peptide
  XENP019018 vhCDR1
NFWMN

SEQ ID NO: 15988 - protein, 19 aa, Artificial Sequence
  Description of Artificial Sequence: Synthetic peptide
  XENP019018 vhCDR2
EIRWKSNNYATHYAEPVKG

SEQ ID NO: 15989 - protein, 11 aa, Artificial Sequence
  Description of Artificial Sequence: Synthetic peptide
  XENP019018 vhCDR3
YYGNYGGYFDV

SEQ ID NO: 15990 - protein, 214 aa, Artificial Sequence; identical to SEQ ID NO: 11550
  Description of Artificial Sequence: Synthetic polypeptide
  XENP019018 1G6_H1.273_L1_IgG1_PVA_/S267K Light Chain

SEQ ID NO: 15991 - protein, 107 aa, Artificial Sequence; identical to SEQ ID NO: 6247
  Description of Artificial Sequence: Synthetic polypeptide
  VL of XENP019018

SEQ ID NO: 15992 - protein, 11 aa, Artificial Sequence
  Description of Artificial Sequence: Synthetic peptide
  XENP019018 vlCDR1
RASQSVSNDVA

SEQ ID NO: 15993 - protein, 7 aa, Artificial Sequence
  Description of Artificial Sequence: Synthetic peptide
  XENP019018 vlCDR2
YASHRYT

SEQ ID NO: 15994 - protein, 9 aa, Artificial Sequence
  Description of Artificial Sequence: Synthetic peptide
  XENP019018 vlCDR3
QQDYSSPRT

SEQ ID NO: 15995 - protein, 451 aa, Artificial Sequence
  Description of Artificial Sequence: Synthetic polypeptide
  XENP019019 1G6_H1.274_L1_IgG1_PVA_/S267K Heavy Chain
EVQLVESGGGLVKPGGSLRLSCAASGFTFSNFWMNWVRQAPGKGLEWVGEIRLKKNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15996 - protein, 122 aa, Artificial Sequence; identical to SEQ ID NO: 10320
  Description of Artificial Sequence: Synthetic polypeptide
  VH of XENP019019

SEQ ID NO: 15997 - protein, 5 aa, Artificial Sequence
  Description of Artificial Sequence: Synthetic peptide
  XENP019019 vhCDR1
NFWMN

SEQ ID NO: 15998 - protein, 19 aa, Artificial Sequence
  Description of Artificial Sequence: Synthetic peptide
  XENP019019 vhCDR2
EIRLKKNNYATHYAEPVKG

SEQ ID NO: 15999 - protein, 11 aa, Artificial Sequence
  Description of Artificial Sequence: Synthetic peptide
  XENP019019 vhCDR3
YYGNYGGYFDV

SEQ ID NO: 16000 - protein, 214 aa, Artificial Sequence; identical to SEQ ID NO: 11550
  Description of Artificial Sequence: Synthetic polypeptide
  XENP019019 1G6_H1.274_L1_IgG1_PVA_/S267K Light Chain

SEQ ID NO: 16001 - protein, 107 aa, Artificial Sequence; identical to SEQ ID NO: 6247
  Description of Artificial Sequence: Synthetic polypeptide
  VL of XENP019019

SEQ ID NO: 16002 - protein, 11 aa, Artificial Sequence
  Description of Artificial Sequence: Synthetic peptide
  XENP019019 vlCDR1
RASQSVSNDVA

SEQ ID NO: 16003 - protein, 7 aa, Artificial Sequence
  Description of Artificial Sequence: Synthetic peptide
  XENP019019 vlCDR2
YASHRYT

SEQ ID NO: 16004 - protein, 9 aa, Artificial Sequence
  Description of Artificial Sequence: Synthetic peptide
  XENP019019 vlCDR3
QQDYSSPRT

SEQ ID NO: 16005 - protein, 451 aa, Artificial Sequence
  Description of Artificial Sequence: Synthetic polypeptide
  XENP019020 1G6_H1.275_L1_IgG1_PVA_/S267K Heavy Chain
EVQLVESGGGLVKPGGSLRLSCAASGFTFSNFWMNWVRQAPGKGLEWVGEIRWYSNNYATHYAEPVKGRFTISRDDSKSTLYLQMNSLKTEDTAVYYCTRYYGNYGGYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16006 - protein, 122 aa, Artificial Sequence; identical to SEQ ID NO: 10329
  Description of Artificial Sequence: Synthetic polypeptide
  VH of XENP019020

SEQ ID NO: 16007 - protein, 5 aa, Artificial Sequence
  Description of Artificial Sequence: Synthetic peptide
  XENP019020 vhCDR1
NFWMN

SEQ ID NO: 16008 - protein, 19 aa, Artificial Sequence
  Description of Artificial Sequence: Synthetic peptide
  XENP019020 vhCDR2
EIRWYSNNYATHYAEPVKG

SEQ ID NO: 16009 - protein, 11 aa, Artificial Sequence
  Description of Artificial Sequence: Synthetic peptide
  XENP019020 vhCDR3
YYGNYGGYFDV

SEQ ID NO: 16010 - protein, 214 aa, Artificial Sequence; identical to SEQ ID NO: 11550
  Description of Artificial Sequence: Synthetic polypeptide
  XENP019020 1G6_H1.275_L1_IgG1_PVA_/S267K Light Chain

SEQ ID NO: 16011 - protein, 107 aa, Artificial Sequence; identical to SEQ ID NO: 6247
  Description of Artificial Sequence: Synthetic polypeptide
  VL of XENP019020

SEQ ID NO: 16012 - protein, 11 aa, Artificial Sequence
  Description of Artificial Sequence: Synthetic peptide
  XENP019020 vlCDR1
RASQSVSNDVA

SEQ ID NO: 16013 - protein, 7 aa, Artificial Sequence
  Description of Artificial Sequence: Synthetic peptide
  XENP019020 vlCDR2
YASHRYT

SEQ ID NO: 16014 - protein, 9 aa, Artificial Sequence
  Description of Artificial Sequence: Synthetic peptide
  XENP019020 vlCDR3
QQDYSSPRT

SEQ ID NO: 16015 - protein, 451 aa, Artificial Sequence
  Description of Artificial Sequence: Synthetic polypeptide
  XENP019021 1G6_H1.276_L1_IgG1_PVA_/S267K Heavy Chain
EVQLVESGGGLVQPGGSLKLSCAASGFTFSNYWMNWVRQAPGKGLEWVGEIRLKSNNYATHYAASVKGRFTISRDDSKSTLYLQMNSLKTEDTAVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16016 - protein, 122 aa, Artificial Sequence; identical to SEQ ID NO: 10338
  Description of Artificial Sequence: Synthetic polypeptide
  VH of XENP019021

SEQ ID NO: 16017 - protein, 5 aa, Artificial Sequence
  Description of Artificial Sequence: Synthetic peptide
  XENP019021 vhCDR1
NYWMN

SEQ ID NO: 16018 - protein, 19 aa, Artificial Sequence
  Description of Artificial Sequence: Synthetic peptide
  XENP019021 vhCDR2
EIRLKSNNYATHYAASVKG

SEQ ID NO: 16019 - protein, 11 aa, Artificial Sequence
  Description of Artificial Sequence: Synthetic peptide
  XENP019021 vhCDR3
YYGNYGGYFDV

SEQ ID NO: 16020 - protein, 214 aa, Artificial Sequence; identical to SEQ ID NO: 11550
  Description of Artificial Sequence: Synthetic polypeptide
  XENP019021 1G6_H1.276_L1_IgG1_PVA_/S267K Light Chain

SEQ ID NO: 16021 - protein, 107 aa, Artificial Sequence; identical to SEQ ID NO: 6247
  Description of Artificial Sequence: Synthetic polypeptide
  VL of XENP019021

SEQ ID NO: 16022 - protein, 11 aa, Artificial Sequence
  Description of Artificial Sequence: Synthetic peptide
  XENP019021 vlCDR1
RASQSVSNDVA

SEQ ID NO: 16023 - protein, 7 aa, Artificial Sequence
  Description of Artificial Sequence: Synthetic peptide
  XENP019021 vlCDR2
YASHRYT

SEQ ID NO: 16024 - protein, 9 aa, Artificial Sequence
  Description of Artificial Sequence: Synthetic peptide
  XENP019021 vlCDR3
QQDYSSPRT

SEQ ID NO: 16025 - protein, 451 aa, Artificial Sequence
  Description of Artificial Sequence: Synthetic polypeptide
  XENP019022 1G6_H1.277_L1_IgG1_PVA_/S267K Heavy Chain
EVQLVESGGGLVKPGGSLKLSCAASGFTFSNYWMNWVRQAPGKGLEWVGEIRLKSNNYATHYADSVKGRFTISRDDSKSTLYLQMNSLKTEDTAVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16026 - protein, 122 aa, Artificial Sequence; identical to SEQ ID NO: 10347
  Description of Artificial Sequence: Synthetic polypeptide
  VH of XENP019022

SEQ ID NO: 16027 - protein, 5 aa, Artificial Sequence
  Description of Artificial Sequence: Synthetic peptide
  XENP019022 vhCDR1
NYWMN

SEQ ID NO: 16028 - protein, 19 aa, Artificial Sequence
  Description of Artificial Sequence: Synthetic peptide
  XENP019022 vhCDR2
EIRLKSNNYATHYADSVKG

SEQ ID NO: 16029 - protein, 11 aa, Artificial Sequence
  Description of Artificial Sequence: Synthetic peptide
  XENP019022 vhCDR3
YYGNYGGYFDV

SEQ ID NO: 16030 - protein, 214 aa, Artificial Sequence; identical to SEQ ID NO: 11550
  Description of Artificial Sequence: Synthetic polypeptide
  XENP019022 1G6_H1.277_L1_IgG1_PVA_/S267K Light Chain

SEQ ID NO: 16031 - protein, 107 aa, Artificial Sequence; identical to SEQ ID NO: 6247
  Description of Artificial Sequence: Synthetic polypeptide
  VL of XENP019022

SEQ ID NO: 16032 - protein, 11 aa, Artificial Sequence
  Description of Artificial Sequence: Synthetic peptide
  XENP019022 vlCDR1
RASQSVSNDVA

SEQ ID NO: 16033 - protein, 7 aa, Artificial Sequence
  Description of Artificial Sequence: Synthetic peptide
  XENP019022 vlCDR2
YASHRYT

SEQ ID NO: 16034 - protein, 9 aa, Artificial Sequence
  Description of Artificial Sequence: Synthetic peptide
  XENP019022 vlCDR3
QQDYSSPRT

SEQ ID NO: 16035 - protein, 451 aa, Artificial Sequence; identical to SEQ ID NO: 11545
  Description of Artificial Sequence: Synthetic polypeptide
  XENP019023 1G6_H1_L1.146_IgG1_PVA_/S267K Heavy Chain

SEQ ID NO: 16036 - protein, 122 aa, Artificial Sequence; identical to SEQ ID NO: 6246
  Description of Artificial Sequence: Synthetic polypeptide
  VH of XENP019023

SEQ ID NO: 16037 - protein, 5 aa, Artificial Sequence
  Description of Artificial Sequence: Synthetic peptide
  XENP019023 vhCDR1
NYWMN

SEQ ID NO: 16038 - protein, 19 aa, Artificial Sequence
  Description of Artificial Sequence: Synthetic peptide
  XENP019023 vhCDR2
EIRLKSNNYATHYAEPVKG

SEQ ID NO: 16039 - protein, 11 aa, Artificial Sequence
  Description of Artificial Sequence: Synthetic peptide
  XENP019023 vhCDR3
YYGNYGGYFDV

SEQ ID NO: 16040 - protein, 214 aa, Artificial Sequence
  Description of Artificial Sequence: Synthetic polypeptide
  XENP019023 1G6_H1_L1.146_IgG1_PVA_/S267K Light Chain
SIVMTQSPATLAVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16041 - protein, 107 aa, Artificial Sequence; identical to SEQ ID NO: 10357
  Description of Artificial Sequence: Synthetic polypeptide
  VL of XENP019023

SEQ ID NO: 16042 - protein, 11 aa, Artificial Sequence
  Description of Artificial Sequence: Synthetic peptide
  XENP019023 vlCDR1
RASQSVSNDVA

SEQ ID NO: 16043 - protein, 7 aa, Artificial Sequence
  Description of Artificial Sequence: Synthetic peptide
  XENP019023 vlCDR2
YASHRYT

SEQ ID NO: 16044 - protein, 9 aa, Artificial Sequence
  Description of Artificial Sequence: Synthetic peptide
  XENP019023 vlCDR3
QQDYSSPRT

SEQ ID NO: 16045 - protein, 451 aa, Artificial Sequence; identical to SEQ ID NO: 11545
  Description of Artificial Sequence: Synthetic polypeptide
  XENP019024 1G6_H1_L1.147_IgG1_PVA_/S267K Heavy Chain

SEQ ID NO: 16046 - protein, 122 aa, Artificial Sequence; identical to SEQ ID NO: 6246
  Description of Artificial Sequence: Synthetic polypeptide
  VH of XENP019024

SEQ ID NO: 16047 - protein, 5 aa, Artificial Sequence
  Description of Artificial Sequence: Synthetic peptide
  XENP019024 vhCDR1
NYWMN

SEQ ID NO: 16048 - protein, 19 aa, Artificial Sequence
  Description of Artificial Sequence: Synthetic peptide
  XENP019024 vhCDR2
EIRLKSNNYATHYAEPVKG

SEQ ID NO: 16049 - protein, 11 aa, Artificial Sequence
  Description of Artificial Sequence: Synthetic peptide
  XENP019024 vhCDR3
YYGNYGGYFDV

SEQ ID NO: 16050 - protein, 214 aa, Artificial Sequence
  Description of Artificial Sequence: Synthetic polypeptide
  XENP019024 1G6_H1_L1.147_IgG1_PVA_/S267K Light Chain
SIVMTQSPATLPVSPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16051 - protein, 107 aa, Artificial Sequence; identical to SEQ ID NO: 10366
  Description of Artificial Sequence: Synthetic polypeptide
  VL of XENP019024

SEQ ID NO: 16052 - protein, 11 aa, Artificial Sequence
  Description of Artificial Sequence: Synthetic peptide
  XENP019024 vlCDR1
RASQSVSNDVA

SEQ ID NO: 16053 - protein, 7 aa, Artificial Sequence
  Description of Artificial Sequence: Synthetic peptide
  XENP019024 vlCDR2
YASHRYT

SEQ ID NO: 16054 - protein, 9 aa, Artificial Sequence
  Description of Artificial Sequence: Synthetic peptide
  XENP019024 vlCDR3
QQDYSSPRT

SEQ ID NO: 16055 - protein, 451 aa, Artificial Sequence; identical to SEQ ID NO: 11545
  Description of Artificial Sequence: Synthetic polypeptide
  XENP019025 1G6_H1_L1.148_IgG1_PVA_/S267K Heavy Chain

SEQ ID NO: 16056 - protein, 122 aa, Artificial Sequence; identical to SEQ ID NO: 6246
  Description of Artificial Sequence: Synthetic polypeptide
  VH of XENP019025

SEQ ID NO: 16057 - protein, 5 aa, Artificial Sequence
  Description of Artificial Sequence: Synthetic peptide
  XENP019025 vhCDR1
NYWMN

SEQ ID NO: 16058 - protein, 19 aa, Artificial Sequence
  Description of Artificial Sequence: Synthetic peptide
  XENP019025 vhCDR2
EIRLKSNNYATHYAEPVKG

SEQ ID NO: 16059 - protein, 11 aa, Artificial Sequence
  Description of Artificial Sequence: Synthetic peptide
  XENP019025 vhCDR3
YYGNYGGYFDV

SEQ ID NO: 16060 - protein, 214 aa, Artificial Sequence
  Description of Artificial Sequence: Synthetic polypeptide
  XENP019025 1G6_H1_L1.148_IgG1_PVA_/S267K Light Chain
SIVMTQSPATLSASPGERATLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16061 - protein, 107 aa, Artificial Sequence; identical to SEQ ID NO: 10375
  Description of Artificial Sequence: Synthetic polypeptide
  VL of XENP019025

SEQ ID NO: 16062 - protein, 11 aa, Artificial Sequence
  Description of Artificial Sequence: Synthetic peptide
  XENP019025 vlCDR1
RASQSVSNDVA

SEQ ID NO: 16063 - protein, 7 aa, Artificial Sequence
  Description of Artificial Sequence: Synthetic peptide
  XENP019025 vlCDR2
YASHRYT

SEQ ID NO: 16064 - protein, 9 aa, Artificial Sequence
  Description of Artificial Sequence: Synthetic peptide
  XENP019025 vlCDR3
QQDYSSPRT

SEQ ID NO: 16065 - protein, 451 aa, Artificial Sequence; identical to SEQ ID NO: 11545
  Description of Artificial Sequence: Synthetic polypeptide
  XENP019026 1G6_H1_L1.149_IgG1_PVA_/S267K Heavy Chain

SEQ ID NO: 16066 - protein, 122 aa, Artificial Sequence; identical to SEQ ID NO: 6246
  Description of Artificial Sequence: Synthetic polypeptide
  VH of XENP019026

SEQ ID NO: 16067 - protein, 5 aa, Artificial Sequence
  Description of Artificial Sequence: Synthetic peptide
  XENP019026 vhCDR1
NYWMN

SEQ ID NO: 16068 - protein, 19 aa, Artificial Sequence
  Description of Artificial Sequence: Synthetic peptide
  XENP019026 vhCDR2
EIRLKSNNYATHYAEPVKG

SEQ ID NO: 16069 - protein, 11 aa, Artificial Sequence
  Description of Artificial Sequence: Synthetic peptide
  XENP019026 vhCDR3
YYGNYGGYFDV

SEQ ID NO: 16070 - protein, 214 aa, Artificial Sequence
  Description of Artificial Sequence: Synthetic polypeptide
  XENP019026 1G6_H1_L1.149_IgG1_PVA_/S267K Light Chain
SIVMTQSPATLSVSPGERASLSCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16071 - protein, 107 aa, Artificial Sequence; identical to SEQ ID NO: 10384
  Description of Artificial Sequence: Synthetic polypeptide
  VL of XENP019026

SEQ ID NO: 16072 - protein, 11 aa, Artificial Sequence
  Description of Artificial Sequence: Synthetic peptide
  XENP019026 vlCDR1
RASQSVSNDVA

SEQ ID NO: 16073 - protein, 7 aa, Artificial Sequence
  Description of Artificial Sequence: Synthetic peptide
  XENP019026 vlCDR2
YASHRYT

SEQ ID NO: 16074 - protein, 9 aa, Artificial Sequence
  Description of Artificial Sequence: Synthetic peptide
  XENP019026 vlCDR3
QQDYSSPRT

SEQ ID NO: 16075 - protein, 451 aa, Artificial Sequence; identical to SEQ ID NO: 11545
  Description of Artificial Sequence: Synthetic polypeptide
  XENP019027 1G6_H1_L1.150_IgG1_PVA_/S267K Heavy Chain

SEQ ID NO: 16076 - protein, 122 aa, Artificial Sequence; identical to SEQ ID NO: 6246
  Description of Artificial Sequence: Synthetic polypeptide
  VH of XENP019027

SEQ ID NO: 16077 - protein, 5 aa, Artificial Sequence
  Description of Artificial Sequence: Synthetic peptide
  XENP019027 vhCDR1
NYWMN

SEQ ID NO: 16078 - protein, 19 aa, Artificial Sequence
  Description of Artificial Sequence: Synthetic peptide
  XENP019027 vhCDR2
EIRLKSNNYATHYAEPVKG

SEQ ID NO: 16079 - protein, 11 aa, Artificial Sequence
  Description of Artificial Sequence: Synthetic peptide
  XENP019027 vhCDR3
YYGNYGGYFDV

SEQ ID NO: 16080 - protein, 214 aa, Artificial Sequence
  Description of Artificial Sequence: Synthetic polypeptide
  XENP019027 1G6_H1_L1.150_IgG1_PVA_/S267K Light Chain
SIVMTQSPATLSVSPGERATLKCRASQSVSNDVAWYQQKPGQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16081 - protein, 107 aa, Artificial Sequence; identical to SEQ ID NO: 10393
  Description of Artificial Sequence: Synthetic polypeptide
  VL of XENP019027

SEQ ID NO: 16082 - protein, 11 aa, Artificial Sequence
  Description of Artificial Sequence: Synthetic peptide
  XENP019027 vlCDR1
RASQSVSNDVA

SEQ ID NO: 16083 - protein, 7 aa, Artificial Sequence
  Description of Artificial Sequence: Synthetic peptide
  XENP019027 vlCDR2
YASHRYT

SEQ ID NO: 16084 - protein, 9 aa, Artificial Sequence
  Description of Artificial Sequence: Synthetic peptide
  XENP019027 vlCDR3
QQDYSSPRT

SEQ ID NO: 16085 - protein, 451 aa, Artificial Sequence; identical to SEQ ID NO: 11545
  Description of Artificial Sequence: Synthetic polypeptide
  XENP019028 1G6_H1_L1.151_IgG1_PVA_/S267K Heavy Chain

SEQ ID NO: 16086 - protein, 122 aa, Artificial Sequence; identical to SEQ ID NO: 6246
  Description of Artificial Sequence: Synthetic polypeptide
  VH of XENP019028

SEQ ID NO: 16087 - protein, 5 aa, Artificial Sequence
  Description of Artificial Sequence: Synthetic peptide
  XENP019028 vhCDR1
NYWMN

SEQ ID NO: 16088 - protein, 19 aa, Artificial Sequence
  Description of Artificial Sequence: Synthetic peptide
  XENP019028 vhCDR2
EIRLKSNNYATHYAEPVKG

SEQ ID NO: 16089 - protein, 11 aa, Artificial Sequence
  Description of Artificial Sequence: Synthetic peptide
  XENP019028 vhCDR3
YYGNYGGYFDV

SEQ ID NO: 16090 - protein, 214 aa, Artificial Sequence
  Description of Artificial Sequence: Synthetic polypeptide
  XENP019028 1G6_H1_L1.151_IgG1_PVA_/S267K Light Chain
SIVMTQSPATLSVSPGERATLSCRASQSVSNDVAWYQQKPEQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16091 - protein, 107 aa, Artificial Sequence; identical to SEQ ID NO: 10402
  Description of Artificial Sequence: Synthetic polypeptide
  VL of XENP019028

SEQ ID NO: 16092 - protein, 11 aa, Artificial Sequence
  Description of Artificial Sequence: Synthetic peptide
  XENP019028 vlCDR1
RASQSVSNDVA

SEQ ID NO: 16093 - protein, 7 aa, Artificial Sequence
  Description of Artificial Sequence: Synthetic peptide
  XENP019028 vlCDR2
YASHRYT

SEQ ID NO: 16094 - protein, 9 aa, Artificial Sequence
  Description of Artificial Sequence: Synthetic peptide
  XENP019028 vlCDR3
QQDYSSPRT

SEQ ID NO: 16095 - protein, 451 aa, Artificial Sequence; identical to SEQ ID NO: 11545
  Description of Artificial Sequence: Synthetic polypeptide
  XENP019029 1G6_H1_L1.152_IgG1_PVA_/S267K Heavy Chain

SEQ ID NO: 16096 - protein, 122 aa, Artificial Sequence; identical to SEQ ID NO: 6246
  Description of Artificial Sequence: Synthetic polypeptide
  VH of XENP019029

SEQ ID NO: 16097 - protein, 5 aa, Artificial Sequence
  Description of Artificial Sequence: Synthetic peptide
  XENP019029 vhCDR1
NYWMN

SEQ ID NO: 16098 - protein, 19 aa, Artificial Sequence
  Description of Artificial Sequence: Synthetic peptide
  XENP019029 vhCDR2
EIRLKSNNYATHYAEPVKG

SEQ ID NO: 16099 - protein, 11 aa, Artificial Sequence
  Description of Artificial Sequence: Synthetic peptide
  XENP019029 vhCDR3
YYGNYGGYFDV

SEQ ID NO: 16100 - protein, 214 aa, Artificial Sequence
  Description of Artificial Sequence: Synthetic polypeptide
  XENP019029 1G6_H1_L1.152_IgG1_PVA_/S267K Light Chain
SIVMTQSPATLSVSPGERATLSCRASQSVSNDVAWYQQKPGESPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16101 - protein, 107 aa, Artificial Sequence; identical to SEQ ID NO: 10411
  Description of Artificial Sequence: Synthetic polypeptide
  VL of XENP019029

SEQ ID NO: 16102 - protein, 11 aa, Artificial Sequence
  Description of Artificial Sequence: Synthetic peptide
  XENP019029 vlCDR1
RASQSVSNDVA

SEQ ID NO: 16103 - protein, 7 aa, Artificial Sequence
  Description of Artificial Sequence: Synthetic peptide
  XENP019029 vlCDR2
YASHRYT

SEQ ID NO: 16104 - protein, 9 aa, Artificial Sequence
  Description of Artificial Sequence: Synthetic peptide
  XENP019029 vlCDR3
QQDYSSPRT

SEQ ID NO: 16105 - protein, 451 aa, Artificial Sequence; identical to SEQ ID NO: 11545
  Description of Artificial Sequence: Synthetic polypeptide
  XENP019030 1G6_H1_L1.153_IgG1_PVA_/S267K Heavy Chain

SEQ ID NO: 16106 - protein, 122 aa, Artificial Sequence; identical to SEQ ID NO: 6246
  Description of Artificial Sequence: Synthetic polypeptide
  VH of XENP019030

SEQ ID NO: 16107 - protein, 5 aa, Artificial Sequence
  Description of Artificial Sequence: Synthetic peptide
  XENP019030 vhCDR1
NYWMN

SEQ ID NO: 16108 - protein, 19 aa, Artificial Sequence
  Description of Artificial Sequence: Synthetic peptide
  XENP019030 vhCDR2
EIRLKSNNYATHYAEPVKG

SEQ ID NO: 16109 - protein, 11 aa, Artificial Sequence
  Description of Artificial Sequence: Synthetic peptide
  XENP019030 vhCDR3
YYGNYGGYFDV

SEQ ID NO: 16110 - protein, 214 aa, Artificial Sequence
  Description of Artificial Sequence: Synthetic polypeptide
  XENP019030 1G6_H1_L1.153_IgG1_PVA_/S267K Light Chain
SIVMTQSPATLSVSPGERATLSCRASQSVSNDVAWYQQKPGQSPRVLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16111 - protein, 107 aa, Artificial Sequence; identical to SEQ ID NO: 10420
  Description of Artificial Sequence: Synthetic polypeptide
  VL of XENP019030

SEQ ID NO: 16112 - protein, 11 aa, Artificial Sequence
  Description of Artificial Sequence: Synthetic peptide
  XENP019030 vlCDR1
RASQSVSNDVA

SEQ ID NO: 16113 - protein, 7 aa, Artificial Sequence
  Description of Artificial Sequence: Synthetic peptide
  XENP019030 vlCDR2
YASHRYT

SEQ ID NO: 16114 - protein, 9 aa, Artificial Sequence
  Description of Artificial Sequence: Synthetic peptide
  XENP019030 vlCDR3
QQDYSSPRT

SEQ ID NO: 16115 - protein, 451 aa, Artificial Sequence; identical to SEQ ID NO: 11545
  Description of Artificial Sequence: Synthetic polypeptide
  XENP019031 1G6_H1_L1.154_IgG1_PVA_/S267K Heavy Chain

SEQ ID NO: 16116 - protein, 122 aa, Artificial Sequence; identical to SEQ ID NO: 6246
  Description of Artificial Sequence: Synthetic polypeptide
  VH of XENP019031

SEQ ID NO: 16117 - protein, 5 aa, Artificial Sequence
  Description of Artificial Sequence: Synthetic peptide
  XENP019031 vhCDR1
NYWMN

SEQ ID NO: 16118 - protein, 19 aa, Artificial Sequence
  Description of Artificial Sequence: Synthetic peptide
  XENP019031 vhCDR2
EIRLKSNNYATHYAEPVKG

SEQ ID NO: 16119 - protein, 11 aa, Artificial Sequence
  Description of Artificial Sequence: Synthetic peptide
  XENP019031 vhCDR3
YYGNYGGYFDV

SEQ ID NO: 16120 - protein, 214 aa, Artificial Sequence
  Description of Artificial Sequence: Synthetic polypeptide
  XENP019031 1G6_H1_L1.154_IgG1_PVA_/S267K Light Chain
SIVMTQSPATLSVSPGERATLSCRASQSVSNDVAWYQQKPGQSPRLLVNYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16121 - protein, 107 aa, Artificial Sequence; identical to SEQ ID NO: 10429
  Description of Artificial Sequence: Synthetic polypeptide
  VL of XENP019031

SEQ ID NO: 16122 - protein, 11 aa, Artificial Sequence
  Description of Artificial Sequence: Synthetic peptide
  XENP019031 vlCDR1
RASQSVSNDVA

SEQ ID NO: 16123 - protein, 7 aa, Artificial Sequence
  Description of Artificial Sequence: Synthetic peptide
  XENP019031 vlCDR2
YASHRYT

SEQ ID NO: 16124 - protein, 9 aa, Artificial Sequence
  Description of Artificial Sequence: Synthetic peptide
  XENP019031 vlCDR3
QQDYSSPRT

SEQ ID NO: 16125 - protein, 451 aa, Artificial Sequence; identical to SEQ ID NO: 11545
  Description of Artificial Sequence: Synthetic polypeptide
  XENP019032 1G6_H1_L1.155_IgG1_PVA_/S267K Heavy Chain

SEQ ID NO: 16126 - protein, 122 aa, Artificial Sequence; identical to SEQ ID NO: 6246
  Description of Artificial Sequence: Synthetic polypeptide
  VH of XENP019032

SEQ ID NO: 16127 - protein, 5 aa, Artificial Sequence
  Description of Artificial Sequence: Synthetic peptide
  XENP019032 vhCDR1
NYWMN

SEQ ID NO: 16128 - protein, 19 aa, Artificial Sequence
  Description of Artificial Sequence: Synthetic peptide
  XENP019032 vhCDR2
EIRLKSNNYATHYAEPVKG

SEQ ID NO: 16129 - protein, 11 aa, Artificial Sequence
  Description of Artificial Sequence: Synthetic peptide
  XENP019032 vhCDR3
YYGNYGGYFDV

SEQ ID NO: 16130 - protein, 214 aa, Artificial Sequence
  Description of Artificial Sequence: Synthetic polypeptide
  XENP019032 1G6_H1_L1.155_IgG1_PVA_/S267K Light Chain
SIVMTQSPATLSVSPGERATLSCRASQSVSNDVAWYQQKPGQSPRLLINYANHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16131 - protein, 107 aa, Artificial Sequence; identical to SEQ ID NO: 10438
  Description of Artificial Sequence: Synthetic polypeptide
  VL of XENP019032

SEQ ID NO: 16132 - protein, 11 aa, Artificial Sequence
  Description of Artificial Sequence: Synthetic peptide
  XENP019032 vlCDR1
RASQSVSNDVA

SEQ ID NO: 16133 - protein, 7 aa, Artificial Sequence
  Description of Artificial Sequence: Synthetic peptide
  XENP019032 vlCDR2
YANHRYT

SEQ ID NO: 16134 - protein, 9 aa, Artificial Sequence
  Description of Artificial Sequence: Synthetic peptide
  XENP019032 vlCDR3
QQDYSSPRT

SEQ ID NO: 16135 - protein, 451 aa, Artificial Sequence; identical to SEQ ID NO: 11545
  Description of Artificial Sequence: Synthetic polypeptide
  XENP019033 1G6_H1_L1.156_IgG1_PVA_/S267K Heavy Chain

SEQ ID NO: 16136 - protein, 122 aa, Artificial Sequence; identical to SEQ ID NO: 6246
  Description of Artificial Sequence: Synthetic polypeptide
  VH of XENP019033

SEQ ID NO: 16137 - protein, 5 aa, Artificial Sequence
  Description of Artificial Sequence: Synthetic peptide
  XENP019033 vhCDR1
NYWMN

SEQ ID NO: 16138 - protein, 19 aa, Artificial Sequence
  Description of Artificial Sequence: Synthetic peptide
  XENP019033 vhCDR2
EIRLKSNNYATHYAEPVKG

SEQ ID NO: 16139 - protein, 11 aa, Artificial Sequence
  Description of Artificial Sequence: Synthetic peptide
  XENP019033 vhCDR3
YYGNYGGYFDV

SEQ ID NO: 16140 - protein, 214 aa, Artificial Sequence
  Description of Artificial Sequence: Synthetic polypeptide
  XENP019033 1G6_H1_L1.156_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLESEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16141 - protein, 107 aa, Artificial Sequence; identical to SEQ ID NO: 10447
  Description of Artificial Sequence: Synthetic polypeptide
  VL of XENP019033

SEQ ID NO: 16142 - protein, 11 aa, Artificial Sequence
  Description of Artificial Sequence: Synthetic peptide
  XENP019033 vlCDR1
RASQSVSNDVA

SEQ ID NO: 16143 - protein, 7 aa, Artificial Sequence
  Description of Artificial Sequence: Synthetic peptide
  XENP019033 vlCDR2
YASHRYT

SEQ ID NO: 16144 - protein, 9 aa, Artificial Sequence
  Description of Artificial Sequence: Synthetic peptide
  XENP019033 vlCDR3
QQDYSSPRT

SEQ ID NO: 16145 - protein, 451 aa, Artificial Sequence; identical to SEQ ID NO: 11545
  Description of Artificial Sequence: Synthetic polypeptide
  XENP019034 1G6_H1_L1.157_IgG1_PVA_/S267K Heavy Chain

SEQ ID NO: 16146 - protein, 122 aa, Artificial Sequence; identical to SEQ ID NO: 6246
  Description of Artificial Sequence: Synthetic polypeptide
  VH of XENP019034

SEQ ID NO: 16147 - protein, 5 aa, Artificial Sequence
  Description of Artificial Sequence: Synthetic peptide
  XENP019034 vhCDR1
NYWMN

SEQ ID NO: 16148 - protein, 19 aa, Artificial Sequence
  Description of Artificial Sequence: Synthetic peptide
  XENP019034 vhCDR2
EIRLKSNNYATHYAEPVKG

SEQ ID NO: 16149 - protein, 11 aa, Artificial Sequence
  Description of Artificial Sequence: Synthetic peptide
  XENP019034 vhCDR3
YYGNYGGYFDV

SEQ ID NO: 16150 - protein, 214 aa, Artificial Sequence
  Description of Artificial Sequence: Synthetic polypeptide
  XENP019034 1G6_H1_L1.157_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLKSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16151 - protein, 107 aa, Artificial Sequence; identical to SEQ ID NO: 10456
  Description of Artificial Sequence: Synthetic polypeptide
  VL of XENP019034

SEQ ID NO: 16152 - protein, 11 aa, Artificial Sequence
  Description of Artificial Sequence: Synthetic peptide
  XENP019034 vlCDR1
RASQSVSNDVA

SEQ ID NO: 16153 - protein, 7 aa, Artificial Sequence
  Description of Artificial Sequence: Synthetic peptide
  XENP019034 vlCDR2
YASHRYT

SEQ ID NO: 16154 - protein, 9 aa, Artificial Sequence
  Description of Artificial Sequence: Synthetic peptide
  XENP019034 vlCDR3
QQDYSSPRT

SEQ ID NO: 16155 - protein, 451 aa, Artificial Sequence; identical to SEQ ID NO: 11545
  Description of Artificial Sequence: Synthetic polypeptide
  XENP019035 1G6_H1_L1.158_IgG1_PVA_/S267K Heavy Chain

SEQ ID NO: 16156 - protein, 122 aa, Artificial Sequence; identical to SEQ ID NO: 6246
  Description of Artificial Sequence: Synthetic polypeptide
  VH of XENP019035

SEQ ID NO: 16157 - protein, 5 aa, Artificial Sequence
  Description of Artificial Sequence: Synthetic peptide
  XENP019035 vhCDR1
NYWMN

SEQ ID NO: 16158 - protein, 19 aa, Artificial Sequence
  Description of Artificial Sequence: Synthetic peptide
  XENP019035 vhCDR2
EIRLKSNNYATHYAEPVKG

SEQ ID NO: 16159 - protein, 11 aa, Artificial Sequence
  Description of Artificial Sequence: Synthetic peptide
  XENP019035 vhCDR3
YYGNYGGYFDV

SEQ ID NO: 16160 - protein, 214 aa, Artificial Sequence
  Description of Artificial Sequence: Synthetic polypeptide
  XENP019035 1G6_H1_L1.158_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFGVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16161 - protein, 107 aa, Artificial Sequence; identical to SEQ ID NO: 10465
  Description of Artificial Sequence: Synthetic polypeptide
  VL of XENP019035

SEQ ID NO: 16162 - protein, 11 aa, Artificial Sequence
  Description of Artificial Sequence: Synthetic peptide
  XENP019035 vlCDR1
RASQSVSNDVA

SEQ ID NO: 16163 - protein, 7 aa, Artificial Sequence
  Description of Artificial Sequence: Synthetic peptide
  XENP019035 vlCDR2
YASHRYT

SEQ ID NO: 16164 - protein, 9 aa, Artificial Sequence
  Description of Artificial Sequence: Synthetic peptide
  XENP019035 vlCDR3
QQDYSSPRT

SEQ ID NO: 16165 - protein, 451 aa, Artificial Sequence; identical to SEQ ID NO: 11545
  Description of Artificial Sequence: Synthetic polypeptide
  XENP019036 1G6_H1_L1.159_IgG1_PVA_/S267K Heavy Chain

SEQ ID NO: 16166 - protein, 122 aa, Artificial Sequence; identical to SEQ ID NO: 6246
  Description of Artificial Sequence: Synthetic polypeptide
  VH of XENP019036

SEQ ID NO: 16167 - protein, 5 aa, Artificial Sequence
  Description of Artificial Sequence: Synthetic peptide
  XENP019036 vhCDR1
NYWMN

SEQ ID NO: 16168 - protein, 19 aa, Artificial Sequence
  Description of Artificial Sequence: Synthetic peptide
  XENP019036 vhCDR2
EIRLKSNNYATHYAEPVKG

SEQ ID NO: 16169 - protein, 11 aa, Artificial Sequence
  Description of Artificial Sequence: Synthetic peptide
  XENP019036 vhCDR3
YYGNYGGYFDV

SEQ ID NO: 16170 - protein, 214 aa, Artificial Sequence
  Description of Artificial Sequence: Synthetic polypeptide
  XENP019036 1G6_H1_L1.159_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCKQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16171 - protein, 107 aa, Artificial Sequence; identical to SEQ ID NO: 10474
  Description of Artificial Sequence: Synthetic polypeptide
  VL of XENP019036

SEQ ID NO: 16172 - protein, 11 aa, Artificial Sequence
  Description of Artificial Sequence: Synthetic peptide
  XENP019036 vlCDR1
RASQSVSNDVA

SEQ ID NO: 16173 - protein, 7 aa, Artificial Sequence
  Description of Artificial Sequence: Synthetic peptide
  XENP019036 vlCDR2
YASHRYT

SEQ ID NO: 16174 - protein, 9 aa, Artificial Sequence
  Description of Artificial Sequence: Synthetic peptide
  XENP019036 vlCDR3
KQDYSSPRT

SEQ ID NO: 16175 - protein, 451 aa, Artificial Sequence; identical to SEQ ID NO: 11545
  Description of Artificial Sequence: Synthetic polypeptide
  XENP019037 1G6_H1_L1.160_IgG1_PVA_/S267K Heavy Chain

SEQ ID NO: 16176 - protein, 122 aa, Artificial Sequence; identical to SEQ ID NO: 6246
  Description of Artificial Sequence: Synthetic polypeptide
  VH of XENP019037

SEQ ID NO: 16177 - protein, 5 aa, Artificial Sequence
  Description of Artificial Sequence: Synthetic peptide
  XENP019037 vhCDR1
NYWMN

SEQ ID NO: 16178 - protein, 19 aa, Artificial Sequence
  Description of Artificial Sequence: Synthetic peptide
  XENP019037 vhCDR2
EIRLKSNNYATHYAEPVKG

SEQ ID NO: 16179 - protein, 11 aa, Artificial Sequence
  Description of Artificial Sequence: Synthetic peptide
  XENP019037 vhCDR3
YYGNYGGYFDV

SEQ ID NO: 16180 - protein, 214 aa, Artificial Sequence
  Description of Artificial Sequence: Synthetic polypeptide
  XENP019037 1G6_H1_L1.160_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQKDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16181 - protein, 107 aa, Artificial Sequence; identical to SEQ ID NO: 10483
  Description of Artificial Sequence: Synthetic polypeptide
  VL of XENP019037

SEQ ID NO: 16182 - protein, 11 aa, Artificial Sequence
  Description of Artificial Sequence: Synthetic peptide
  XENP019037 vlCDR1
RASQSVSNDVA

SEQ ID NO: 16183 - protein, 7 aa, Artificial Sequence
  Description of Artificial Sequence: Synthetic peptide
  XENP019037 vlCDR2
YASHRYT

SEQ ID NO: 16184 - protein, 9 aa, Artificial Sequence
  Description of Artificial Sequence: Synthetic peptide
  XENP019037 vlCDR3
QKDYSSPRT

SEQ ID NO: 16185 - protein, 451 aa, Artificial Sequence; identical to SEQ ID NO: 11545
  Description of Artificial Sequence: Synthetic polypeptide
  XENP019038 1G6_H1_L1.161_IgG1_PVA_/S267K Heavy Chain

SEQ ID NO: 16186 - protein, 122 aa, Artificial Sequence; identical to SEQ ID NO: 6246
  Description of Artificial Sequence: Synthetic polypeptide
  VH of XENP019038

SEQ ID NO: 16187 - protein, 5 aa, Artificial Sequence
  Description of Artificial Sequence: Synthetic peptide
  XENP019038 vhCDR1
NYWMN

SEQ ID NO: 16188 - protein, 19 aa, Artificial Sequence
  Description of Artificial Sequence: Synthetic peptide
  XENP019038 vhCDR2
EIRLKSNNYATHYAEPVKG

SEQ ID NO: 16189 - protein, 11 aa, Artificial Sequence
  Description of Artificial Sequence: Synthetic peptide
  XENP019038 vhCDR3
YYGNYGGYFDV

SEQ ID NO: 16190 - protein, 214 aa, Artificial Sequence
  Description of Artificial Sequence: Synthetic polypeptide
  XENP019038 1G6_H1_L1.161_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQNDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16191 - protein, 107 aa, Artificial Sequence; identical to SEQ ID NO: 10492
  Description of Artificial Sequence: Synthetic polypeptide
  VL of XENP019038

SEQ ID NO: 16192 - protein, 11 aa, Artificial Sequence
  Description of Artificial Sequence: Synthetic peptide
  XENP019038 vlCDR1
RASQSVSNDVA

SEQ ID NO: 16193 - protein, 7 aa, Artificial Sequence
  Description of Artificial Sequence: Synthetic peptide
  XENP019038 vlCDR2
YASHRYT

SEQ ID NO: 16194 - protein, 9 aa, Artificial Sequence
  Description of Artificial Sequence: Synthetic peptide
  XENP019038 vlCDR3
QNDYSSPRT

SEQ ID NO: 16195 - protein, 451 aa, Artificial Sequence; identical to SEQ ID NO: 11545
  Description of Artificial Sequence: Synthetic polypeptide
  XENP019039 1G6_H1_L1.162_IgG1_PVA_/S267K Heavy Chain

SEQ ID NO: 16196 - protein, 122 aa, Artificial Sequence; identical to SEQ ID NO: 6246
  Description of Artificial Sequence: Synthetic polypeptide
  VH of XENP019039

SEQ ID NO: 16197 - protein, 5 aa, Artificial Sequence
  Description of Artificial Sequence: Synthetic peptide
  XENP019039 vhCDR1
NYWMN

SEQ ID NO: 16198 - protein, 19 aa, Artificial Sequence
  Description of Artificial Sequence: Synthetic peptide
  XENP019039 vhCDR2
EIRLKSNNYATHYAEPVKG

SEQ ID NO: 16199 - protein, 11 aa, Artificial Sequence
  Description of Artificial Sequence: Synthetic peptide
  XENP019039 vhCDR3
YYGNYGGYFDV

SEQ ID NO: 16200 - protein, 214 aa, Artificial Sequence
  Description of Artificial Sequence: Synthetic polypeptide
  XENP019039 1G6_H1_L1.162_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQRDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16201 - protein, 107 aa, Artificial Sequence; identical to SEQ ID NO: 10501
  Description of Artificial Sequence: Synthetic polypeptide
  VL of XENP019039

SEQ ID NO: 16202 - protein, 11 aa, Artificial Sequence
  Description of Artificial Sequence: Synthetic peptide
  XENP019039 vlCDR1
RASQSVSNDVA

SEQ ID NO: 16203 - protein, 7 aa, Artificial Sequence
  Description of Artificial Sequence: Synthetic peptide
  XENP019039 vlCDR2
YASHRYT

SEQ ID NO: 16204 - protein, 9 aa, Artificial Sequence
  Description of Artificial Sequence: Synthetic peptide
  XENP019039 vlCDR3
QRDYSSPRT

SEQ ID NO: 16205 - protein, 451 aa, Artificial Sequence; identical to SEQ ID NO: 11545
  Description of Artificial Sequence: Synthetic polypeptide
  XENP019040 1G6_H1_L1.163_IgG1_PVA_/S267K Heavy Chain

SEQ ID NO: 16206 - protein, 122 aa, Artificial Sequence; identical to SEQ ID NO: 6246
  Description of Artificial Sequence: Synthetic polypeptide
  VH of XENP019040

SEQ ID NO: 16207 - protein, 5 aa, Artificial Sequence
  Description of Artificial Sequence: Synthetic peptide
  XENP019040 vhCDR1
NYWMN

SEQ ID NO: 16208 - protein, 19 aa, Artificial Sequence
  Description of Artificial Sequence: Synthetic peptide
  XENP019040 vhCDR2
EIRLKSNNYATHYAEPVKG

SEQ ID NO: 16209 - protein, 11 aa, Artificial Sequence
  Description of Artificial Sequence: Synthetic peptide
  XENP019040 vhCDR3
YYGNYGGYFDV

SEQ ID NO: 16210 - protein, 214 aa, Artificial Sequence
  Description of Artificial Sequence: Synthetic polypeptide
  XENP019040 1G6_H1_L1.163_IgG1_PVA_/S267K Light Chain
SIVMTQSPATLSVSPGEPATLSCRASQSVSNDVAWYQQKPGQSPRLLINYASHRYTGVPDRFTGSGYGTEFTLTISRLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16211 - protein, 107 aa, Artificial Sequence; identical to SEQ ID NO: 10510
  Description of Artificial Sequence: Synthetic polypeptide
  VL of XENP019040

SEQ ID NO: 16212 - protein, 11 aa, Artificial Sequence
  Description of Artificial Sequence: Synthetic peptide
  XENP019040 vlCDR1
RASQSVSNDVA

SEQ ID NO: 16213 - protein, 7 aa, Artificial Sequence
  Description of Artificial Sequence: Synthetic peptide
  XENP019040 vlCDR2
YASHRYT

SEQ ID NO: 16214 - protein, 9 aa, Artificial Sequence
  Description of Artificial Sequence: Synthetic peptide
  XENP019040 vlCDR3
QQDYSSPRT

SEQ ID NO: 16215 - protein, 451 aa, Artificial Sequence; identical to SEQ ID NO: 11545
  Description of Artificial Sequence: Synthetic polypeptide
  XENP019041 1G6_H1_L1.164_IgG1_PVA_/S267K Heavy Chain

SEQ ID NO: 16216 - protein, 122 aa, Artificial Sequence; identical to SEQ ID NO: 6246
  Description of Artificial Sequence: Synthetic polypeptide
  VH of XENP019041

SEQ ID NO: 16217 - protein, 5 aa, Artificial Sequence
  Description of Artificial Sequence: Synthetic peptide
  XENP019041 vhCDR1
NYWMN

SEQ ID NO: 16218 - protein, 19 aa, Artificial Sequence
  Description of Artificial Sequence: Synthetic peptide
  XENP019041 vhCDR2
EIRLKSNNYATHYAEPVKG

SEQ ID NO: 16219 - protein, 11 aa, Artificial Sequence
  Description of Artificial Sequence: Synthetic peptide
  XENP019041 vhCDR3
YYGNYGGYFDV

SEQ ID NO: 16220 - protein, 214 aa, Artificial Sequence
  Description of Artificial Sequence: Synthetic polypeptide
  XENP019041 1G6_H1_L1.164_IgG1_PVA_/S267K Light Chain
SIVMTQSPATLSVSPGERATLSCRASESVSNDVAWYQQKPGQSPRLLINYASHRYTGVPDRFTGSGYGTEFTLTISSLQSEDFAVYFCQKDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16221 - protein, 107 aa, Artificial Sequence; identical to SEQ ID NO: 10519
  Description of Artificial Sequence: Synthetic polypeptide
  VL of XENP019041

SEQ ID NO: 16222 - protein, 11 aa, Artificial Sequence
  Description of Artificial Sequence: Synthetic peptide
  XENP019041 vlCDR1
RASESVSNDVA

SEQ ID NO: 16223 - protein, 7 aa, Artificial Sequence
  Description of Artificial Sequence: Synthetic peptide
  XENP019041 vlCDR2
YASHRYT

SEQ ID NO: 16224 - protein, 9 aa, Artificial Sequence
  Description of Artificial Sequence: Synthetic peptide
  XENP019041 vlCDR3
QKDYSSPRT

SEQ ID NO: 16225 - protein, 451 aa, Artificial Sequence; identical to SEQ ID NO: 11545
  Description of Artificial Sequence: Synthetic polypeptide
  XENP019042 1G6_H1_L1.165_IgG1_PVA_/S267K Heavy Chain

SEQ ID NO: 16226 - protein, 122 aa, Artificial Sequence; identical to SEQ ID NO: 6246
  Description of Artificial Sequence: Synthetic polypeptide
  VH of XENP019042

SEQ ID NO: 16227 - protein, 5 aa, Artificial Sequence
  Description of Artificial Sequence: Synthetic peptide
  XENP019042 vhCDR1
NYWMN

SEQ ID NO: 16228 - protein, 19 aa, Artificial Sequence
  Description of Artificial Sequence: Synthetic peptide
  XENP019042 vhCDR2
EIRLKSNNYATHYAEPVKG

SEQ ID NO: 16229 - protein, 11 aa, Artificial Sequence
  Description of Artificial Sequence: Synthetic peptide
  XENP019042 vhCDR3
YYGNYGGYFDV

SEQ ID NO: 16230 - protein, 214 aa, Artificial Sequence
  Description of Artificial Sequence: Synthetic polypeptide
  XENP019042 1G6_H1_L1.165_IgG1_PVA_/S267K Light Chain
SIVMTQSPATLSVSPGERATLSCRASESVSNDVAWYQQKPGQSPRLLINYASHRYTGVPDRFTGSGYGTEFTLTISSLQSEDFAVYFCQQDYKSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16231 - protein, 107 aa, Artificial Sequence; identical to SEQ ID NO: 10528
  Description of Artificial Sequence: Synthetic polypeptide
  VL of XENP019042

SEQ ID NO: 16232 - protein, 11 aa, Artificial Sequence
  Description of Artificial Sequence: Synthetic peptide
  XENP019042 vlCDR1
RASESVSNDVA

SEQ ID NO: 16233 - protein, 7 aa, Artificial Sequence
  Description of Artificial Sequence: Synthetic peptide
  XENP019042 vlCDR2
YASHRYT

SEQ ID NO: 16234 - protein, 9 aa, Artificial Sequence
  Description of Artificial Sequence: Synthetic peptide
  XENP019042 vlCDR3
QQDYKSPRT

SEQ ID NO: 16235 - protein, 451 aa, Artificial Sequence; identical to SEQ ID NO: 11545
  Description of Artificial Sequence: Synthetic polypeptide
  XENP019043 1G6_H1_L1.166_IgG1_PVA_/S267K Heavy Chain

SEQ ID NO: 16236 - protein, 122 aa, Artificial Sequence; identical to SEQ ID NO: 6246
  Description of Artificial Sequence: Synthetic polypeptide
  VH of XENP019043

SEQ ID NO: 16237 - protein, 5 aa, Artificial Sequence
  Description of Artificial Sequence: Synthetic peptide
  XENP019043 vhCDR1
NYWMN

SEQ ID NO: 16238 - protein, 19 aa, Artificial Sequence
  Description of Artificial Sequence: Synthetic peptide
  XENP019043 vhCDR2
EIRLKSNNYATHYAEPVKG

SEQ ID NO: 16239 - protein, 11 aa, Artificial Sequence
  Description of Artificial Sequence: Synthetic peptide
  XENP019043 vhCDR3
YYGNYGGYFDV

SEQ ID NO: 16240 - protein, 214 aa, Artificial Sequence
  Description of Artificial Sequence: Synthetic polypeptide
  XENP019043 1G6_H1_L1.166_IgG1_PVA_/S267K Light Chain
SIVMTQSPATLSVSPGERATLSCRASQSVSNDVAWYRQKPEQSPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16241 - protein, 107 aa, Artificial Sequence; identical to SEQ ID NO: 10537
  Description of Artificial Sequence: Synthetic polypeptide
  VL of XENP019043

SEQ ID NO: 16242 - protein, 11 aa, Artificial Sequence
  Description of Artificial Sequence: Synthetic peptide
  XENP019043 vlCDR1
RASQSVSNDVA

SEQ ID NO: 16243 - protein, 7 aa, Artificial Sequence
  Description of Artificial Sequence: Synthetic peptide
  XENP019043 vlCDR2
YASHRYT

SEQ ID NO: 16244 - protein, 9 aa, Artificial Sequence
  Description of Artificial Sequence: Synthetic peptide
  XENP019043 vlCDR3
QQDYSSPRT

SEQ ID NO: 16245 - protein, 451 aa, Artificial Sequence; identical to SEQ ID NO: 11545
  Description of Artificial Sequence: Synthetic polypeptide
  XENP019044 1G6_H1_L1.167_IgG1_PVA_/S267K Heavy Chain

SEQ ID NO: 16246 - protein, 122 aa, Artificial Sequence; identical to SEQ ID NO: 6246
  Description of Artificial Sequence: Synthetic polypeptide
  VH of XENP019044

SEQ ID NO: 16247 - protein, 5 aa, Artificial Sequence
  Description of Artificial Sequence: Synthetic peptide
  XENP019044 vhCDR1
NYWMN

SEQ ID NO: 16248 - protein, 19 aa, Artificial Sequence
  Description of Artificial Sequence: Synthetic peptide
  XENP019044 vhCDR2
EIRLKSNNYATHYAEPVKG

SEQ ID NO: 16249 - protein, 11 aa, Artificial Sequence
  Description of Artificial Sequence: Synthetic peptide
  XENP019044 vhCDR3
YYGNYGGYFDV

SEQ ID NO: 16250 - protein, 214 aa, Artificial Sequence
  Description of Artificial Sequence: Synthetic polypeptide
  XENP019044 1G6_H1_L1.167_IgG1_PVA_/S267K Light Chain
SIVMTQSPATLSVSPGERATLSCRASQSVSNDVAWYRQKPGESPRLLINYASHRYTGVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16251 - protein, 107 aa, Artificial Sequence; identical to SEQ ID NO: 10546
  Description of Artificial Sequence: Synthetic polypeptide
  VL of XENP019044

SEQ ID NO: 16252 - protein, 11 aa, Artificial Sequence
  Description of Artificial Sequence: Synthetic peptide
  XENP019044 vlCDR1
RASQSVSNDVA

SEQ ID NO: 16253 - protein, 7 aa, Artificial Sequence
  Description of Artificial Sequence: Synthetic peptide
  XENP019044 vlCDR2
YASHRYT

SEQ ID NO: 16254 - protein, 9 aa, Artificial Sequence
  Description of Artificial Sequence: Synthetic peptide
  XENP019044 vlCDR3
QQDYSSPRT

SEQ ID NO: 16255 - protein, 451 aa, Artificial Sequence; identical to SEQ ID NO: 11545
  Description of Artificial Sequence: Synthetic polypeptide
  XENP019045 1G6_H1_L1.168_IgG1_PVA_/S267K Heavy Chain

SEQ ID NO: 16256 - protein, 122 aa, Artificial Sequence; identical to SEQ ID NO: 6246
  Description of Artificial Sequence: Synthetic polypeptide
  VH of XENP019045

SEQ ID NO: 16257 - protein, 5 aa, Artificial Sequence
  Description of Artificial Sequence: Synthetic peptide
  XENP019045 vhCDR1
NYWMN

SEQ ID NO: 16258 - protein, 19 aa, Artificial Sequence
  Description of Artificial Sequence: Synthetic peptide
  XENP019045 vhCDR2
EIRLKSNNYATHYAEPVKG

SEQ ID NO: 16259 - protein, 11 aa, Artificial Sequence
  Description of Artificial Sequence: Synthetic peptide
  XENP019045 vhCDR3
YYGNYGGYFDV

SEQ ID NO: 16260 - protein, 214 aa, Artificial Sequence
  Description of Artificial Sequence: Synthetic polypeptide
  XENP019045 1G6_H1_L1.168_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16261 - protein, 107 aa, Artificial Sequence; identical to SEQ ID NO: 10555
  Description of Artificial Sequence: Synthetic polypeptide
  VL of XENP019045

SEQ ID NO: 16262 - protein, 11 aa, Artificial Sequence
  Description of Artificial Sequence: Synthetic peptide
  XENP019045 vlCDR1
RASQSVSNDVA

SEQ ID NO: 16263 - protein, 7 aa, Artificial Sequence
  Description of Artificial Sequence: Synthetic peptide
  XENP019045 vlCDR2
YASWRYT

SEQ ID NO: 16264 - protein, 9 aa, Artificial Sequence
  Description of Artificial Sequence: Synthetic peptide
  XENP019045 vlCDR3
QQDFSSPRT

SEQ ID NO: 16265 - protein, 451 aa, Artificial Sequence; identical to SEQ ID NO: 11545
  Description of Artificial Sequence: Synthetic polypeptide
  XENP019046 1G6_H1_L1.169_IgG1_PVA_/S267K Heavy Chain

SEQ ID NO: 16266 - protein, 122 aa, Artificial Sequence; identical to SEQ ID NO: 6246
  Description of Artificial Sequence: Synthetic polypeptide
  VH of XENP019046

SEQ ID NO: 16267 - protein, 5 aa, Artificial Sequence
  Description of Artificial Sequence: Synthetic peptide
  XENP019046 vhCDR1
NYWMN

SEQ ID NO: 16268 - protein, 19 aa, Artificial Sequence
  Description of Artificial Sequence: Synthetic peptide
  XENP019046 vhCDR2
EIRLKSNNYATHYAEPVKG

SEQ ID NO: 16269 - protein, 11 aa, Artificial Sequence
  Description of Artificial Sequence: Synthetic peptide
  XENP019046 vhCDR3
YYGNYGGYFDV

SEQ ID NO: 16270 - protein, 214 aa, Artificial Sequence
  Description of Artificial Sequence: Synthetic polypeptide
  XENP019046 1G6_H1_L1.169_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16271 - protein, 107 aa, Artificial Sequence; identical to SEQ ID NO: 10564
  Description of Artificial Sequence: Synthetic polypeptide
  VL of XENP019046

SEQ ID NO: 16272 - protein, 11 aa, Artificial Sequence
  Description of Artificial Sequence: Synthetic peptide
  XENP019046 vlCDR1
RASQSVSNDVA

SEQ ID NO: 16273 - protein, 7 aa, Artificial Sequence
  Description of Artificial Sequence: Synthetic peptide
  XENP019046 vlCDR2
YASWRYT

SEQ ID NO: 16274 - protein, 9 aa, Artificial Sequence
  Description of Artificial Sequence: Synthetic peptide
  XENP019046 vlCDR3
QQDWSSPRT

SEQ ID NO: 16275 - protein, 451 aa, Artificial Sequence; identical to SEQ ID NO: 11545
  Description of Artificial Sequence: Synthetic polypeptide
  XENP019047 1G6_H1_L1.170_IgG1_PVA_/S267K Heavy Chain

SEQ ID NO: 16276 - protein, 122 aa, Artificial Sequence; identical to SEQ ID NO: 6246
  Description of Artificial Sequence: Synthetic polypeptide
  VH of XENP019047

SEQ ID NO: 16277 - protein, 5 aa, Artificial Sequence
  Description of Artificial Sequence: Synthetic peptide
  XENP019047 vhCDR1
NYWMN

SEQ ID NO: 16278 - protein, 19 aa, Artificial Sequence
  Description of Artificial Sequence: Synthetic peptide
  XENP019047 vhCDR2
EIRLKSNNYATHYAEPVKG

SEQ ID NO: 16279 - protein, 11 aa, Artificial Sequence
  Description of Artificial Sequence: Synthetic peptide
  XENP019047 vhCDR3
YYGNYGGYFDV

SEQ ID NO: 16280 - protein, 214 aa, Artificial Sequence
  Description of Artificial Sequence: Synthetic polypeptide
  XENP019047 1G6_H1_L1.170_IgG1_PVA_/S267K Light Chain
SIVMTQSPATLSVSPGERATLSCRASQSVSNDVAWYQQKPGQSPRLLINYASWRYTGVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16281 - protein, 107 aa, Artificial Sequence; identical to SEQ ID NO: 10573
  Description of Artificial Sequence: Synthetic polypeptide
  VL of XENP019047

SEQ ID NO: 16282 - protein, 11 aa, Artificial Sequence
  Description of Artificial Sequence: Synthetic peptide
  XENP019047 vlCDR1
RASQSVSNDVA

SEQ ID NO: 16283 - protein, 7 aa, Artificial Sequence
  Description of Artificial Sequence: Synthetic peptide
  XENP019047 vlCDR2
YASWRYT

SEQ ID NO: 16284 - protein, 9 aa, Artificial Sequence
  Description of Artificial Sequence: Synthetic peptide
  XENP019047 vlCDR3
QQDGSSPRT

SEQ ID NO: 16285 - protein, 451 aa, Artificial Sequence; identical to SEQ ID NO: 11545
  Description of Artificial Sequence: Synthetic polypeptide
  XENP019048 1G6_H1_L1.171_IgG1_PVA_/S267K Heavy Chain

SEQ ID NO: 16286 - protein, 122 aa, Artificial Sequence; identical to SEQ ID NO: 6246
  Description of Artificial Sequence: Synthetic polypeptide
  VH of XENP019048

SEQ ID NO: 16287 - protein, 5 aa, Artificial Sequence
  Description of Artificial Sequence: Synthetic peptide
  XENP019048 vhCDR1
NYWMN

SEQ ID NO: 16288 - protein, 19 aa, Artificial Sequence
  Description of Artificial Sequence: Synthetic peptide
  XENP019048 vhCDR2
EIRLKSNNYATHYAEPVKG

SEQ ID NO: 16289 - protein, 11 aa, Artificial Sequence
  Description of Artificial Sequence: Synthetic peptide
  XENP019048 vhCDR3
YYGNYGGYFDV

SEQ ID NO: 16290 - protein, 214 aa, Artificial Sequence
  Description of Artificial Sequence: Synthetic polypeptide
  XENP019048 1G6_H1_L1.171_IgG1_PVA_/S267K Light Chain
SIVMTQSPATLSVSPGERATLSCRASQSVSNDVAWYQQKPGQSPRLLINYASHRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16291 - protein, 107 aa, Artificial Sequence; identical to SEQ ID NO: 10582
  Description of Artificial Sequence: Synthetic polypeptide
  VL of XENP019048

SEQ ID NO: 16292 - protein, 11 aa, Artificial Sequence
  Description of Artificial Sequence: Synthetic peptide
  XENP019048 vlCDR1
RASQSVSNDVA

SEQ ID NO: 16293 - protein, 7 aa, Artificial Sequence
  Description of Artificial Sequence: Synthetic peptide
  XENP019048 vlCDR2
YASHRYT

SEQ ID NO: 16294 - protein, 9 aa, Artificial Sequence
  Description of Artificial Sequence: Synthetic peptide
  XENP019048 vlCDR3
QQDWSSPRT

SEQ ID NO: 16295 - protein, 451 aa, Artificial Sequence; identical to SEQ ID NO: 11545
  Description of Artificial Sequence: Synthetic polypeptide
  XENP019049 1G6_H1_L1.172_IgG1_PVA_/S267K Heavy Chain

SEQ ID NO: 16296 - protein, 122 aa, Artificial Sequence; identical to SEQ ID NO: 6246
  Description of Artificial Sequence: Synthetic polypeptide
  VH of XENP019049

SEQ ID NO: 16297 - protein, 5 aa, Artificial Sequence
  Description of Artificial Sequence: Synthetic peptide
  XENP019049 vhCDR1
NYWMN

SEQ ID NO: 16298 - protein, 19 aa, Artificial Sequence
  Description of Artificial Sequence: Synthetic peptide
  XENP019049 vhCDR2
EIRLKSNNYATHYAEPVKG

SEQ ID NO: 16299 - protein, 11 aa, Artificial Sequence
  Description of Artificial Sequence: Synthetic peptide
  XENP019049 vhCDR3
YYGNYGGYFDV

SEQ ID NO: 16300 - protein, 214 aa, Artificial Sequence
  Description of Artificial Sequence: Synthetic polypeptide
  XENP019049 1G6_H1_L1.172_IgG1_PVA_/S267K Light Chain
SIVMTQSPATLSVSPGERATLSCRASQSVSNDVAWYQQKPGQSPRLLINYASHRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16301 - protein, 107 aa, Artificial Sequence; identical to SEQ ID NO: 10591
  Description of Artificial Sequence: Synthetic polypeptide
  VL of XENP019049

SEQ ID NO: 16302 - protein, 11 aa, Artificial Sequence
  Description of Artificial Sequence: Synthetic peptide
  XENP019049 vlCDR1
RASQSVSNDVA

SEQ ID NO: 16303 - protein, 7 aa, Artificial Sequence
  Description of Artificial Sequence: Synthetic peptide
  XENP019049 vlCDR2
YASHRYT

SEQ ID NO: 16304 - protein, 9 aa, Artificial Sequence
  Description of Artificial Sequence: Synthetic peptide
  XENP019049 vlCDR3
QQDFSSPRT

SEQ ID NO: 16305 - protein, 451 aa, Artificial Sequence; identical to SEQ ID NO: 11545
  Description of Artificial Sequence: Synthetic polypeptide
  XENP019050 1G6_H1_L1.173_IgG1_PVA_/S267K Heavy Chain

SEQ ID NO: 16306 - protein, 122 aa, Artificial Sequence; identical to SEQ ID NO: 6246
  Description of Artificial Sequence: Synthetic polypeptide
  VH of XENP019050

SEQ ID NO: 16307 - protein, 5 aa, Artificial Sequence
  Description of Artificial Sequence: Synthetic peptide
  XENP019050 vhCDR1
NYWMN

SEQ ID NO: 16308 - protein, 19 aa, Artificial Sequence
  Description of Artificial Sequence: Synthetic peptide
  XENP019050 vhCDR2
EIRLKSNNYATHYAEPVKG

SEQ ID NO: 16309 - protein, 11 aa, Artificial Sequence
  Description of Artificial Sequence: Synthetic peptide
  XENP019050 vhCDR3
YYGNYGGYFDV

SEQ ID NO: 16310 - protein, 214 aa, Artificial Sequence
  Description of Artificial Sequence: Synthetic polypeptide
  XENP019050 1G6_H1_L1.173_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDFGSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16311 - protein, 107 aa, Artificial Sequence; identical to SEQ ID NO: 10600
  Description of Artificial Sequence: Synthetic polypeptide
  VL of XENP019050

SEQ ID NO: 16312 - protein, 11 aa, Artificial Sequence
  Description of Artificial Sequence: Synthetic peptide
  XENP019050 vlCDR1
RASQSVSNDVA

SEQ ID NO: 16313 - protein, 7 aa, Artificial Sequence
  Description of Artificial Sequence: Synthetic peptide
  XENP019050 vlCDR2
YASHRYT

SEQ ID NO: 16314 - protein, 9 aa, Artificial Sequence
  Description of Artificial Sequence: Synthetic peptide
  XENP019050 vlCDR3
QQDFGSPRT

SEQ ID NO: 16315 - protein, 451 aa, Artificial Sequence; identical to SEQ ID NO: 11545
  Description of Artificial Sequence: Synthetic polypeptide
  XENP019051 1G6_H1_L1.174_IgG1_PVA_/S267K Heavy Chain

SEQ ID NO: 16316 - protein, 122 aa, Artificial Sequence; identical to SEQ ID NO: 6246
  Description of Artificial Sequence: Synthetic polypeptide
  VH of XENP019051

SEQ ID NO: 16317 - protein, 5 aa, Artificial Sequence
  Description of Artificial Sequence: Synthetic peptide
  XENP019051 vhCDR1
NYWMN

SEQ ID NO: 16318 - protein, 19 aa, Artificial Sequence
  Description of Artificial Sequence: Synthetic peptide
  XENP019051 vhCDR2
EIRLKSNNYATHYAEPVKG

SEQ ID NO: 16319 - protein, 11 aa, Artificial Sequence
  Description of Artificial Sequence: Synthetic peptide
  XENP019051 vhCDR3
YYGNYGGYFDV

SEQ ID NO: 16320 - protein, 214 aa, Artificial Sequence
  Description of Artificial Sequence: Synthetic polypeptide
  XENP019051 1G6_H1_L1.174_IgG1_PVA_/S267K Light Chain
SIVMTQSPATLSVSPGERATLSCRASQSVSNDVAWYQQKPGQSPRLLINYASHRYTGVPDRFTGSGYGTEFTLTISSLQSEDFAVYFCQQDWGSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16321 - protein, 107 aa, Artificial Sequence; identical to SEQ ID NO: 10609
  Description of Artificial Sequence: Synthetic polypeptide
  VL of XENP019051

SEQ ID NO: 16322 - protein, 11 aa, Artificial Sequence
  Description of Artificial Sequence: Synthetic peptide
  XENP019051 vlCDR1
RASQSVSNDVA

SEQ ID NO: 16323 - protein, 7 aa, Artificial Sequence
  Description of Artificial Sequence: Synthetic peptide
  XENP019051 vlCDR2
YASHRYT

SEQ ID NO: 16324 - protein, 9 aa, Artificial Sequence
  Description of Artificial Sequence: Synthetic peptide
  XENP019051 vlCDR3
QQDWGSPRT

SEQ ID NO: 16325 - protein, 451 aa, Artificial Sequence; identical to SEQ ID NO: 11545
  Description of Artificial Sequence: Synthetic polypeptide
  XENP019052 1G6_H1_L1.175_IgG1_PVA_/S267K Heavy Chain

SEQ ID NO: 16326 - protein, 122 aa, Artificial Sequence; identical to SEQ ID NO: 6246
  Description of Artificial Sequence: Synthetic polypeptide
  VH of XENP019052

SEQ ID NO: 16327 - protein, 5 aa, Artificial Sequence
  Description of Artificial Sequence: Synthetic peptide
  XENP019052 vhCDR1
NYWMN

SEQ ID NO: 16328 - protein, 19 aa, Artificial Sequence
  Description of Artificial Sequence: Synthetic peptide
  XENP019052 vhCDR2
EIRLKSNNYATHYAEPVKG

SEQ ID NO: 16329 - protein, 11 aa, Artificial Sequence
  Description of Artificial Sequence: Synthetic peptide
  XENP019052 vhCDR3
YYGNYGGYFDV

SEQ ID NO: 16330 - protein, 214 aa, Artificial Sequence
  Description of Artificial Sequence: Synthetic polypeptide
  XENP019052 1G6_H1_L1.175_IgG1_PVA_/S267K Light Chain
SIVMTQSPATLSVSPGERATLSCRASQSVGNDVAWYQQKPGQSPRLLINYASHRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16331 - protein, 107 aa, Artificial Sequence; identical to SEQ ID NO: 10618
  Description of Artificial Sequence: Synthetic polypeptide
  VL of XENP019052

SEQ ID NO: 16332 - protein, 11 aa, Artificial Sequence
  Description of Artificial Sequence: Synthetic peptide
  XENP019052 vlCDR1
RASQSVGNDVA

SEQ ID NO: 16333 - protein, 7 aa, Artificial Sequence
  Description of Artificial Sequence: Synthetic peptide
  XENP019052 vlCDR2
YASHRYT

SEQ ID NO: 16334 - protein, 9 aa, Artificial Sequence
  Description of Artificial Sequence: Synthetic peptide
  XENP019052 vlCDR3
QQDWSSPRT

SEQ ID NO: 16335 - protein, 451 aa, Artificial Sequence; identical to SEQ ID NO: 11545
  Description of Artificial Sequence: Synthetic polypeptide
  XENP019053 1G6_H1_L1.176_IgG1_PVA_/S267K Heavy Chain

SEQ ID NO: 16336 - protein, 122 aa, Artificial Sequence; identical to SEQ ID NO: 6246
  Description of Artificial Sequence: Synthetic polypeptide
  VH of XENP019053

SEQ ID NO: 16337 - protein, 5 aa, Artificial Sequence
  Description of Artificial Sequence: Synthetic peptide
  XENP019053 vhCDR1
NYWMN

SEQ ID NO: 16338 - protein, 19 aa, Artificial Sequence
  Description of Artificial Sequence: Synthetic peptide
  XENP019053 vhCDR2
EIRLKSNNYATHYAEPVKG

SEQ ID NO: 16339 - protein, 11 aa, Artificial Sequence
  Description of Artificial Sequence: Synthetic peptide
  XENP019053 vhCDR3
YYGNYGGYFDV

SEQ ID NO: 16340 - protein, 214 aa, Artificial Sequence
  Description of Artificial Sequence: Synthetic polypeptide
  XENP019053 1G6_H1_L1.176_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16341 - protein, 107 aa, Artificial Sequence; identical to SEQ ID NO: 10627
  Description of Artificial Sequence: Synthetic polypeptide
  VL of XENP019053

SEQ ID NO: 16342 - protein, 11 aa, Artificial Sequence
  Description of Artificial Sequence: Synthetic peptide
  XENP019053 vlCDR1
RASQSVGNDVA

SEQ ID NO: 16343 - protein, 7 aa, Artificial Sequence
  Description of Artificial Sequence: Synthetic peptide
  XENP019053 vlCDR2
YASWRYT

SEQ ID NO: 16344 - protein, 9 aa, Artificial Sequence
  Description of Artificial Sequence: Synthetic peptide
  XENP019053 vlCDR3
QQDYSSPRT

SEQ ID NO: 16345 - protein, 451 aa, Artificial Sequence; identical to SEQ ID NO: 11545
  Description of Artificial Sequence: Synthetic polypeptide
  XENP019054 1G6_H1_L1.177_IgG1_PVA_/S267K Heavy Chain

SEQ ID NO: 16346 - protein, 122 aa, Artificial Sequence; identical to SEQ ID NO: 6246
  Description of Artificial Sequence: Synthetic polypeptide
  VH of XENP019054

SEQ ID NO: 16347 - protein, 5 aa, Artificial Sequence
  Description of Artificial Sequence: Synthetic peptide
  XENP019054 vhCDR1
NYWMN

SEQ ID NO: 16348 - protein, 19 aa, Artificial Sequence
  Description of Artificial Sequence: Synthetic peptide
  XENP019054 vhCDR2
EIRLKSNNYATHYAEPVKG

SEQ ID NO: 16349 - protein, 11 aa, Artificial Sequence
  Description of Artificial Sequence: Synthetic peptide
  XENP019054 vhCDR3
YYGNYGGYFDV

SEQ ID NO: 16350 - protein, 214 aa, Artificial Sequence
  Description of Artificial Sequence: Synthetic polypeptide
  XENP019054 1G6_H1_L1.177_IgG1_PVA_/S267K Light Chain
SIVMTQSPATLSVSPGERATLSCRASQSVGNDVAWYQQKPGQSPRLLINYASHRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16351 - protein, 107 aa, Artificial Sequence; identical to SEQ ID NO: 10636
  Description of Artificial Sequence: Synthetic polypeptide
  VL of XENP019054

SEQ ID NO: 16352 - protein, 11 aa, Artificial Sequence
  Description of Artificial Sequence: Synthetic peptide
  XENP019054 vlCDR1
RASQSVGNDVA

SEQ ID NO: 16353 - protein, 7 aa, Artificial Sequence
  Description of Artificial Sequence: Synthetic peptide
  XENP019054 vlCDR2
YASHRYT

SEQ ID NO: 16354 - protein, 9 aa, Artificial Sequence
  Description of Artificial Sequence: Synthetic peptide
  XENP019054 vlCDR3
QQDFSSPRT

SEQ ID NO: 16355 - protein, 451 aa, Artificial Sequence; identical to SEQ ID NO: 11545
  Description of Artificial Sequence: Synthetic polypeptide
  XENP019055 1G6_H1_L1.178_IgG1_PVA_/S267K Heavy Chain

SEQ ID NO: 16356 - protein, 122 aa, Artificial Sequence; identical to SEQ ID NO: 6246
  Description of Artificial Sequence: Synthetic polypeptide
  VH of XENP019055

SEQ ID NO: 16357 - protein, 5 aa, Artificial Sequence
  Description of Artificial Sequence: Synthetic peptide
  XENP019055 vhCDR1
NYWMN

SEQ ID NO: 16358 - protein, 19 aa, Artificial Sequence
  Description of Artificial Sequence: Synthetic peptide
  XENP019055 vhCDR2
EIRLKSNNYATHYAEPVKG

SEQ ID NO: 16359 - protein, 11 aa, Artificial Sequence
  Description of Artificial Sequence: Synthetic peptide
  XENP019055 vhCDR3
YYGNYGGYFDV

SEQ ID NO: 16360 - protein, 214 aa, Artificial Sequence
  Description of Artificial Sequence: Synthetic polypeptide
  XENP019055 1G6_H1_L1.178_IgG1_PVA_/S267K Light Chain
SIVMTQSPATLSVSPGERATLSCRASQSVGNDVAWYQQKPGQSPRLLINYASHRYTSVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16361 - protein, 107 aa, Artificial Sequence; identical to SEQ ID NO: 10645
  Description of Artificial Sequence: Synthetic polypeptide
  VL of XENP019055

SEQ ID NO: 16362 - protein, 11 aa, Artificial Sequence
  Description of Artificial Sequence: Synthetic peptide
  XENP019055 vlCDR1
RASQSVGNDVA

SEQ ID NO: 16363 - protein, 7 aa, Artificial Sequence
  Description of Artificial Sequence: Synthetic peptide
  XENP019055 vlCDR2
YASHRYT

SEQ ID NO: 16364 - protein, 9 aa, Artificial Sequence
  Description of Artificial Sequence: Synthetic peptide
  XENP019055 vlCDR3
QQDGSSPRT

SEQ ID NO: 16365 - protein, 451 aa, Artificial Sequence; identical to SEQ ID NO: 11545
  Description of Artificial Sequence: Synthetic polypeptide
  XENP019056 1G6_H1_L1.179_IgG1_PVA_/S267K Heavy Chain

SEQ ID NO: 16366 - protein, 122 aa, Artificial Sequence; identical to SEQ ID NO: 6246
  Description of Artificial Sequence: Synthetic polypeptide
  VH of XENP019056

SEQ ID NO: 16367 - protein, 5 aa, Artificial Sequence
  Description of Artificial Sequence: Synthetic peptide
  XENP019056 vhCDR1
NYWMN

SEQ ID NO: 16368 - protein, 19 aa, Artificial Sequence
  Description of Artificial Sequence: Synthetic peptide
  XENP019056 vhCDR2
EIRLKSNNYATHYAEPVKG

SEQ ID NO: 16369 - protein, 11 aa, Artificial Sequence
  Description of Artificial Sequence: Synthetic peptide
  XENP019056 vhCDR3
YYGNYGGYFDV

SEQ ID NO: 16370 - protein, 214 aa, Artificial Sequence
  Description of Artificial Sequence: Synthetic polypeptide
  XENP019056 1G6_H1_L1.179_IgG1_PVA_/S267K Light Chain
SIVMTQSPATLSVSPGERATLSCRASQSVSNDVAWYQQKPGQSPRLLINYASWRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16371 - protein, 107 aa, Artificial Sequence; identical to SEQ ID NO: 10654
  Description of Artificial Sequence: Synthetic polypeptide
  VL of XENP019056

SEQ ID NO: 16372 - protein, 11 aa, Artificial Sequence
  Description of Artificial Sequence: Synthetic peptide
  XENP019056 vlCDR1
RASQSVSNDVA

SEQ ID NO: 16373 - protein, 7 aa, Artificial Sequence
  Description of Artificial Sequence: Synthetic peptide
  XENP019056 vlCDR2
YASWRYT

SEQ ID NO: 16374 - protein, 9 aa, Artificial Sequence
  Description of Artificial Sequence: Synthetic peptide
  XENP019056 vlCDR3
QQDFSSPRT

SEQ ID NO: 16375 - protein, 451 aa, Artificial Sequence; identical to SEQ ID NO: 11545
  Description of Artificial Sequence: Synthetic polypeptide
  XENP019057 1G6_H1_L1.180_IgG1_PVA_/S267K Heavy Chain

SEQ ID NO: 16376 - protein, 122 aa, Artificial Sequence; identical to SEQ ID NO: 6246
  Description of Artificial Sequence: Synthetic polypeptide
  VH of XENP019057

SEQ ID NO: 16377 - protein, 5 aa, Artificial Sequence
  Description of Artificial Sequence: Synthetic peptide
  XENP019057 vhCDR1
NYWMN

SEQ ID NO: 16378 - protein, 19 aa, Artificial Sequence
  Description of Artificial Sequence: Synthetic peptide
  XENP019057 vhCDR2
EIRLKSNNYATHYAEPVKG

SEQ ID NO: 16379 - protein, 11 aa, Artificial Sequence
  Description of Artificial Sequence: Synthetic peptide
  XENP019057 vhCDR3
YYGNYGGYFDV

SEQ ID NO: 16380 - protein, 214 aa, Artificial Sequence
  Description of Artificial Sequence: Synthetic polypeptide
  XENP019057 1G6_H1_L1.180_IgG1_PVA_/S267K Light Chain
SIVMTQSPATLSVSPGERATLSCRASQSVSNDVAWYQQKPGQSPRLLINYASWRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16381 - protein, 107 aa, Artificial Sequence; identical to SEQ ID NO: 10663
  Description of Artificial Sequence: Synthetic polypeptide
  VL of XENP019057

SEQ ID NO: 16382 - protein, 11 aa, Artificial Sequence
  Description of Artificial Sequence: Synthetic peptide
  XENP019057 vlCDR1
RASQSVSNDVA

SEQ ID NO: 16383 - protein, 7 aa, Artificial Sequence
  Description of Artificial Sequence: Synthetic peptide
  XENP019057 vlCDR2
YASWRYT

SEQ ID NO: 16384 - protein, 9 aa, Artificial Sequence
  Description of Artificial Sequence: Synthetic peptide
  XENP019057 vlCDR3
QQDWSSPRT

SEQ ID NO: 16385 - protein, 451 aa, Artificial Sequence; identical to SEQ ID NO: 11545
  Description of Artificial Sequence: Synthetic polypeptide
  XENP019058 1G6_H1_L1.181_IgG1_PVA_/S267K Heavy Chain

SEQ ID NO: 16386 - protein, 122 aa, Artificial Sequence; identical to SEQ ID NO: 6246
  Description of Artificial Sequence: Synthetic polypeptide
  VH of XENP019058

SEQ ID NO: 16387 - protein, 5 aa, Artificial Sequence
  Description of Artificial Sequence: Synthetic peptide
  XENP019058 vhCDR1
NYWMN

SEQ ID NO: 16388 - protein, 19 aa, Artificial Sequence
  Description of Artificial Sequence: Synthetic peptide
  XENP019058 vhCDR2
EIRLKSNNYATHYAEPVKG

SEQ ID NO: 16389 - protein, 11 aa, Artificial Sequence
  Description of Artificial Sequence: Synthetic peptide
  XENP019058 vhCDR3
YYGNYGGYFDV

SEQ ID NO: 16390 - protein, 214 aa, Artificial Sequence
  Description of Artificial Sequence: Synthetic polypeptide
  XENP019058 1G6_H1_L1.181_IgG1_PVA_/S267K Light Chain
SIVMTQSPATLSVSPGERATLSCRASQSVSNDVAWYQQKPGQSPRLLINYASWRYTSVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16391 - protein, 107 aa, Artificial Sequence; identical to SEQ ID NO: 10672
  Description of Artificial Sequence: Synthetic polypeptide
  VL of XENP019058

SEQ ID NO: 16392 - protein, 11 aa, Artificial Sequence
  Description of Artificial Sequence: Synthetic peptide
  XENP019058 vlCDR1
RASQSVSNDVA

SEQ ID NO: 16393 - protein, 7 aa, Artificial Sequence
  Description of Artificial Sequence: Synthetic peptide
  XENP019058 vlCDR2
YASWRYT

SEQ ID NO: 16394 - protein, 9 aa, Artificial Sequence
  Description of Artificial Sequence: Synthetic peptide
  XENP019058 vlCDR3
QQDGSSPRT

SEQ ID NO: 16395 - protein, 451 aa, Artificial Sequence; identical to SEQ ID NO: 11545
  Description of Artificial Sequence: Synthetic polypeptide
  XENP019059 1G6_H1_L1.182_IgG1_PVA_/S267K Heavy Chain

SEQ ID NO: 16396 - protein, 122 aa, Artificial Sequence; identical to SEQ ID NO: 6246
  Description of Artificial Sequence: Synthetic polypeptide
  VH of XENP019059

SEQ ID NO: 16397 - protein, 5 aa, Artificial Sequence
  Description of Artificial Sequence: Synthetic peptide
  XENP019059 vhCDR1
NYWMN

SEQ ID NO: 16398 - protein, 19 aa, Artificial Sequence
  Description of Artificial Sequence: Synthetic peptide
  XENP019059 vhCDR2
EIRLKSNNYATHYAEPVKG

SEQ ID NO: 16399 - protein, 11 aa, Artificial Sequence
  Description of Artificial Sequence: Synthetic peptide
  XENP019059 vhCDR3
YYGNYGGYFDV

SEQ ID NO: 16400 - protein, 214 aa, Artificial Sequence
  Description of Artificial Sequence: Synthetic polypeptide
  XENP019059 1G6_H1_L1.182_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16401 - protein, 107 aa, Artificial Sequence; identical to SEQ ID NO: 10681
  Description of Artificial Sequence: Synthetic polypeptide
  VL of XENP019059

SEQ ID NO: 16402 - protein, 11 aa, Artificial Sequence
  Description of Artificial Sequence: Synthetic peptide
  XENP019059 vlCDR1
RASQSVGNDVA

SEQ ID NO: 16403 - protein, 7 aa, Artificial Sequence
  Description of Artificial Sequence: Synthetic peptide
  XENP019059 vlCDR2
YASWRYT

SEQ ID NO: 16404 - protein, 9 aa, Artificial Sequence
  Description of Artificial Sequence: Synthetic peptide
  XENP019059 vlCDR3
QQDWSSPRT

SEQ ID NO: 16405 - protein, 451 aa, Artificial Sequence; identical to SEQ ID NO: 11545
  Description of Artificial Sequence: Synthetic polypeptide
  XENP019060 1G6_H1_L1.183_IgG1_PVA_/S267K Heavy Chain

SEQ ID NO: 16406 - protein, 122 aa, Artificial Sequence; identical to SEQ ID NO: 6246
  Description of Artificial Sequence: Synthetic polypeptide
  VH of XENP019060

SEQ ID NO: 16407 - protein, 5 aa, Artificial Sequence
  Description of Artificial Sequence: Synthetic peptide
  XENP019060 vhCDR1
NYWMN

SEQ ID NO: 16408 - protein, 19 aa, Artificial Sequence
  Description of Artificial Sequence: Synthetic peptide
  XENP019060 vhCDR2
EIRLKSNNYATHYAEPVKG

SEQ ID NO: 16409 - protein, 11 aa, Artificial Sequence
  Description of Artificial Sequence: Synthetic peptide
  XENP019060 vhCDR3
YYGNYGGYFDV

SEQ ID NO: 16410 - protein, 214 aa, Artificial Sequence
  Description of Artificial Sequence: Synthetic polypeptide
  XENP019060 1G6_H1_L1.183_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16411 - protein, 107 aa, Artificial Sequence; identical to SEQ ID NO: 10690
  Description of Artificial Sequence: Synthetic polypeptide
  VL of XENP019060

SEQ ID NO: 16412 - protein, 11 aa, Artificial Sequence
  Description of Artificial Sequence: Synthetic peptide
  XENP019060 vlCDR1
RASQSVGNDVA

SEQ ID NO: 16413 - protein, 7 aa, Artificial Sequence
  Description of Artificial Sequence: Synthetic peptide
  XENP019060 vlCDR2
YASWRYT

SEQ ID NO: 16414 - protein, 9 aa, Artificial Sequence
  Description of Artificial Sequence: Synthetic peptide
  XENP019060 vlCDR3
QQDFSSPRT

SEQ ID NO: 16415 - protein, 451 aa, Artificial Sequence; identical to SEQ ID NO: 11545
  Description of Artificial Sequence: Synthetic polypeptide
  XENP019061 1G6_H1_L1.184_IgG1_PVA_/S267K Heavy Chain

SEQ ID NO: 16416 - protein, 122 aa, Artificial Sequence; identical to SEQ ID NO: 6246
  Description of Artificial Sequence: Synthetic polypeptide
  VH of XENP019061

SEQ ID NO: 16417 - protein, 5 aa, Artificial Sequence
  Description of Artificial Sequence: Synthetic peptide
  XENP019061 vhCDR1
NYWMN

SEQ ID NO: 16418 - protein, 19 aa, Artificial Sequence
  Description of Artificial Sequence: Synthetic peptide
  XENP019061 vhCDR2
EIRLKSNNYATHYAEPVKG

SEQ ID NO: 16419 - protein, 11 aa, Artificial Sequence
  Description of Artificial Sequence: Synthetic peptide
  XENP019061 vhCDR3
YYGNYGGYFDV

SEQ ID NO: 16420 - protein, 214 aa, Artificial Sequence
  Description of Artificial Sequence: Synthetic polypeptide
  XENP019061 1G6_H1_L1.184_IgG1_PVA_/S267K Light Chain
SIVMTQSPATLSVSPGERATLSCRASQSVGNDVAWYQQKPGQSPRLLINYASWRYTSVPDRFTGSGYGTEFTLTISSLQSEDFAVYFCQQDGSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16421 - protein, 107 aa, Artificial Sequence; identical to SEQ ID NO: 10699
  Description of Artificial Sequence: Synthetic polypeptide
  VL of XENP019061

SEQ ID NO: 16422 - protein, 11 aa, Artificial Sequence
  Description of Artificial Sequence: Synthetic peptide
  XENP019061 vlCDR1
RASQSVGNDVA

SEQ ID NO: 16423 - protein, 7 aa, Artificial Sequence
  Description of Artificial Sequence: Synthetic peptide
  XENP019061 vlCDR2
YASWRYT

SEQ ID NO: 16424 - protein, 9 aa, Artificial Sequence
  Description of Artificial Sequence: Synthetic peptide
  XENP019061 vlCDR3
QQDGSSPRT

SEQ ID NO: 16425 - protein, 451 aa, Artificial Sequence; identical to SEQ ID NO: 11545
  Description of Artificial Sequence: Synthetic polypeptide
  XENP019062 1G6_H1_L1.185_IgG1_PVA_/S267K Heavy Chain

SEQ ID NO: 16426 - protein, 122 aa, Artificial Sequence; identical to SEQ ID NO: 6246
  Description of Artificial Sequence: Synthetic polypeptide
  VH of XENP019062

SEQ ID NO: 16427 - protein, 5 aa, Artificial Sequence
  Description of Artificial Sequence: Synthetic peptide
  XENP019062 vhCDR1
NYWMN

SEQ ID NO: 16428 - protein, 19 aa, Artificial Sequence
  Description of Artificial Sequence: Synthetic peptide
  XENP019062 vhCDR2
EIRLKSNNYATHYAEPVKG

SEQ ID NO: 16429 - protein, 11 aa, Artificial Sequence
  Description of Artificial Sequence: Synthetic peptide
  XENP019062 vhCDR3
YYGNYGGYFDV

SEQ ID NO: 16430 - protein, 214 aa, Artificial Sequence
  Description of Artificial Sequence: Synthetic polypeptide
  XENP019062 1G6_H1_L1.185_IgG1_PVA_/S267K Light Chain
EIVMTQSPATLSVSPGERATLSCRASQSVSNDLAWYQQKPGQSPRLLINYASHRYTGVPARFSGSGYGTEFTLTISSLQSEDFAVYYCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16431 - protein, 107 aa, Artificial Sequence; identical to SEQ ID NO: 10708
  Description of Artificial Sequence: Synthetic polypeptide
  VL of XENP019062

SEQ ID NO: 16432 - protein, 11 aa, Artificial Sequence
  Description of Artificial Sequence: Synthetic peptide
  XENP019062 vlCDR1
RASQSVSNDLA

SEQ ID NO: 16433 - protein, 7 aa, Artificial Sequence
  Description of Artificial Sequence: Synthetic peptide
  XENP019062 vlCDR2
YASHRYT

SEQ ID NO: 16434 - protein, 9 aa, Artificial Sequence
  Description of Artificial Sequence: Synthetic peptide
  XENP019062 vlCDR3
QQDYSSPRT

SEQ ID NO: 16435 - protein, 451 aa, Artificial Sequence; identical to SEQ ID NO: 11545
  Description of Artificial Sequence: Synthetic polypeptide
  XENP019063 1G6_H1_L1.186_IgG1_PVA_/S267K Heavy Chain

SEQ ID NO: 16436 - protein, 122 aa, Artificial Sequence; identical to SEQ ID NO: 6246
  Description of Artificial Sequence: Synthetic polypeptide
  VH of XENP019063

SEQ ID NO: 16437 - protein, 5 aa, Artificial Sequence
  Description of Artificial Sequence: Synthetic peptide
  XENP019063 vhCDR1
NYWMN

SEQ ID NO: 16438 - protein, 19 aa, Artificial Sequence
  Description of Artificial Sequence: Synthetic peptide
  XENP019063 vhCDR2
EIRLKSNNYATHYAEPVKG

SEQ ID NO: 16439 - protein, 11 aa, Artificial Sequence
  Description of Artificial Sequence: Synthetic peptide
  XENP019063 vhCDR3
YYGNYGGYFDV

SEQ ID NO: 16440 - protein, 214 aa, Artificial Sequence
  Description of Artificial Sequence: Synthetic polypeptide
  XENP019063 1G6_H1_L1.186_IgG1_PVA_/S267K Light Chain
DIVMTQSPATLSVSPGERATLSCRASQSVSNDLAWYQQKPGQSPRLLINYASHRYTGVPDRFSGSGYGTEFTLTISSLQSEDFAVYYCQQDYSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16441 - protein, 107 aa, Artificial Sequence; identical to SEQ ID NO: 10717
  Description of Artificial Sequence: Synthetic polypeptide
  VL of XENP019063

SEQ ID NO: 16442 - protein, 11 aa, Artificial Sequence
  Description of Artificial Sequence: Synthetic peptide
  XENP019063 vlCDR1
RASQSVSNDLA

SEQ ID NO: 16443 - protein, 7 aa, Artificial Sequence
  Description of Artificial Sequence: Synthetic peptide
  XENP019063 vlCDR2
YASHRYT

SEQ ID NO: 16444 - protein, 9 aa, Artificial Sequence
  Description of Artificial Sequence: Synthetic peptide
  XENP019063 vlCDR3
QQDYSSPRT

SEQ ID NO: 16445 - protein, 451 aa, Artificial Sequence; identical to SEQ ID NO: 15945
  Description of Artificial Sequence: Synthetic polypeptide
  XENP019160 1G6_H1.269_L1.116_IgG1_PVA_/S267K Heavy Chain

SEQ ID NO: 16446 - protein, 122 aa, Artificial Sequence; identical to SEQ ID NO: 10275
  Description of Artificial Sequence: Synthetic polypeptide
  VH of XENP019160

SEQ ID NO: 16447 - protein, 5 aa, Artificial Sequence
  Description of Artificial Sequence: Synthetic peptide
  XENP019160 vhCDR1
NFWMN

SEQ ID NO: 16448 - protein, 19 aa, Artificial Sequence
  Description of Artificial Sequence: Synthetic peptide
  XENP019160 vhCDR2
EIRLYSNNYATHYAEPVKG

SEQ ID NO: 16449 - protein, 11 aa, Artificial Sequence
  Description of Artificial Sequence: Synthetic peptide
  XENP019160 vhCDR3
YYGNYGGYFDV

SEQ ID NO: 16450 - protein, 214 aa, Artificial Sequence; identical to SEQ ID NO: 15260
  Description of Artificial Sequence: Synthetic polypeptide
  XENP019160 1G6_H1.269_L1.116_IgG1_PVA_/S267K Light Chain

SEQ ID NO: 16451 - protein, 107 aa, Artificial Sequence; identical to SEQ ID NO: 9538
  Description of Artificial Sequence: Synthetic polypeptide
  VL of XENP019160

SEQ ID NO: 16452 - protein, 11 aa, Artificial Sequence
  Description of Artificial Sequence: Synthetic peptide
  XENP019160 vlCDR1
RASQSVSNDVA

SEQ ID NO: 16453 - protein, 7 aa, Artificial Sequence
  Description of Artificial Sequence: Synthetic peptide
  XENP019160 vlCDR2
YASHRYT

SEQ ID NO: 16454 - protein, 9 aa, Artificial Sequence
  Description of Artificial Sequence: Synthetic peptide
  XENP019160 vlCDR3
QQDFSSPRT

SEQ ID NO: 16455 - protein, 451 aa, Artificial Sequence; identical to SEQ ID NO: 15965
  Description of Artificial Sequence: Synthetic polypeptide
  XENP019161 1G6_H1.271_L1.116_IgG1_PVA_/S267K Heavy Chain

SEQ ID NO: 16456 - protein, 122 aa, Artificial Sequence; identical to SEQ ID NO: 10293
  Description of Artificial Sequence: Synthetic polypeptide
  VH of XENP019161

SEQ ID NO: 16457 - protein, 5 aa, Artificial Sequence
  Description of Artificial Sequence: Synthetic peptide
  XENP019161 vhCDR1
NYWMN

SEQ ID NO: 16458 - protein, 19 aa, Artificial Sequence
  Description of Artificial Sequence: Synthetic peptide
  XENP019161 vhCDR2
EIRLYSNNYATHYAEPVKG

SEQ ID NO: 16459 - protein, 11 aa, Artificial Sequence
  Description of Artificial Sequence: Synthetic peptide
  XENP019161 vhCDR3
YYGNYGGYFDV

SEQ ID NO: 16460 - protein, 214 aa, Artificial Sequence; identical to SEQ ID NO: 15260
  Description of Artificial Sequence: Synthetic polypeptide
  XENP019161 1G6_H1.271_L1.116_IgG1_PVA_/S267K Light Chain

SEQ ID NO: 16461 - protein, 107 aa, Artificial Sequence; identical to SEQ ID NO: 9538
  Description of Artificial Sequence: Synthetic polypeptide
  VL of XENP019161

SEQ ID NO: 16462 - protein, 11 aa, Artificial Sequence
  Description of Artificial Sequence: Synthetic peptide
  XENP019161 vlCDR1
RASQSVSNDVA

SEQ ID NO: 16463 - protein, 7 aa, Artificial Sequence
  Description of Artificial Sequence: Synthetic peptide
  XENP019161 vlCDR2
YASHRYT

SEQ ID NO: 16464 - protein, 9 aa, Artificial Sequence
  Description of Artificial Sequence: Synthetic peptide
  XENP019161 vlCDR3
QQDFSSPRT

SEQ ID NO: 16465 - protein, 451 aa, Artificial Sequence; identical to SEQ ID NO: 15975
  Description of Artificial Sequence: Synthetic polypeptide
  XENP019162 1G6_H1.272_L1.116_IgG1_PVA_/S267K Heavy Chain

SEQ ID NO: 16466 - protein, 122 aa, Artificial Sequence; identical to SEQ ID NO: 10302
  Description of Artificial Sequence: Synthetic polypeptide
  VH of XENP019162

SEQ ID NO: 16467 - protein, 5 aa, Artificial Sequence
  Description of Artificial Sequence: Synthetic peptide
  XENP019162 vhCDR1
NFWMN

SEQ ID NO: 16468 - protein, 19 aa, Artificial Sequence
  Description of Artificial Sequence: Synthetic peptide
  XENP019162 vhCDR2
EIRLYSNNYATHYAEPVKG

SEQ ID NO: 16469 - protein, 11 aa, Artificial Sequence
  Description of Artificial Sequence: Synthetic peptide
  XENP019162 vhCDR3
YYGNYGGYFDV

SEQ ID NO: 16470 - protein, 214 aa, Artificial Sequence; identical to SEQ ID NO: 15260
  Description of Artificial Sequence: Synthetic polypeptide
  XENP019162 1G6_H1.272_L1.116_IgG1_PVA_/S267K Light Chain

SEQ ID NO: 16471 - protein, 107 aa, Artificial Sequence; identical to SEQ ID NO: 9538
  Description of Artificial Sequence: Synthetic polypeptide
  VL of XENP019162

SEQ ID NO: 16472 - protein, 11 aa, Artificial Sequence
  Description of Artificial Sequence: Synthetic peptide
  XENP019162 vlCDR1
RASQSVSNDVA

SEQ ID NO: 16473 - protein, 7 aa, Artificial Sequence
  Description of Artificial Sequence: Synthetic peptide
  XENP019162 vlCDR2
YASHRYT

SEQ ID NO: 16474 - protein, 9 aa, Artificial Sequence
  Description of Artificial Sequence: Synthetic peptide
  XENP019162 vlCDR3
QQDFSSPRT

SEQ ID NO: 16475 - protein, 451 aa, Artificial Sequence; identical to SEQ ID NO: 12615
  Description of Artificial Sequence: Synthetic polypeptide
  XENP019163 1G6_H1.90_L1.177_IgG1_PVA_/S267K Heavy Chain

SEQ ID NO: 16476 - protein, 122 aa, Artificial Sequence; identical to SEQ ID NO: 7161
  Description of Artificial Sequence: Synthetic polypeptide
  VH of XENP019163

SEQ ID NO: 16477 - protein, 5 aa, Artificial Sequence
  Description of Artificial Sequence: Synthetic peptide
  XENP019163 vhCDR1
NYWMN

SEQ ID NO: 16478 - protein, 19 aa, Artificial Sequence
  Description of Artificial Sequence: Synthetic peptide
  XENP019163 vhCDR2
EIRLYSNNYATHYAEPVKG

SEQ ID NO: 16479 - protein, 11 aa, Artificial Sequence
  Description of Artificial Sequence: Synthetic peptide
  XENP019163 vhCDR3
YYGNYGGYFDV

SEQ ID NO: 16480 - protein, 214 aa, Artificial Sequence; identical to SEQ ID NO: 16350
  Description of Artificial Sequence: Synthetic polypeptide
  XENP019163 1G6_H1.90_L1.177_IgG1_PVA_/S267K Light Chain

SEQ ID NO: 16481 - protein, 107 aa, Artificial Sequence; identical to SEQ ID NO: 10636
  Description of Artificial Sequence: Synthetic polypeptide
  VL of XENP019163

SEQ ID NO: 16482 - protein, 11 aa, Artificial Sequence
  Description of Artificial Sequence: Synthetic peptide
  XENP019163 vlCDR1
RASQSVGNDVA

SEQ ID NO: 16483 - protein, 7 aa, Artificial Sequence
  Description of Artificial Sequence: Synthetic peptide
  XENP019163 vlCDR2
YASHRYT

SEQ ID NO: 16484 - protein, 9 aa, Artificial Sequence
  Description of Artificial Sequence: Synthetic peptide
  XENP019163 vlCDR3
QQDFSSPRT

SEQ ID NO: 16485 - protein, 451 aa, Artificial Sequence; identical to SEQ ID NO: 15945
  Description of Artificial Sequence: Synthetic polypeptide
  XENP019164 1G6_H1.269_L1.177_IgG1_PVA_/S267K Heavy Chain

SEQ ID NO: 16486 - protein, 122 aa, Artificial Sequence; identical to SEQ ID NO: 10275
  Description of Artificial Sequence: Synthetic polypeptide
  VH of XENP019164

SEQ ID NO: 16487 - protein, 5 aa, Artificial Sequence
  Description of Artificial Sequence: Synthetic peptide
  XENP019164 vhCDR1
NFWMN

SEQ ID NO: 16488 - protein, 19 aa, Artificial Sequence
  Description of Artificial Sequence: Synthetic peptide
  XENP019164 vhCDR2
EIRLYSNNYATHYAEPVKG

SEQ ID NO: 16489 - protein, 11 aa, Artificial Sequence
  Description of Artificial Sequence: Synthetic peptide
  XENP019164 vhCDR3
YYGNYGGYFDV

SEQ ID NO: 16490 - protein, 214 aa, Artificial Sequence; identical to SEQ ID NO: 16350
  Description of Artificial Sequence: Synthetic polypeptide
  XENP019164 1G6_H1.269_L1.177_IgG1_PVA_/S267K Light Chain

SEQ ID NO: 16491 - protein, 107 aa, Artificial Sequence; identical to SEQ ID NO: 10636
  Description of Artificial Sequence: Synthetic polypeptide
  VL of XENP019164

SEQ ID NO: 16492 - protein, 11 aa, Artificial Sequence
  Description of Artificial Sequence: Synthetic peptide
  XENP019164 vlCDR1
RASQSVGNDVA

SEQ ID NO: 16493 - protein, 7 aa, Artificial Sequence
  Description of Artificial Sequence: Synthetic peptide
  XENP019164 vlCDR2
YASHRYT

SEQ ID NO: 16494 - protein, 9 aa, Artificial Sequence
  Description of Artificial Sequence: Synthetic peptide
  XENP019164 vlCDR3
QQDFSSPRT

SEQ ID NO: 16495 - protein, 451 aa, Artificial Sequence; identical to SEQ ID NO: 15965
  Description of Artificial Sequence: Synthetic polypeptide
  XENP019165 1G6_H1.271_L1.177_IgG1_PVA_/S267K Heavy Chain

SEQ ID NO: 16496 - protein, 122 aa, Artificial Sequence; identical to SEQ ID NO: 10293
  Description of Artificial Sequence: Synthetic polypeptide
  VH of XENP019165

SEQ ID NO: 16497 - protein, 5 aa, Artificial Sequence
  Description of Artificial Sequence: Synthetic peptide
  XENP019165 vhCDR1
NYWMN

SEQ ID NO: 16498 - protein, 19 aa, Artificial Sequence
  Description of Artificial Sequence: Synthetic peptide
  XENP019165 vhCDR2
EIRLYSNNYATHYAEPVKG

SEQ ID NO: 16499 - protein, 11 aa, Artificial Sequence
  Description of Artificial Sequence: Synthetic peptide
  XENP019165 vhCDR3
YYGNYGGYFDV

SEQ ID NO: 16500 - protein, 214 aa, Artificial Sequence; identical to SEQ ID NO: 16350
  Description of Artificial Sequence: Synthetic polypeptide
  XENP019165 1G6_H1.271_L1.177_IgG1_PVA_/S267K Light Chain

SEQ ID NO: 16501 - protein, 107 aa, Artificial Sequence; identical to SEQ ID NO: 10636
  Description of Artificial Sequence: Synthetic polypeptide
  VL of XENP019165

SEQ ID NO: 16502 - protein, 11 aa, Artificial Sequence
  Description of Artificial Sequence: Synthetic peptide
  XENP019165 vlCDR1
RASQSVGNDVA

SEQ ID NO: 16503 - protein, 7 aa, Artificial Sequence
  Description of Artificial Sequence: Synthetic peptide
  XENP019165 vlCDR2
YASHRYT

SEQ ID NO: 16504 - protein, 9 aa, Artificial Sequence
  Description of Artificial Sequence: Synthetic peptide
  XENP019165 vlCDR3
QQDFSSPRT

SEQ ID NO: 16505 - protein, 451 aa, Artificial Sequence; identical to SEQ ID NO: 15975
  Description of Artificial Sequence: Synthetic polypeptide
  XENP019166 1G6_H1.272_L1.177_IgG1_PVA_/S267K Heavy Chain

SEQ ID NO: 16506 - protein, 122 aa, Artificial Sequence; identical to SEQ ID NO: 10302
  Description of Artificial Sequence: Synthetic polypeptide
  VH of XENP019166

SEQ ID NO: 16507 - protein, 5 aa, Artificial Sequence
  Description of Artificial Sequence: Synthetic peptide
  XENP019166 vhCDR1
NFWMN

SEQ ID NO: 16508 - protein, 19 aa, Artificial Sequence
  Description of Artificial Sequence: Synthetic peptide
  XENP019166 vhCDR2
EIRLYSNNYATHYAEPVKG

SEQ ID NO: 16509 - protein, 11 aa, Artificial Sequence
  Description of Artificial Sequence: Synthetic peptide
  XENP019166 vhCDR3
YYGNYGGYFDV

SEQ ID NO: 16510 - protein, 214 aa, Artificial Sequence; identical to SEQ ID NO: 16350
  Description of Artificial Sequence: Synthetic polypeptide
  XENP019166 1G6_H1.272_L1.177_IgG1_PVA_/S267K Light Chain

SEQ ID NO: 16511 - protein, 107 aa, Artificial Sequence; identical to SEQ ID NO: 10636
  Description of Artificial Sequence: Synthetic polypeptide
  VL of XENP019166

SEQ ID NO: 16512 - protein, 11 aa, Artificial Sequence
  Description of Artificial Sequence: Synthetic peptide
  XENP019166 vlCDR1
RASQSVGNDVA

SEQ ID NO: 16513 - protein, 7 aa, Artificial Sequence
  Description of Artificial Sequence: Synthetic peptide
  XENP019166 vlCDR2
YASHRYT

SEQ ID NO: 16514 - protein, 9 aa, Artificial Sequence
  Description of Artificial Sequence: Synthetic peptide
  XENP019166 vlCDR3
QQDFSSPRT

SEQ ID NO: 16515 - protein, 451 aa, Artificial Sequence; identical to SEQ ID NO: 12615
  Description of Artificial Sequence: Synthetic polypeptide
  XENP019167 1G6_H1.90_L1.175_IgG1_PVA_/S267K Heavy Chain

SEQ ID NO: 16516 - protein, 122 aa, Artificial Sequence; identical to SEQ ID NO: 7161
  Description of Artificial Sequence: Synthetic polypeptide
  VH of XENP019167

SEQ ID NO: 16517 - protein, 5 aa, Artificial Sequence
  Description of Artificial Sequence: Synthetic peptide
  XENP019167 vhCDR1
NYWMN

SEQ ID NO: 16518 - protein, 19 aa, Artificial Sequence
  Description of Artificial Sequence: Synthetic peptide
  XENP019167 vhCDR2
EIRLYSNNYATHYAEPVKG

SEQ ID NO: 16519 - protein, 11 aa, Artificial Sequence
  Description of Artificial Sequence: Synthetic peptide
  XENP019167 vhCDR3
YYGNYGGYFDV

SEQ ID NO: 16520 - protein, 214 aa, Artificial Sequence; identical to SEQ ID NO: 16330
  Description of Artificial Sequence: Synthetic polypeptide
  XENP019167 1G6_H1.90_L1.175_IgG1_PVA_/S267K Light Chain

SEQ ID NO: 16521 - protein, 107 aa, Artificial Sequence; identical to SEQ ID NO: 10618
  Description of Artificial Sequence: Synthetic polypeptide
  VL of XENP019167

SEQ ID NO: 16522 - protein, 11 aa, Artificial Sequence
  Description of Artificial Sequence: Synthetic peptide
  XENP019167 vlCDR1
RASQSVGNDVA

SEQ ID NO: 16523 - protein, 7 aa, Artificial Sequence
  Description of Artificial Sequence: Synthetic peptide
  XENP019167 vlCDR2
YASHRYT

SEQ ID NO: 16524 - protein, 9 aa, Artificial Sequence
  Description of Artificial Sequence: Synthetic peptide
  XENP019167 vlCDR3
QQDWSSPRT

SEQ ID NO: 16525 - protein, 451 aa, Artificial Sequence; identical to SEQ ID NO: 15945
  Description of Artificial Sequence: Synthetic polypeptide
  XENP019168 1G6_H1.269_L1.175_IgG1_PVA_/S267K Heavy Chain

SEQ ID NO: 16526 - protein, 122 aa, Artificial Sequence; identical to SEQ ID NO: 10275
  Description of Artificial Sequence: Synthetic polypeptide
  VH of XENP019168

SEQ ID NO: 16527 - protein, 5 aa, Artificial Sequence
  Description of Artificial Sequence: Synthetic peptide
  XENP019168 vhCDR1
NFWMN

SEQ ID NO: 16528 - protein, 19 aa, Artificial Sequence
  Description of Artificial Sequence: Synthetic peptide
  XENP019168 vhCDR2
EIRLYSNNYATHYAEPVKG

SEQ ID NO: 16529 - protein, 11 aa, Artificial Sequence
  Description of Artificial Sequence: Synthetic peptide
  XENP019168 vhCDR3
YYGNYGGYFDV

SEQ ID NO: 16530 - protein, 214 aa, Artificial Sequence; identical to SEQ ID NO: 16330
  Description of Artificial Sequence: Synthetic polypeptide
  XENP019168 1G6_H1.269_L1.175_IgG1_PVA_/S267K Light Chain

SEQ ID NO: 16531 - protein, 107 aa, Artificial Sequence; identical to SEQ ID NO: 10618
  Description of Artificial Sequence: Synthetic polypeptide
  VL of XENP019168

SEQ ID NO: 16532 - protein, 11 aa, Artificial Sequence
  Description of Artificial Sequence: Synthetic peptide
  XENP019168 vlCDR1
RASQSVGNDVA

SEQ ID NO: 16533 - protein, 7 aa, Artificial Sequence
  Description of Artificial Sequence: Synthetic peptide
  XENP019168 vlCDR2
YASHRYT

SEQ ID NO: 16534 - protein, 9 aa, Artificial Sequence
  Description of Artificial Sequence: Synthetic peptide
  XENP019168 vlCDR3
QQDWSSPRT

SEQ ID NO: 16535 - protein, 451 aa, Artificial Sequence; identical to SEQ ID NO: 15965
  Description of Artificial Sequence: Synthetic polypeptide
  XENP019169 1G6_H1.271_L1.175_IgG1_PVA_/S267K Heavy Chain

SEQ ID NO: 16536 - protein, 122 aa, Artificial Sequence; identical to SEQ ID NO: 10293
  Description of Artificial Sequence: Synthetic polypeptide
  VH of XENP019169

SEQ ID NO: 16537 - protein, 5 aa, Artificial Sequence
  Description of Artificial Sequence: Synthetic peptide
  XENP019169 vhCDR1
NYWMN

SEQ ID NO: 16538 - protein, 19 aa, Artificial Sequence
  Description of Artificial Sequence: Synthetic peptide
  XENP019169 vhCDR2
EIRLYSNNYATHYAEPVKG

SEQ ID NO: 16539 - protein, 11 aa, Artificial Sequence
  Description of Artificial Sequence: Synthetic peptide
  XENP019169 vhCDR3
YYGNYGGYFDV

SEQ ID NO: 16540 - protein, 214 aa, Artificial Sequence; identical to SEQ ID NO: 16330
  Description of Artificial Sequence: Synthetic polypeptide
  XENP019169 1G6_H1.271_L1.175_IgG1_PVA_/S267K Light Chain

SEQ ID NO: 16541 - protein, 107 aa, Artificial Sequence; identical to SEQ ID NO: 10618
  Description of Artificial Sequence: Synthetic polypeptide
  VL of XENP019169

SEQ ID NO: 16542 - protein, 11 aa, Artificial Sequence
  Description of Artificial Sequence: Synthetic peptide
  XENP019169 vlCDR1
RASQSVGNDVA

SEQ ID NO: 16543 - protein, 7 aa, Artificial Sequence
  Description of Artificial Sequence: Synthetic peptide
  XENP019169 vlCDR2
YASHRYT

SEQ ID NO: 16544 - protein, 9 aa, Artificial Sequence
  Description of Artificial Sequence: Synthetic peptide
  XENP019169 vlCDR3
QQDWSSPRT

SEQ ID NO: 16545 - protein, 451 aa, Artificial Sequence; identical to SEQ ID NO: 15975
  Description of Artificial Sequence: Synthetic polypeptide
  XENP019170 1G6_H1.272_L1.175_IgG1_PVA_/S267K Heavy Chain

SEQ ID NO: 16546 - protein, 122 aa, Artificial Sequence; identical to SEQ ID NO: 10302
  Description of Artificial Sequence: Synthetic polypeptide
  VH of XENP019170

SEQ ID NO: 16547 - protein, 5 aa, Artificial Sequence
  Description of Artificial Sequence: Synthetic peptide
  XENP019170 vhCDR1
NFWMN

SEQ ID NO: 16548 - protein, 19 aa, Artificial Sequence
  Description of Artificial Sequence: Synthetic peptide
  XENP019170 vhCDR2
EIRLYSNNYATHYAEPVKG

SEQ ID NO: 16549 - protein, 11 aa, Artificial Sequence
  Description of Artificial Sequence: Synthetic peptide
  XENP019170 vhCDR3
YYGNYGGYFDV

SEQ ID NO: 16550 - protein, 214 aa, Artificial Sequence; identical to SEQ ID NO: 16330
  Description of Artificial Sequence: Synthetic polypeptide
  XENP019170 1G6_H1.272_L1.175_IgG1_PVA_/S267K Light Chain

SEQ ID NO: 16551 - protein, 107 aa, Artificial Sequence; identical to SEQ ID NO: 10618
  Description of Artificial Sequence: Synthetic polypeptide
  VL of XENP019170

SEQ ID NO: 16552 - protein, 11 aa, Artificial Sequence
  Description of Artificial Sequence: Synthetic peptide
  XENP019170 vlCDR1
RASQSVGNDVA

SEQ ID NO: 16553 - protein, 7 aa, Artificial Sequence
  Description of Artificial Sequence: Synthetic peptide
  XENP019170 vlCDR2
YASHRYT

SEQ ID NO: 16554 - protein, 9 aa, Artificial Sequence
  Description of Artificial Sequence: Synthetic peptide
  XENP019170 vlCDR3
QQDWSSPRT

SEQ ID NO: 16555 - protein, 451 aa, Artificial Sequence; identical to SEQ ID NO: 11545
  Description of Artificial Sequence: Synthetic polypeptide
  XENP019172 1G6_H1_L1.190_IgG1_PVA_/S267K Heavy Chain

SEQ ID NO: 16556 - protein, 122 aa, Artificial Sequence; identical to SEQ ID NO: 6246
  Description of Artificial Sequence: Synthetic polypeptide
  VH of XENP019172

SEQ ID NO: 16557 - protein, 5 aa, Artificial Sequence
  Description of Artificial Sequence: Synthetic peptide
  XENP019172 vhCDR1
NYWMN

SEQ ID NO: 16558 - protein, 19 aa, Artificial Sequence
  Description of Artificial Sequence: Synthetic peptide
  XENP019172 vhCDR2
EIRLKSNNYATHYAEPVKG

SEQ ID NO: 16559 - protein, 11 aa, Artificial Sequence
  Description of Artificial Sequence: Synthetic peptide
  XENP019172 vhCDR3
YYGNYGGYFDV

SEQ ID NO: 16560 - protein, 214 aa, Artificial Sequence
  Description of Artificial Sequence: Synthetic polypeptide
  XENP019172 1G6_H1_L1.190_IgG1_PVA_/S267K Light Chain
SIVMTQSPATLSVSPGERATLSCRASQSVGNDVAWYQQKPGQSPRLLINYASHRYTGVPDRFTGSGYGTEFTLTISSLQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16561 - protein, 107 aa, Artificial Sequence; identical to SEQ ID NO: 10828
  Description of Artificial Sequence: Synthetic polypeptide
  VL of XENP019172

SEQ ID NO: 16562 - protein, 11 aa, Artificial Sequence
  Description of Artificial Sequence: Synthetic peptide
  XENP019172 vlCDR1
RASQSVGNDVA

SEQ ID NO: 16563 - protein, 7 aa, Artificial Sequence
  Description of Artificial Sequence: Synthetic peptide
  XENP019172 vlCDR2
YASHRYT

SEQ ID NO: 16564 - protein, 9 aa, Artificial Sequence
  Description of Artificial Sequence: Synthetic peptide
  XENP019172 vlCDR3
QQDFSSPRT

SEQ ID NO: 16565 - protein, 451 aa, Artificial Sequence; identical to SEQ ID NO: 11545
  Description of Artificial Sequence: Synthetic polypeptide
  XENP019173 1G6_H1_L1.191_IgG1_PVA_/S267K Heavy Chain

SEQ ID NO: 16566 - protein, 122 aa, Artificial Sequence; identical to SEQ ID NO: 6246
  Description of Artificial Sequence: Synthetic polypeptide
  VH of XENP019173

SEQ ID NO: 16567 - protein, 5 aa, Artificial Sequence
  Description of Artificial Sequence: Synthetic peptide
  XENP019173 vhCDR1
NYWMN

SEQ ID NO: 16568 - protein, 19 aa, Artificial Sequence
  Description of Artificial Sequence: Synthetic peptide
  XENP019173 vhCDR2
EIRLKSNNYATHYAEPVKG

SEQ ID NO: 16569 - protein, 11 aa, Artificial Sequence
  Description of Artificial Sequence: Synthetic peptide
  XENP019173 vhCDR3
YYGNYGGYFDV

SEQ ID NO: 16570 - protein, 214 aa, Artificial Sequence
  Description of Artificial Sequence: Synthetic polypeptide
  XENP019173 1G6_H1_L1.191_IgG1_PVA_/S267K Light Chain
SIVMTQSPATLSVSPGERATLSCRASQSVGNDVAWYQQKPGQSPRLLINYASHRYTGVPDRFTGSGYGTEFTLTISSLQSEDFAVYFCQQDWSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16571 - protein, 107 aa, Artificial Sequence; identical to SEQ ID NO: 10837
  Description of Artificial Sequence: Synthetic polypeptide
  VL of XENP019173

SEQ ID NO: 16572 - protein, 11 aa, Artificial Sequence
  Description of Artificial Sequence: Synthetic peptide
  XENP019173 vlCDR1
RASQSVGNDVA

SEQ ID NO: 16573 - protein, 7 aa, Artificial Sequence
  Description of Artificial Sequence: Synthetic peptide
  XENP019173 vlCDR2
YASHRYT

SEQ ID NO: 16574 - protein, 9 aa, Artificial Sequence
  Description of Artificial Sequence: Synthetic peptide
  XENP019173 vlCDR3
QQDWSSPRT

SEQ ID NO: 16575 - protein, 451 aa, Artificial Sequence; identical to SEQ ID NO: 12615
  Description of Artificial Sequence: Synthetic polypeptide
  XENP019174 1G6_H1.90_L1.190_IgG1_PVA_/S267K Heavy Chain

SEQ ID NO: 16576 - protein, 122 aa, Artificial Sequence; identical to SEQ ID NO: 7161
  Description of Artificial Sequence: Synthetic polypeptide
  VH of XENP019174

SEQ ID NO: 16577 - protein, 5 aa, Artificial Sequence
  Description of Artificial Sequence: Synthetic peptide
  XENP019174 vhCDR1
NYWMN

SEQ ID NO: 16578 - protein, 19 aa, Artificial Sequence
  Description of Artificial Sequence: Synthetic peptide
  XENP019174 vhCDR2
EIRLYSNNYATHYAEPVKG

SEQ ID NO: 16579 - protein, 11 aa, Artificial Sequence
  Description of Artificial Sequence: Synthetic peptide
  XENP019174 vhCDR3
YYGNYGGYFDV

SEQ ID NO: 16580 - protein, 214 aa, Artificial Sequence; identical to SEQ ID NO: 16560
  Description of Artificial Sequence: Synthetic polypeptide
  XENP019174 1G6_H1.90_L1.190_IgG1_PVA_/S267K Light Chain

SEQ ID NO: 16581 - protein, 107 aa, Artificial Sequence; identical to SEQ ID NO: 10828
  Description of Artificial Sequence: Synthetic polypeptide
  VL of XENP019174

SEQ ID NO: 16582 - protein, 11 aa, Artificial Sequence
  Description of Artificial Sequence: Synthetic peptide
  XENP019174 vlCDR1
RASQSVGNDVA

SEQ ID NO: 16583 - protein, 7 aa, Artificial Sequence
  Description of Artificial Sequence: Synthetic peptide
  XENP019174 vlCDR2
YASHRYT

SEQ ID NO: 16584 - protein, 9 aa, Artificial Sequence
  Description of Artificial Sequence: Synthetic peptide
  XENP019174 vlCDR3
QQDFSSPRT

SEQ ID NO: 16585 - protein, 451 aa, Artificial Sequence; identical to SEQ ID NO: 12615
  Description of Artificial Sequence: Synthetic polypeptide
  XENP019175 1G6_H1.90_L1.191_IgG1_PVA_/S267K Heavy Chain

SEQ ID NO: 16586 - protein, 122 aa, Artificial Sequence; identical to SEQ ID NO: 7161
  Description of Artificial Sequence: Synthetic polypeptide
  VH of XENP019175

SEQ ID NO: 16587 - protein, 5 aa, Artificial Sequence
  Description of Artificial Sequence: Synthetic peptide
  XENP019175 vhCDR1
NYWMN

SEQ ID NO: 16588 - protein, 19 aa, Artificial Sequence
  Description of Artificial Sequence: Synthetic peptide
  XENP019175 vhCDR2
EIRLYSNNYATHYAEPVKG

SEQ ID NO: 16589 - protein, 11 aa, Artificial Sequence
  Description of Artificial Sequence: Synthetic peptide
  XENP019175 vhCDR3
YYGNYGGYFDV

SEQ ID NO: 16590 - protein, 214 aa, Artificial Sequence; identical to SEQ ID NO: 16570
  Description of Artificial Sequence: Synthetic polypeptide
  XENP019175 1G6_H1.90_L1.191_IgG1_PVA_/S267K Light Chain

SEQ ID NO: 16591 - protein, 107 aa, Artificial Sequence; identical to SEQ ID NO: 10837
  Description of Artificial Sequence: Synthetic polypeptide
  VL of XENP019175

SEQ ID NO: 16592 - protein, 11 aa, Artificial Sequence
  Description of Artificial Sequence: Synthetic peptide
  XENP019175 vlCDR1
RASQSVGNDVA

SEQ ID NO: 16593 - protein, 7 aa, Artificial Sequence
  Description of Artificial Sequence: Synthetic peptide
  XENP019175 vlCDR2
YASHRYT

SEQ ID NO: 16594 - protein, 9 aa, Artificial Sequence
  Description of Artificial Sequence: Synthetic peptide
  XENP019175 vlCDR3
QQDWSSPRT

SEQ ID NO: 16595 - protein, 451 aa, Artificial Sequence; identical to SEQ ID NO: 15945
  Description of Artificial Sequence: Synthetic polypeptide
  XENP019176 1G6_H1.269_L1.190_IgG1_PVA_/S267K Heavy Chain

SEQ ID NO: 16596 - protein, 122 aa, Artificial Sequence; identical to SEQ ID NO: 10275
  Description of Artificial Sequence: Synthetic polypeptide
  VH of XENP019176

SEQ ID NO: 16597 - protein, 5 aa, Artificial Sequence
  Description of Artificial Sequence: Synthetic peptide
  XENP019176 vhCDR1
NFWMN

SEQ ID NO: 16598 - protein, 19 aa, Artificial Sequence
  Description of Artificial Sequence: Synthetic peptide
  XENP019176 vhCDR2
EIRLYSNNYATHYAEPVKG

SEQ ID NO: 16599 - protein, 11 aa, Artificial Sequence
  Description of Artificial Sequence: Synthetic peptide
  XENP019176 vhCDR3
YYGNYGGYFDV

SEQ ID NO: 16600 - protein, 214 aa, Artificial Sequence; identical to SEQ ID NO: 16560
  Description of Artificial Sequence: Synthetic polypeptide
  XENP019176 1G6_H1.269_L1.190_IgG1_PVA_/S267K Light Chain

SEQ ID NO: 16601 - protein, 107 aa, Artificial Sequence; identical to SEQ ID NO: 10828
  Description of Artificial Sequence: Synthetic polypeptide
  VL of XENP019176

SEQ ID NO: 16602 - protein, 11 aa, Artificial Sequence
  Description of Artificial Sequence: Synthetic peptide
  XENP019176 vlCDR1
RASQSVGNDVA

SEQ ID NO: 16603 - protein, 7 aa, Artificial Sequence
  Description of Artificial Sequence: Synthetic peptide
  XENP019176 vlCDR2
YASHRYT

SEQ ID NO: 16604 - protein, 9 aa, Artificial Sequence
  Description of Artificial Sequence: Synthetic peptide
  XENP019176 vlCDR3
QQDFSSPRT

SEQ ID NO: 16605 - protein, 451 aa, Artificial Sequence; identical to SEQ ID NO: 15965
  Description of Artificial Sequence: Synthetic polypeptide
  XENP019177 1G6_H1.271_L1.190_IgG1_PVA_/S267K Heavy Chain

SEQ ID NO: 16606 - protein, 122 aa, Artificial Sequence; identical to SEQ ID NO: 10293
  Description of Artificial Sequence: Synthetic polypeptide
  VH of XENP019177

SEQ ID NO: 16607 - protein, 5 aa, Artificial Sequence
  Description of Artificial Sequence: Synthetic peptide
  XENP019177 vhCDR1
NYWMN

SEQ ID NO: 16608 - protein, 19 aa, Artificial Sequence
  Description of Artificial Sequence: Synthetic peptide
  XENP019177 vhCDR2
EIRLYSNNYATHYAEPVKG

SEQ ID NO: 16609 - protein, 11 aa, Artificial Sequence
  Description of Artificial Sequence: Synthetic peptide
  XENP019177 vhCDR3
YYGNYGGYFDV

SEQ ID NO: 16610 - protein, 214 aa, Artificial Sequence; identical to SEQ ID NO: 16560
  Description of Artificial Sequence: Synthetic polypeptide
  XENP019177 1G6_H1.271_L1.190_IgG1_PVA_/S267K Light Chain

SEQ ID NO: 16611 - protein, 107 aa, Artificial Sequence; identical to SEQ ID NO: 10828
  Description of Artificial Sequence: Synthetic polypeptide
  VL of XENP019177

SEQ ID NO: 16612 - protein, 11 aa, Artificial Sequence
  Description of Artificial Sequence: Synthetic peptide
  XENP019177 vlCDR1
RASQSVGNDVA

SEQ ID NO: 16613 - protein, 7 aa, Artificial Sequence
  Description of Artificial Sequence: Synthetic peptide
  XENP019177 vlCDR2
YASHRYT

SEQ ID NO: 16614 - protein, 9 aa, Artificial Sequence
  Description of Artificial Sequence: Synthetic peptide
  XENP019177 vlCDR3
QQDFSSPRT

SEQ ID NO: 16615 - protein, 451 aa, Artificial Sequence; identical to SEQ ID NO: 15975
  Description of Artificial Sequence: Synthetic polypeptide
  XENP019178 1G6_H1.272_L1.190_IgG1_PVA_/S267K Heavy Chain

SEQ ID NO: 16616 - protein, 122 aa, Artificial Sequence; identical to SEQ ID NO: 10302
  Description of Artificial Sequence: Synthetic polypeptide
  VH of XENP019178

SEQ ID NO: 16617 - protein, 5 aa, Artificial Sequence
  Description of Artificial Sequence: Synthetic peptide
  XENP019178 vhCDR1
NFWMN

SEQ ID NO: 16618 - protein, 19 aa, Artificial Sequence
  Description of Artificial Sequence: Synthetic peptide
  XENP019178 vhCDR2
EIRLYSNNYATHYAEPVKG

SEQ ID NO: 16619 - protein, 11 aa, Artificial Sequence
  Description of Artificial Sequence: Synthetic peptide
  XENP019178 vhCDR3
YYGNYGGYFDV

SEQ ID NO: 16620 - protein, 214 aa, Artificial Sequence; identical to SEQ ID NO: 16560
  Description of Artificial Sequence: Synthetic polypeptide
  XENP019178 1G6_H1.272_L1.190_IgG1_PVA_/S267K Light Chain

SEQ ID NO: 16621 - protein, 107 aa, Artificial Sequence; identical to SEQ ID NO: 10828
  Description of Artificial Sequence: Synthetic polypeptide
  VL of XENP019178

SEQ ID NO: 16622 - protein, 11 aa, Artificial Sequence
  Description of Artificial Sequence: Synthetic peptide
  XENP019178 vlCDR1
RASQSVGNDVA

SEQ ID NO: 16623 - protein, 7 aa, Artificial Sequence
  Description of Artificial Sequence: Synthetic peptide
  XENP019178 vlCDR2
YASHRYT

SEQ ID NO: 16624 - protein, 9 aa, Artificial Sequence
  Description of Artificial Sequence: Synthetic peptide
  XENP019178 vlCDR3
QQDFSSPRT

SEQ ID NO: 16625 - protein, 451 aa, Artificial Sequence; identical to SEQ ID NO: 15945
  Description of Artificial Sequence: Synthetic polypeptide
  XENP019179 1G6_H1.269_L1.191_IgG1_PVA_/S267K Heavy Chain

SEQ ID NO: 16626 - protein, 122 aa, Artificial Sequence; identical to SEQ ID NO: 10275
  Description of Artificial Sequence: Synthetic polypeptide
  VH of XENP019179

SEQ ID NO: 16627 - protein, 5 aa, Artificial Sequence
  Description of Artificial Sequence: Synthetic peptide
  XENP019179 vhCDR1
NFWMN

SEQ ID NO: 16628 - protein, 19 aa, Artificial Sequence
  Description of Artificial Sequence: Synthetic peptide
  XENP019179 vhCDR2
EIRLYSNNYATHYAEPVKG

SEQ ID NO: 16629 - protein, 11 aa, Artificial Sequence
  Description of Artificial Sequence: Synthetic peptide
  XENP019179 vhCDR3
YYGNYGGYFDV

SEQ ID NO: 16630 - protein, 214 aa, Artificial Sequence; identical to SEQ ID NO: 16570
  Description of Artificial Sequence: Synthetic polypeptide
  XENP019179 1G6_H1.269_L1.191_IgG1_PVA_/S267K Light Chain

SEQ ID NO: 16631 - protein, 107 aa, Artificial Sequence; identical to SEQ ID NO: 10837
  Description of Artificial Sequence: Synthetic polypeptide
  VL of XENP019179

SEQ ID NO: 16632 - protein, 11 aa, Artificial Sequence
  Description of Artificial Sequence: Synthetic peptide
  XENP019179 vlCDR1
RASQSVGNDVA

SEQ ID NO: 16633 - protein, 7 aa, Artificial Sequence
  Description of Artificial Sequence: Synthetic peptide
  XENP019179 vlCDR2
YASHRYT

SEQ ID NO: 16634 - protein, 9 aa, Artificial Sequence
  Description of Artificial Sequence: Synthetic peptide
  XENP019179 vlCDR3
QQDWSSPRT

SEQ ID NO: 16635 - protein, 451 aa, Artificial Sequence; identical to SEQ ID NO: 15965
  Description of Artificial Sequence: Synthetic polypeptide
  XENP019180 1G6_H1.271_L1.191_IgG1_PVA_/S267K Heavy Chain

SEQ ID NO: 16636 - protein, 122 aa, Artificial Sequence; identical to SEQ ID NO: 10293
  Description of Artificial Sequence: Synthetic polypeptide
  VH of XENP019180

SEQ ID NO: 16637 - protein, 5 aa, Artificial Sequence
  Description of Artificial Sequence: Synthetic peptide
  XENP019180 vhCDR1
NYWMN

SEQ ID NO: 16638 - protein, 19 aa, Artificial Sequence
  Description of Artificial Sequence: Synthetic peptide
  XENP019180 vhCDR2
EIRLYSNNYATHYAEPVKG

SEQ ID NO: 16639 - protein, 11 aa, Artificial Sequence
  Description of Artificial Sequence: Synthetic peptide
  XENP019180 vhCDR3
YYGNYGGYFDV

SEQ ID NO: 16640 - protein, 214 aa, Artificial Sequence; identical to SEQ ID NO: 16570
  Description of Artificial Sequence: Synthetic polypeptide
  XENP019180 1G6_H1.271_L1.191_IgG1_PVA_/S267K Light Chain

SEQ ID NO: 16641 - protein, 107 aa, Artificial Sequence; identical to SEQ ID NO: 10837
  Description of Artificial Sequence: Synthetic polypeptide
  VL of XENP019180

SEQ ID NO: 16642 - protein, 11 aa, Artificial Sequence
  Description of Artificial Sequence: Synthetic peptide
  XENP019180 vlCDR1
RASQSVGNDVA

SEQ ID NO: 16643 - protein, 7 aa, Artificial Sequence
  Description of Artificial Sequence: Synthetic peptide
  XENP019180 vlCDR2
YASHRYT

SEQ ID NO: 16644 - protein, 9 aa, Artificial Sequence
  Description of Artificial Sequence: Synthetic peptide
  XENP019180 vlCDR3
QQDWSSPRT

SEQ ID NO: 16645 - protein, 451 aa, Artificial Sequence; identical to SEQ ID NO: 15975
  Description of Artificial Sequence: Synthetic polypeptide
  XENP019181 1G6_H1.272_L1.191_IgG1_PVA_/S267K Heavy Chain

SEQ ID NO: 16646 - protein, 122 aa, Artificial Sequence; identical to SEQ ID NO: 10302
  Description of Artificial Sequence: Synthetic polypeptide
  VH of XENP019181

SEQ ID NO: 16647 - protein, 5 aa, Artificial Sequence
  Description of Artificial Sequence: Synthetic peptide
  XENP019181 vhCDR1
NFWMN

SEQ ID NO: 16648 - protein, 19 aa, Artificial Sequence
  Description of Artificial Sequence: Synthetic peptide
  XENP019181 vhCDR2
EIRLYSNNYATHYAEPVKG

SEQ ID NO: 16649 - protein, 11 aa, Artificial Sequence
  Description of Artificial Sequence: Synthetic peptide
  XENP019181 vhCDR3
YYGNYGGYFDV

SEQ ID NO: 16650 - protein, 214 aa, Artificial Sequence; identical to SEQ ID NO: 16570
  Description of Artificial Sequence: Synthetic polypeptide
  XENP019181 1G6_H1.272_L1.191_IgG1_PVA_/S267K Light Chain

SEQ ID NO: 16651 - protein, 107 aa, Artificial Sequence; identical to SEQ ID NO: 10837
  Description of Artificial Sequence: Synthetic polypeptide
  VL of XENP019181

SEQ ID NO: 16652 - protein, 11 aa, Artificial Sequence
  Description of Artificial Sequence: Synthetic peptide
  XENP019181 vlCDR1
RASQSVGNDVA

SEQ ID NO: 16653 - protein, 7 aa, Artificial Sequence
  Description of Artificial Sequence: Synthetic peptide
  XENP019181 vlCDR2
YASHRYT

SEQ ID NO: 16654 - protein, 9 aa, Artificial Sequence
  Description of Artificial Sequence: Synthetic peptide
  XENP019181 vlCDR3
QQDWSSPRT

SEQ ID NO: 16655 - protein, 451 aa, Artificial Sequence; identical to SEQ ID NO: 11545
  Description of Artificial Sequence: Synthetic polypeptide
  XENP019193 1G6_H1_L1.188_IgG1_PVA_/S267K Heavy Chain

SEQ ID NO: 16656 - protein, 122 aa, Artificial Sequence; identical to SEQ ID NO: 6246
  Description of Artificial Sequence: Synthetic polypeptide
  VH of XENP019193

SEQ ID NO: 16657 - protein, 5 aa, Artificial Sequence
  Description of Artificial Sequence: Synthetic peptide
  XENP019193 vhCDR1
NYWMN

SEQ ID NO: 16658 - protein, 19 aa, Artificial Sequence
  Description of Artificial Sequence: Synthetic peptide
  XENP019193 vhCDR2
EIRLKSNNYATHYAEPVKG

SEQ ID NO: 16659 - protein, 11 aa, Artificial Sequence
  Description of Artificial Sequence: Synthetic peptide
  XENP019193 vhCDR3
YYGNYGGYFDV

SEQ ID NO: 16660 - protein, 214 aa, Artificial Sequence
  Description of Artificial Sequence: Synthetic polypeptide
  XENP019193 1G6_H1_L1.188_IgG1_PVA_/S267K Light Chain
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16661 - protein, 107 aa, Artificial Sequence; identical to SEQ ID NO: 10855
  Description of Artificial Sequence: Synthetic polypeptide
  VL of XENP019193

SEQ ID NO: 16662 - protein, 11 aa, Artificial Sequence
  Description of Artificial Sequence: Synthetic peptide
  XENP019193 vlCDR1
RASQSVGNDVA

SEQ ID NO: 16663 - protein, 7 aa, Artificial Sequence
  Description of Artificial Sequence: Synthetic peptide
  XENP019193 vlCDR2
YASHRYT

SEQ ID NO: 16664 - protein, 9 aa, Artificial Sequence
  Description of Artificial Sequence: Synthetic peptide
  XENP019193 vlCDR3
QQDFSSPRT

SEQ ID NO: 16665 - protein, 451 aa, Artificial Sequence; identical to SEQ ID NO: 11545
  Description of Artificial Sequence: Synthetic polypeptide
  XENP019194 1G6_H1_L1.189_IgG1_PVA_/S267K Heavy Chain

SEQ ID NO: 16666 - protein, 122 aa, Artificial Sequence; identical to SEQ ID NO: 6246
  Description of Artificial Sequence: Synthetic polypeptide
  VH of XENP019194

SEQ ID NO: 16667 - protein, 5 aa, Artificial Sequence
  Description of Artificial Sequence: Synthetic peptide
  XENP019194 vhCDR1
NYWMN

SEQ ID NO: 16668 - protein, 19 aa, Artificial Sequence
  Description of Artificial Sequence: Synthetic peptide
  XENP019194 vhCDR2
EIRLKSNNYATHYAEPVKG

SEQ ID NO: 16669 - protein, 11 aa, Artificial Sequence
  Description of Artificial Sequence: Synthetic peptide
  XENP019194 vhCDR3
YYGNYGGYFDV

SEQ ID NO: 16670 - protein, 214 aa, Artificial Sequence
  Description of Artificial Sequence: Synthetic polypeptide
  XENP019194 1G6_H1_L1.189_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16671 - protein, 107 aa, Artificial Sequence; identical to SEQ ID NO: 10864
  Description of Artificial Sequence: Synthetic polypeptide
  VL of XENP019194

SEQ ID NO: 16672 - protein, 11 aa, Artificial Sequence
  Description of Artificial Sequence: Synthetic peptide
  XENP019194 vlCDR1
RASQSVGNDVA

SEQ ID NO: 16673 - protein, 7 aa, Artificial Sequence
  Description of Artificial Sequence: Synthetic peptide
  XENP019194 vlCDR2
YASHRYT

SEQ ID NO: 16674 - protein, 9 aa, Artificial Sequence
  Description of Artificial Sequence: Synthetic peptide
  XENP019194 vlCDR3
QQDFSSPRT

SEQ ID NO: 16675 - protein, 451 aa, Artificial Sequence
  Description of Artificial Sequence: Synthetic polypeptide
  XENP019195 1G6_H1.278_L1.188_IgG1_PVA_/S267K Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16676 - protein, 122 aa, Artificial Sequence; identical to SEQ ID NO: 10845
  Description of Artificial Sequence: Synthetic polypeptide
  VH of XENP019195

SEQ ID NO: 16677 - protein, 5 aa, Artificial Sequence
  Description of Artificial Sequence: Synthetic peptide
  XENP019195 vhCDR1
NYWMN

SEQ ID NO: 16678 - protein, 19 aa, Artificial Sequence
  Description of Artificial Sequence: Synthetic peptide
  XENP019195 vhCDR2
EIRLYSNNYATHYAESVKG

SEQ ID NO: 16679 - protein, 11 aa, Artificial Sequence
  Description of Artificial Sequence: Synthetic peptide
  XENP019195 vhCDR3
YYGNYGGYFDV

SEQ ID NO: 16680 - protein, 214 aa, Artificial Sequence; identical to SEQ ID NO: 16660
  Description of Artificial Sequence: Synthetic polypeptide
  XENP019195 1G6_H1.278_L1.188_IgG1_PVA_/S267K Light Chain

SEQ ID NO: 16681 - protein, 107 aa, Artificial Sequence; identical to SEQ ID NO: 10855
  Description of Artificial Sequence: Synthetic polypeptide
  VL of XENP019195

SEQ ID NO: 16682 - protein, 11 aa, Artificial Sequence
  Description of Artificial Sequence: Synthetic peptide
  XENP019195 vlCDR1
RASQSVGNDVA

SEQ ID NO: 16683 - protein, 7 aa, Artificial Sequence
  Description of Artificial Sequence: Synthetic peptide
  XENP019195 vlCDR2
YASHRYT

SEQ ID NO: 16684 - protein, 9 aa, Artificial Sequence
  Description of Artificial Sequence: Synthetic peptide
  XENP019195 vlCDR3
QQDFSSPRT

SEQ ID NO: 16685 - protein, 451 aa, Artificial Sequence; identical to SEQ ID NO: 16675
  Description of Artificial Sequence: Synthetic polypeptide
  XENP019196 1G6_H1.278_L1.189_IgG1_PVA_/S267K Heavy Chain

SEQ ID NO: 16686 - protein, 122 aa, Artificial Sequence; identical to SEQ ID NO: 10845
  Description of Artificial Sequence: Synthetic polypeptide
  VH of XENP019196

SEQ ID NO: 16687 - protein, 5 aa, Artificial Sequence
  Description of Artificial Sequence: Synthetic peptide
  XENP019196 vhCDR1
NYWMN

SEQ ID NO: 16688 - protein, 19 aa, Artificial Sequence
  Description of Artificial Sequence: Synthetic peptide
  XENP019196 vhCDR2
EIRLYSNNYATHYAESVKG

SEQ ID NO: 16689 - protein, 11 aa, Artificial Sequence
  Description of Artificial Sequence: Synthetic peptide
  XENP019196 vhCDR3
YYGNYGGYFDV

SEQ ID NO: 16690 - protein, 214 aa, Artificial Sequence; identical to SEQ ID NO: 16670
  Description of Artificial Sequence: Synthetic polypeptide
  XENP019196 1G6_H1.278_L1.189_IgG1_PVA_/S267K Light Chain

SEQ ID NO: 16691 - protein, 107 aa, Artificial Sequence; identical to SEQ ID NO: 10864
  Description of Artificial Sequence: Synthetic polypeptide
  VL of XENP019196

SEQ ID NO: 16692 - protein, 11 aa, Artificial Sequence
  Description of Artificial Sequence: Synthetic peptide
  XENP019196 vlCDR1
RASQSVGNDVA

SEQ ID NO: 16693 - protein, 7 aa, Artificial Sequence
  Description of Artificial Sequence: Synthetic peptide
  XENP019196 vlCDR2
YASHRYT

SEQ ID NO: 16694 - protein, 9 aa, Artificial Sequence
  Description of Artificial Sequence: Synthetic peptide
  XENP019196 vlCDR3
QQDFSSPRT

SEQ ID NO: 16695 - protein, 451 aa, Artificial Sequence; identical to SEQ ID NO: 16675
  Description of Artificial Sequence: Synthetic polypeptide
  XENP019201 1G6_H1.278_L1_IgG1_PVA_/S267K Heavy Chain

SEQ ID NO: 16696 - protein, 122 aa, Artificial Sequence; identical to SEQ ID NO: 10845
  Description of Artificial Sequence: Synthetic polypeptide
  VH of XENP019201

SEQ ID NO: 16697 - protein, 5 aa, Artificial Sequence
  Description of Artificial Sequence: Synthetic peptide
  XENP019201 vhCDR1
NYWMN

SEQ ID NO: 16698 - protein, 19 aa, Artificial Sequence
  Description of Artificial Sequence: Synthetic peptide
  XENP019201 vhCDR2
EIRLYSNNYATHYAESVKG

SEQ ID NO: 16699 - protein, 11 aa, Artificial Sequence
  Description of Artificial Sequence: Synthetic peptide
  XENP019201 vhCDR3
YYGNYGGYFDV

SEQ ID NO: 16700 - protein, 214 aa, Artificial Sequence; identical to SEQ ID NO: 11550
  Description of Artificial Sequence: Synthetic polypeptide
  XENP019201 1G6_H1.278_L1_IgG1_PVA_/S267K Light Chain

SEQ ID NO: 16701 - protein, 107 aa, Artificial Sequence; identical to SEQ ID NO: 6247
  Description of Artificial Sequence: Synthetic polypeptide
  VL of XENP019201

SEQ ID NO: 16702 - protein, 11 aa, Artificial Sequence
  Description of Artificial Sequence: Synthetic peptide
  XENP019201 vlCDR1
RASQSVSNDVA

SEQ ID NO: 16703 - protein, 7 aa, Artificial Sequence
  Description of Artificial Sequence: Synthetic peptide
  XENP019201 vlCDR2
YASHRYT

SEQ ID NO: 16704 - protein, 9 aa, Artificial Sequence
  Description of Artificial Sequence: Synthetic peptide
  XENP019201 vlCDR3
QQDYSSPRT

SEQ ID NO: 16705 - protein, 451 aa, Artificial Sequence
  Description of Artificial Sequence: Synthetic polypeptide
  XENP019589 1G6_H1.279_L1.189_IgG1_PVA_/S267K Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16706 - protein, 122 aa, Artificial Sequence; identical to SEQ ID NO: 10908
  Description of Artificial Sequence: Synthetic polypeptide
  VH of XENP019589

SEQ ID NO: 16707 - protein, 5 aa, Artificial Sequence
  Description of Artificial Sequence: Synthetic peptide
  XENP019589 vhCDR1
NYWMN

SEQ ID NO: 16708 - protein, 19 aa, Artificial Sequence
  Description of Artificial Sequence: Synthetic peptide
  XENP019589 vhCDR2
EIRLYSNNYATHYAESVKG

SEQ ID NO: 16709 - protein, 11 aa, Artificial Sequence
  Description of Artificial Sequence: Synthetic peptide
  XENP019589 vhCDR3
YYGNYGGYFDV

SEQ ID NO: 16710 - protein, 214 aa, Artificial Sequence; identical to SEQ ID NO: 16670
  Description of Artificial Sequence: Synthetic polypeptide
  XENP019589 1G6_H1.279_L1.189_IgG1_PVA_/S267K Light Chain

SEQ ID NO: 16711 - protein, 107 aa, Artificial Sequence; identical to SEQ ID NO: 10864
  Description of Artificial Sequence: Synthetic polypeptide
  VL of XENP019589

SEQ ID NO: 16712 - protein, 11 aa, Artificial Sequence
  Description of Artificial Sequence: Synthetic peptide
  XENP019589 vlCDR1
RASQSVGNDVA

SEQ ID NO: 16713 - protein, 7 aa, Artificial Sequence
  Description of Artificial Sequence: Synthetic peptide
  XENP019589 vlCDR2
YASHRYT

SEQ ID NO: 16714 - protein, 9 aa, Artificial Sequence
  Description of Artificial Sequence: Synthetic peptide
  XENP019589 vlCDR3
QQDFSSPRT

SEQ ID NO: 16715 - protein, 451 aa, Artificial Sequence
  Description of Artificial Sequence: Synthetic polypeptide
  XENP019590 1G6_H1.280_L1.189_IgG1_PVA_/S267K Heavy Chain
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16716 - protein, 122 aa, Artificial Sequence; identical to SEQ ID NO: 10917
  Description of Artificial Sequence: Synthetic polypeptide
  VH of XENP019590

SEQ ID NO: 16717 - protein, 5 aa, Artificial Sequence
  Description of Artificial Sequence: Synthetic peptide
  XENP019590 vhCDR1
NYWMN

SEQ ID NO: 16718 - protein, 19 aa, Artificial Sequence
  Description of Artificial Sequence: Synthetic peptide
  XENP019590 vhCDR2
EIRLYSNNYATHYAESVKG

SEQ ID NO: 16719 - protein, 11 aa, Artificial Sequence
  Description of Artificial Sequence: Synthetic peptide
  XENP019590 vhCDR3
YYGNYGGYFDV

SEQ ID NO: 16720 - protein, 214 aa, Artificial Sequence; identical to SEQ ID NO: 16670
  Description of Artificial Sequence: Synthetic polypeptide
  XENP019590 1G6_H1.280_L1.189_IgG1_PVA_/S267K Light Chain

SEQ ID NO: 16721 - protein, 107 aa, Artificial Sequence; identical to SEQ ID NO: 10864
  Description of Artificial Sequence: Synthetic polypeptide
  VL of XENP019590

SEQ ID NO: 16722 - protein, 11 aa, Artificial Sequence
  Description of Artificial Sequence: Synthetic peptide
  XENP019590 vlCDR1
RASQSVGNDVA

SEQ ID NO: 16723 - protein, 7 aa, Artificial Sequence
  Description of Artificial Sequence: Synthetic peptide
  XENP019590 vlCDR2
YASHRYT

SEQ ID NO: 16724 - protein, 9 aa, Artificial Sequence
  Description of Artificial Sequence: Synthetic peptide
  XENP019590 vlCDR3
QQDFSSPRT

SEQ ID NO: 16725 - protein, 451 aa, Artificial Sequence
  Description of Artificial Sequence: Synthetic polypeptide
  XENP019591 1G6_H1.281_L1.189_IgG1_PVA_/S267K Heavy Chain
EVQLVESGGGLVKPGGSLRLSCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16726 - protein, 122 aa, Artificial Sequence; identical to SEQ ID NO: 10926
  Description of Artificial Sequence: Synthetic polypeptide
  VH of XENP019591

SEQ ID NO: 16727 - protein, 5 aa, Artificial Sequence
  Description of Artificial Sequence: Synthetic peptide
  XENP019591 vhCDR1
NYWMN

SEQ ID NO: 16728 - protein, 19 aa, Artificial Sequence
  Description of Artificial Sequence: Synthetic peptide
  XENP019591 vhCDR2
EIRLYSNNYATHYAESVKG

SEQ ID NO: 16729 - protein, 11 aa, Artificial Sequence
  Description of Artificial Sequence: Synthetic peptide
  XENP019591 vhCDR3
YYGNYGGYFDV

SEQ ID NO: 16730 - protein, 214 aa, Artificial Sequence; identical to SEQ ID NO: 16670
  Description of Artificial Sequence: Synthetic polypeptide
  XENP019591 1G6_H1.281_L1.189_IgG1_PVA_/S267K Light Chain

SEQ ID NO: 16731 - protein, 107 aa, Artificial Sequence; identical to SEQ ID NO: 10864
  Description of Artificial Sequence: Synthetic polypeptide
  VL of XENP019591

SEQ ID NO: 16732 - protein, 11 aa, Artificial Sequence
  Description of Artificial Sequence: Synthetic peptide
  XENP019591 vlCDR1
RASQSVGNDVA

SEQ ID NO: 16733 - protein, 7 aa, Artificial Sequence
  Description of Artificial Sequence: Synthetic peptide
  XENP019591 vlCDR2
YASHRYT

SEQ ID NO: 16734 - protein, 9 aa, Artificial Sequence
  Description of Artificial Sequence: Synthetic peptide
  XENP019591 vlCDR3
QQDFSSPRT

SEQ ID NO: 16735 - protein, 451 aa, Artificial Sequence
  Description of Artificial Sequence: Synthetic polypeptide
  XENP019592 1G6_H1.282_L1.189_IgG1_PVA_/S267K Heavy Chain
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16736 - protein, 122 aa, Artificial Sequence; identical to SEQ ID NO: 10935
  Description of Artificial Sequence: Synthetic polypeptide
  VH of XENP019592

SEQ ID NO: 16737 - protein, 5 aa, Artificial Sequence
  Description of Artificial Sequence: Synthetic peptide
  XENP019592 vhCDR1
NYWMN

SEQ ID NO: 16738 - protein, 19 aa, Artificial Sequence
  Description of Artificial Sequence: Synthetic peptide
  XENP019592 vhCDR2
EIRLYSNNYATHYAESVKG

SEQ ID NO: 16739 - protein, 11 aa, Artificial Sequence
  Description of Artificial Sequence: Synthetic peptide
  XENP019592 vhCDR3
YYGNYGGYFDV

SEQ ID NO: 16740 - protein, 214 aa, Artificial Sequence; identical to SEQ ID NO: 16670
  Description of Artificial Sequence: Synthetic polypeptide
  XENP019592 1G6_H1.282_L1.189_IgG1_PVA_/S267K Light Chain

SEQ ID NO: 16741 - protein, 107 aa, Artificial Sequence; identical to SEQ ID NO: 10864
  Description of Artificial Sequence: Synthetic polypeptide
  VL of XENP019592

SEQ ID NO: 16742 - protein, 11 aa, Artificial Sequence
  Description of Artificial Sequence: Synthetic peptide
  XENP019592 vlCDR1
RASQSVGNDVA

SEQ ID NO: 16743 - protein, 7 aa, Artificial Sequence
  Description of Artificial Sequence: Synthetic peptide
  XENP019592 vlCDR2
YASHRYT

SEQ ID NO: 16744 - protein, 9 aa, Artificial Sequence
  Description of Artificial Sequence: Synthetic peptide
  XENP019592 vlCDR3
QQDFSSPRT

SEQ ID NO: 16745 - protein, 451 aa, Artificial Sequence
  Description of Artificial Sequence: Synthetic polypeptide
  XENP019593 1G6_H1.283_L1.189_IgG1_PVA_/S267K Heavy Chain
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16746 - protein, 122 aa, Artificial Sequence; identical to SEQ ID NO: 10944
  Description of Artificial Sequence: Synthetic polypeptide
  VH of XENP019593

SEQ ID NO: 16747 - protein, 5 aa, Artificial Sequence
  Description of Artificial Sequence: Synthetic peptide
  XENP019593 vhCDR1
NYWMN

SEQ ID NO: 16748 - protein, 19 aa, Artificial Sequence
  Description of Artificial Sequence: Synthetic peptide
  XENP019593 vhCDR2
EIRLYSNNYATHYAESVKG

SEQ ID NO: 16749 - protein, 11 aa, Artificial Sequence
  Description of Artificial Sequence: Synthetic peptide
  XENP019593 vhCDR3
YYGNYGGYFDV

SEQ ID NO: 16750 - protein, 214 aa, Artificial Sequence; identical to SEQ ID NO: 16670
  Description of Artificial Sequence: Synthetic polypeptide
  XENP019593 1G6_H1.283_L1.189_IgG1_PVA_/S267K Light Chain

SEQ ID NO: 16751 - protein, 107 aa, Artificial Sequence; identical to SEQ ID NO: 10864
  Description of Artificial Sequence: Synthetic polypeptide
  VL of XENP019593

SEQ ID NO: 16752 - protein, 11 aa, Artificial Sequence
  Description of Artificial Sequence: Synthetic peptide
  XENP019593 vlCDR1
RASQSVGNDVA

SEQ ID NO: 16753 - protein, 7 aa, Artificial Sequence
  Description of Artificial Sequence: Synthetic peptide
  XENP019593 vlCDR2
YASHRYT

SEQ ID NO: 16754 - protein, 9 aa, Artificial Sequence
  Description of Artificial Sequence: Synthetic peptide
  XENP019593 vlCDR3
QQDFSSPRT

SEQ ID NO: 16755 - protein, 451 aa, Artificial Sequence
  Description of Artificial Sequence: Synthetic polypeptide
  XENP019594 1G6_H1.284_L1.189_IgG1_PVA_/S267K Heavy Chain
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16756 - protein, 122 aa, Artificial Sequence; identical to SEQ ID NO: 10953
  Description of Artificial Sequence: Synthetic polypeptide
  VH of XENP019594

SEQ ID NO: 16757 - protein, 5 aa, Artificial Sequence
  Description of Artificial Sequence: Synthetic peptide
  XENP019594 vhCDR1
NYWMN

SEQ ID NO: 16758 - protein, 19 aa, Artificial Sequence
  Description of Artificial Sequence: Synthetic peptide
  XENP019594 vhCDR2
EIRLYSNNYATHYAESVKG

SEQ ID NO: 16759 - protein, 11 aa, Artificial Sequence
  Description of Artificial Sequence: Synthetic peptide
  XENP019594 vhCDR3
YYGNYGGYFDV

SEQ ID NO: 16760 - protein, 214 aa, Artificial Sequence; identical to SEQ ID NO: 16670
  Description of Artificial Sequence: Synthetic polypeptide
  XENP019594 1G6_H1.284_L1.189_IgG1_PVA_/S267K Light Chain

SEQ ID NO: 16761 - protein, 107 aa, Artificial Sequence; identical to SEQ ID NO: 10864
  Description of Artificial Sequence: Synthetic polypeptide
  VL of XENP019594

SEQ ID NO: 16762 - protein, 11 aa, Artificial Sequence
  Description of Artificial Sequence: Synthetic peptide
  XENP019594 vlCDR1
RASQSVGNDVA

SEQ ID NO: 16763 - protein, 7 aa, Artificial Sequence
  Description of Artificial Sequence: Synthetic peptide
  XENP019594 vlCDR2
YASHRYT

SEQ ID NO: 16764 - protein, 9 aa, Artificial Sequence
  Description of Artificial Sequence: Synthetic peptide
  XENP019594 vlCDR3
QQDFSSPRT

SEQ ID NO: 16765 - protein, 451 aa, Artificial Sequence
  Description of Artificial Sequence: Synthetic polypeptide
  XENP019595 1G6_H1.285_L1.189_IgG1_PVA_/S267K Heavy Chain
EVQLVESGGGLVKPGGSLRLTCVASGFTFSNYWMNWVRQAPGKGLEWVCEIRLYSNNYATHYAESVKGRFTCSRDDSKSMLYLQMNNLKTEDTGVYYCTRYYGNYGGYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16766 - protein, 122 aa, Artificial Sequence; identical to SEQ ID NO: 10962
  Description of Artificial Sequence: Synthetic polypeptide
  VH of XENP019595

SEQ ID NO: 16767 - protein, 5 aa, Artificial Sequence
  Description of Artificial Sequence: Synthetic peptide
  XENP019595 vhCDR1
NYWMN

SEQ ID NO: 16768 - protein, 19 aa, Artificial Sequence
  Description of Artificial Sequence: Synthetic peptide
  XENP019595 vhCDR2
EIRLYSNNYATHYAESVKG

SEQ ID NO: 16769 - protein, 11 aa, Artificial Sequence
  Description of Artificial Sequence: Synthetic peptide
  XENP019595 vhCDR3
YYGNYGGYFDV

SEQ ID NO: 16770 - protein, 214 aa, Artificial Sequence; identical to SEQ ID NO: 16670
  Description of Artificial Sequence: Synthetic polypeptide
  XENP019595 1G6_H1.285_L1.189_IgG1_PVA_/S267K Light Chain

SEQ ID NO: 16771 - protein, 107 aa, Artificial Sequence; identical to SEQ ID NO: 10864
  Description of Artificial Sequence: Synthetic polypeptide
  VL of XENP019595

SEQ ID NO: 16772 - protein, 11 aa, Artificial Sequence
  Description of Artificial Sequence: Synthetic peptide
  XENP019595 vlCDR1
RASQSVGNDVA

SEQ ID NO: 16773 - protein, 7 aa, Artificial Sequence
  Description of Artificial Sequence: Synthetic peptide
  XENP019595 vlCDR2
YASHRYT

SEQ ID NO: 16774 - protein, 9 aa, Artificial Sequence
  Description of Artificial Sequence: Synthetic peptide
  XENP019595 vlCDR3
QQDFSSPRT

SEQ ID NO: 16775 - protein, 451 aa, Artificial Sequence
  Description of Artificial Sequence: Synthetic polypeptide
  XENP019596 1G6_H1.286_L1.189_IgG1_PVA_/S267K Heavy Chain
EVQLVESGGGLVKPGGSLRLSCVASGFTFSNYWMNWVRQAPGKGLEWVAEIRLYSDNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16776 - protein, 122 aa, Artificial Sequence; identical to SEQ ID NO: 10971
  Description of Artificial Sequence: Synthetic polypeptide
  VH of XENP019596

SEQ ID NO: 16777 - protein, 5 aa, Artificial Sequence
  Description of Artificial Sequence: Synthetic peptide
  XENP019596 vhCDR1
NYWMN

SEQ ID NO: 16778 - protein, 19 aa, Artificial Sequence
  Description of Artificial Sequence: Synthetic peptide
  XENP019596 vhCDR2
EIRLYSDNYATHYAESVKG

SEQ ID NO: 16779 - protein, 11 aa, Artificial Sequence
  Description of Artificial Sequence: Synthetic peptide
  XENP019596 vhCDR3
YYGNYGGYFDV

SEQ ID NO: 16780 - protein, 214 aa, Artificial Sequence; identical to SEQ ID NO: 16670
  Description of Artificial Sequence: Synthetic polypeptide
  XENP019596 1G6_H1.286_L1.189_IgG1_PVA_/S267K Light Chain

SEQ ID NO: 16781 - protein, 107 aa, Artificial Sequence; identical to SEQ ID NO: 10864
  Description of Artificial Sequence: Synthetic polypeptide
  VL of XENP019596

SEQ ID NO: 16782 - protein, 11 aa, Artificial Sequence
  Description of Artificial Sequence: Synthetic peptide
  XENP019596 vlCDR1
RASQSVGNDVA

SEQ ID NO: 16783 - protein, 7 aa, Artificial Sequence
  Description of Artificial Sequence: Synthetic peptide
  XENP019596 vlCDR2
YASHRYT

SEQ ID NO: 16784 - protein, 9 aa, Artificial Sequence
  Description of Artificial Sequence: Synthetic peptide
  XENP019596 vlCDR3
QQDFSSPRT

SEQ ID NO: 16785 - protein, 451 aa, Artificial Sequence; identical to SEQ ID NO: 16675
  Description of Artificial Sequence: Synthetic polypeptide
  XENP019601 1G6_H1.278_L1.192_IgG1_PVA_/S267K Heavy Chain

SEQ ID NO: 16786 - protein, 122 aa, Artificial Sequence; identical to SEQ ID NO: 10845
  Description of Artificial Sequence: Synthetic polypeptide
  VH of XENP019601

SEQ ID NO: 16787 - protein, 5 aa, Artificial Sequence
  Description of Artificial Sequence: Synthetic peptide
  XENP019601 vhCDR1
NYWMN

SEQ ID NO: 16788 - protein, 19 aa, Artificial Sequence
  Description of Artificial Sequence: Synthetic peptide
  XENP019601 vhCDR2
EIRLYSNNYATHYAESVKG

SEQ ID NO: 16789 - protein, 11 aa, Artificial Sequence
  Description of Artificial Sequence: Synthetic peptide
  XENP019601 vhCDR3
YYGNYGGYFDV

SEQ ID NO: 16790 - protein, 214 aa, Artificial Sequence
  Description of Artificial Sequence: Synthetic polypeptide
  XENP019601 1G6_H1.278_L1.192_IgG1_PVA_/S267K Light Chain
EIVLTQSPATLSASPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16791 - protein, 107 aa, Artificial Sequence; identical to SEQ ID NO: 10981
  Description of Artificial Sequence: Synthetic polypeptide
  VL of XENP019601

SEQ ID NO: 16792 - protein, 11 aa, Artificial Sequence
  Description of Artificial Sequence: Synthetic peptide
  XENP019601 vlCDR1
RASQSVGNDVA

SEQ ID NO: 16793 - protein, 7 aa, Artificial Sequence
  Description of Artificial Sequence: Synthetic peptide
  XENP019601 vlCDR2
YASHRYT

SEQ ID NO: 16794 - protein, 9 aa, Artificial Sequence
  Description of Artificial Sequence: Synthetic peptide
  XENP019601 vlCDR3
QQDFSSPRT

SEQ ID NO: 16795 - protein, 451 aa, Artificial Sequence; identical to SEQ ID NO: 16675
  Description of Artificial Sequence: Synthetic polypeptide
  XENP019602 1G6_H1.278_L1.193_IgG1_PVA_/S267K Heavy Chain

SEQ ID NO: 16796 - protein, 122 aa, Artificial Sequence; identical to SEQ ID NO: 10845
  Description of Artificial Sequence: Synthetic polypeptide
  VH of XENP019602

SEQ ID NO: 16797 - protein, 5 aa, Artificial Sequence
  Description of Artificial Sequence: Synthetic peptide
  XENP019602 vhCDR1
NYWMN

SEQ ID NO: 16798 - protein, 19 aa, Artificial Sequence
  Description of Artificial Sequence: Synthetic peptide
  XENP019602 vhCDR2
EIRLYSNNYATHYAESVKG

SEQ ID NO: 16799 - protein, 11 aa, Artificial Sequence
  Description of Artificial Sequence: Synthetic peptide
  XENP019602 vhCDR3
YYGNYGGYFDV

SEQ ID NO: 16800 - protein, 214 aa, Artificial Sequence
  Description of Artificial Sequence: Synthetic polypeptide
  XENP019602 1G6_H1.278_L1.193_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16801 - protein, 107 aa, Artificial Sequence; identical to SEQ ID NO: 10990
  Description of Artificial Sequence: Synthetic polypeptide
  VL of XENP019602

SEQ ID NO: 16802 - protein, 11 aa, Artificial Sequence
  Description of Artificial Sequence: Synthetic peptide
  XENP019602 vlCDR1
RASQSVGNDVA

SEQ ID NO: 16803 - protein, 7 aa, Artificial Sequence
  Description of Artificial Sequence: Synthetic peptide
  XENP019602 vlCDR2
YASHRYT

SEQ ID NO: 16804 - protein, 9 aa, Artificial Sequence
  Description of Artificial Sequence: Synthetic peptide
  XENP019602 vlCDR3
QQDFSSPRT

SEQ ID NO: 16805 - protein, 451 aa, Artificial Sequence; identical to SEQ ID NO: 16675
  Description of Artificial Sequence: Synthetic polypeptide
  XENP019603 1G6_H1.278_L1.194_IgG1_PVA_/S267K Heavy Chain

SEQ ID NO: 16806 - protein, 122 aa, Artificial Sequence; identical to SEQ ID NO: 10845
  Description of Artificial Sequence: Synthetic polypeptide
  VH of XENP019603

SEQ ID NO: 16807 - protein, 5 aa, Artificial Sequence
  Description of Artificial Sequence: Synthetic peptide
  XENP019603 vhCDR1
NYWMN

SEQ ID NO: 16808 - protein, 19 aa, Artificial Sequence
  Description of Artificial Sequence: Synthetic peptide
  XENP019603 vhCDR2
EIRLYSNNYATHYAESVKG

SEQ ID NO: 16809 - protein, 11 aa, Artificial Sequence
  Description of Artificial Sequence: Synthetic peptide
  XENP019603 vhCDR3
YYGNYGGYFDV

SEQ ID NO: 16810 - protein, 214 aa, Artificial Sequence
  Description of Artificial Sequence: Synthetic polypeptide
  XENP019603 1G6_H1.278_L1.194_IgG1_PVA_/S267K Light Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16811 - protein, 107 aa, Artificial Sequence; identical to SEQ ID NO: 10999
  Description of Artificial Sequence: Synthetic polypeptide
  VL of XENP019603

SEQ ID NO: 16812 - protein, 11 aa, Artificial Sequence
  Description of Artificial Sequence: Synthetic peptide
  XENP019603 vlCDR1
RASQSVGNDVA

SEQ ID NO: 16813 - protein, 7 aa, Artificial Sequence
  Description of Artificial Sequence: Synthetic peptide
  XENP019603 vlCDR2
YASHRYT

SEQ ID NO: 16814 - protein, 9 aa, Artificial Sequence
  Description of Artificial Sequence: Synthetic peptide
  XENP019603 vlCDR3
QQDFSSPRT

SEQ ID NO: 16815 - protein, 451 aa, Artificial Sequence; identical to SEQ ID NO: 16675
  Description of Artificial Sequence: Synthetic polypeptide
  XENP019604 1G6_H1.278_L1.195_IgG1_PVA_/S267K Heavy Chain

SEQ ID NO: 16816 - protein, 122 aa, Artificial Sequence; identical to SEQ ID NO: 10845
  Description of Artificial Sequence: Synthetic polypeptide
  VH of XENP019604

SEQ ID NO: 16817 - protein, 5 aa, Artificial Sequence
  Description of Artificial Sequence: Synthetic peptide
  XENP019604 vhCDR1
NYWMN

SEQ ID NO: 16818 - protein, 19 aa, Artificial Sequence
  Description of Artificial Sequence: Synthetic peptide
  XENP019604 vhCDR2
EIRLYSNNYATHYAESVKG

SEQ ID NO: 16819 - protein, 11 aa, Artificial Sequence
  Description of Artificial Sequence: Synthetic peptide
  XENP019604 vhCDR3
YYGNYGGYFDV

SEQ ID NO: 16820 - protein, 214 aa, Artificial Sequence
  Description of Artificial Sequence: Synthetic polypeptide
  XENP019604 1G6_H1.278_L1.195_IgG1_PVA_/S267K Light Chain
EIVLTQSPATLSVSPGERVTLTCRASQSVGNDVAWYQQKPGQAPRLLCNYASHRYTGVPDRFTCSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16821 - protein, 107 aa, Artificial Sequence; identical to SEQ ID NO: 11008
  Description of Artificial Sequence: Synthetic polypeptide
  VL of XENP019604

SEQ ID NO: 16822 - protein, 11 aa, Artificial Sequence
  Description of Artificial Sequence: Synthetic peptide
  XENP019604 vlCDR1
RASQSVGNDVA

SEQ ID NO: 16823 - protein, 7 aa, Artificial Sequence
  Description of Artificial Sequence: Synthetic peptide
  XENP019604 vlCDR2
YASHRYT

SEQ ID NO: 16824 - protein, 9 aa, Artificial Sequence
  Description of Artificial Sequence: Synthetic peptide
  XENP019604 vlCDR3
QQDFSSPRT

SEQ ID NO: 16825 - protein, 451 aa, Artificial Sequence; identical to SEQ ID NO: 16675
  Description of Artificial Sequence: Synthetic polypeptide
  XENP019605 1G6_H1.278_L1.196_IgG1_PVA_/S267K Heavy Chain

SEQ ID NO: 16826 - protein, 122 aa, Artificial Sequence; identical to SEQ ID NO: 10845
  Description of Artificial Sequence: Synthetic polypeptide
  VH of XENP019605

SEQ ID NO: 16827 - protein, 5 aa, Artificial Sequence
  Description of Artificial Sequence: Synthetic peptide
  XENP019605 vhCDR1
NYWMN

SEQ ID NO: 16828 - protein, 19 aa, Artificial Sequence
  Description of Artificial Sequence: Synthetic peptide
  XENP019605 vhCDR2
EIRLYSNNYATHYAESVKG

SEQ ID NO: 16829 - protein, 11 aa, Artificial Sequence
  Description of Artificial Sequence: Synthetic peptide
  XENP019605 vhCDR3
YYGNYGGYFDV

SEQ ID NO: 16830 - protein, 214 aa, Artificial Sequence
  Description of Artificial Sequence: Synthetic polypeptide
  XENP019605 1G6_H1.278_L1.196_IgG1_PVA_/S267K Light Chain
EIVLTQSPATLSASPGERVTLTCRASQSVGNDVAWYQQKPGQAPRLLCNYASHRYTGVPDRFTCSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16831 - protein, 107 aa, Artificial Sequence; identical to SEQ ID NO: 11017
  Description of Artificial Sequence: Synthetic polypeptide
  VL of XENP019605

SEQ ID NO: 16832 - protein, 11 aa, Artificial Sequence
  Description of Artificial Sequence: Synthetic peptide
  XENP019605 vlCDR1
RASQSVGNDVA

SEQ ID NO: 16833 - protein, 7 aa, Artificial Sequence
  Description of Artificial Sequence: Synthetic peptide
  XENP019605 vlCDR2
YASHRYT

SEQ ID NO: 16834 - protein, 9 aa, Artificial Sequence
  Description of Artificial Sequence: Synthetic peptide
  XENP019605 vlCDR3
QQDFSSPRT

SEQ ID NO: 16835 - protein, 451 aa, Artificial Sequence; identical to SEQ ID NO: 16675
  Description of Artificial Sequence: Synthetic polypeptide
  XENP019606 1G6_H1.278_L1.197_IgG1_PVA_/S267K Heavy Chain

SEQ ID NO: 16836 - protein, 122 aa, Artificial Sequence; identical to SEQ ID NO: 10845
  Description of Artificial Sequence: Synthetic polypeptide
  VH of XENP019606

SEQ ID NO: 16837 - protein, 5 aa, Artificial Sequence
  Description of Artificial Sequence: Synthetic peptide
  XENP019606 vhCDR1
NYWMN

SEQ ID NO: 16838 - protein, 19 aa, Artificial Sequence
  Description of Artificial Sequence: Synthetic peptide
  XENP019606 vhCDR2
EIRLYSNNYATHYAESVKG

SEQ ID NO: 16839 - protein, 11 aa, Artificial Sequence
  Description of Artificial Sequence: Synthetic peptide
  XENP019606 vhCDR3
YYGNYGGYFDV

SEQ ID NO: 16840 - protein, 214 aa, Artificial Sequence
  Description of Artificial Sequence: Synthetic polypeptide
  XENP019606 1G6_H1.278_L1.197_IgG1_PVA_/S267K Light Chain
EIVLTQSPATLSASPGERVTLTCRASQSVGNDVAWYQQKPGQAPRLLCNYASHRYTSVPDRFTCSGYGTEFTLTISSVQSEDFGVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16841 - protein, 107 aa, Artificial Sequence; identical to SEQ ID NO: 11026
  Description of Artificial Sequence: Synthetic polypeptide
  VL of XENP019606

SEQ ID NO: 16842 - protein, 11 aa, Artificial Sequence
  Description of Artificial Sequence: Synthetic peptide
  XENP019606 vlCDR1
RASQSVGNDVA

SEQ ID NO: 16843 - protein, 7 aa, Artificial Sequence
  Description of Artificial Sequence: Synthetic peptide
  XENP019606 vlCDR2
YASHRYT

SEQ ID NO: 16844 - protein, 9 aa, Artificial Sequence
  Description of Artificial Sequence: Synthetic peptide
  XENP019606 vlCDR3
QQDFSSPRT

SEQ ID NO: 16845 - protein, 451 aa, Artificial Sequence; identical to SEQ ID NO: 16675
  Description of Artificial Sequence: Synthetic polypeptide
  XENP019607 1G6_H1.278_L1.198_IgG1_PVA_/S267K Heavy Chain

SEQ ID NO: 16846 - protein, 122 aa, Artificial Sequence; identical to SEQ ID NO: 10845
  Description of Artificial Sequence: Synthetic polypeptide
  VH of XENP019607

SEQ ID NO: 16847 - protein, 5 aa, Artificial Sequence
  Description of Artificial Sequence: Synthetic peptide
  XENP019607 vhCDR1
NYWMN

SEQ ID NO: 16848 - protein, 19 aa, Artificial Sequence
  Description of Artificial Sequence: Synthetic peptide
  XENP019607 vhCDR2
EIRLYSNNYATHYAESVKG

SEQ ID NO: 16849 - protein, 11 aa, Artificial Sequence
  Description of Artificial Sequence: Synthetic peptide
  XENP019607 vhCDR3
YYGNYGGYFDV

SEQ ID NO: 16850 - protein, 214 aa, Artificial Sequence
  Description of Artificial Sequence: Synthetic polypeptide
  XENP019607 1G6_H1.278_L1.198_IgG1_PVA_/S267K Light Chain
EIVLTQSPSTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16851 - protein, 107 aa, Artificial Sequence; identical to SEQ ID NO: 11035
  Description of Artificial Sequence: Synthetic polypeptide
  VL of XENP019607

SEQ ID NO: 16852 - protein, 11 aa, Artificial Sequence
  Description of Artificial Sequence: Synthetic peptide
  XENP019607 vlCDR1
RASQSVGNDVA

SEQ ID NO: 16853 - protein, 7 aa, Artificial Sequence
  Description of Artificial Sequence: Synthetic peptide
  XENP019607 vlCDR2
YASHRYT

SEQ ID NO: 16854 - protein, 9 aa, Artificial Sequence
  Description of Artificial Sequence: Synthetic peptide
  XENP019607 vlCDR3
QQDFSSPRT

SEQ ID NO: 16855 - protein, 451 aa, Artificial Sequence; identical to SEQ ID NO: 16675
  Description of Artificial Sequence: Synthetic polypeptide
  XENP019608 1G6_H1.278_L1.199_IgG1_PVA_/S267K Heavy Chain

SEQ ID NO: 16856 - protein, 122 aa, Artificial Sequence; identical to SEQ ID NO: 10845
  Description of Artificial Sequence: Synthetic polypeptide
  VH of XENP019608

SEQ ID NO: 16857 - protein, 5 aa, Artificial Sequence
  Description of Artificial Sequence: Synthetic peptide
  XENP019608 vhCDR1
NYWMN

SEQ ID NO: 16858 - protein, 19 aa, Artificial Sequence
  Description of Artificial Sequence: Synthetic peptide
  XENP019608 vhCDR2
EIRLYSNNYATHYAESVKG

SEQ ID NO: 16859 - protein, 11 aa, Artificial Sequence
  Description of Artificial Sequence: Synthetic peptide
  XENP019608 vhCDR3
YYGNYGGYFDV

SEQ ID NO: 16860 - protein, 214 aa, Artificial Sequence
  Description of Artificial Sequence: Synthetic polypeptide
  XENP019608 1G6_H1.278_L1.199_IgG1_PVA_/S267K Light Chain
EIVLTQSPDTLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16861 - protein, 107 aa, Artificial Sequence; identical to SEQ ID NO: 11044
  Description of Artificial Sequence: Synthetic polypeptide
  VL of XENP019608

SEQ ID NO: 16862 - protein, 11 aa, Artificial Sequence
  Description of Artificial Sequence: Synthetic peptide
  XENP019608 vlCDR1
RASQSVGNDVA

SEQ ID NO: 16863 - protein, 7 aa, Artificial Sequence
  Description of Artificial Sequence: Synthetic peptide
  XENP019608 vlCDR2
YASHRYT

SEQ ID NO: 16864 - protein, 9 aa, Artificial Sequence
  Description of Artificial Sequence: Synthetic peptide
  XENP019608 vlCDR3
QQDFSSPRT

SEQ ID NO: 16865 - protein, 451 aa, Artificial Sequence; identical to SEQ ID NO: 16675
  Description of Artificial Sequence: Synthetic polypeptide
  XENP019609 1G6_H1.278_L1.200_IgG1_PVA_/S267K Heavy Chain

SEQ ID NO: 16866 - protein, 122 aa, Artificial Sequence; identical to SEQ ID NO: 10845
  Description of Artificial Sequence: Synthetic polypeptide
  VH of XENP019609

SEQ ID NO: 16867 - protein, 5 aa, Artificial Sequence
  Description of Artificial Sequence: Synthetic peptide
  XENP019609 vhCDR1
NYWMN

SEQ ID NO: 16868 - protein, 19 aa, Artificial Sequence
  Description of Artificial Sequence: Synthetic peptide
  XENP019609 vhCDR2
EIRLYSNNYATHYAESVKG

SEQ ID NO: 16869 - protein, 11 aa, Artificial Sequence
  Description of Artificial Sequence: Synthetic peptide
  XENP019609 vhCDR3
YYGNYGGYFDV

SEQ ID NO: 16870 - protein, 214 aa, Artificial Sequence
  Description of Artificial Sequence: Synthetic polypeptide
  XENP019609 1G6_H1.278_L1.200_IgG1_PVA_/S267K Light Chain
EIVLTQSPATLAVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16871 - protein, 107 aa, Artificial Sequence; identical to SEQ ID NO: 11053
  Description of Artificial Sequence: Synthetic polypeptide
  VL of XENP019609

SEQ ID NO: 16872 - protein, 11 aa, Artificial Sequence
  Description of Artificial Sequence: Synthetic peptide
  XENP019609 vlCDR1
RASQSVGNDVA

SEQ ID NO: 16873 - protein, 7 aa, Artificial Sequence
  Description of Artificial Sequence: Synthetic peptide
  XENP019609 vlCDR2
YASHRYT

SEQ ID NO: 16874 - protein, 9 aa, Artificial Sequence
  Description of Artificial Sequence: Synthetic peptide
  XENP019609 vlCDR3
QQDFSSPRT

SEQ ID NO: 16875 - protein, 451 aa, Artificial Sequence; identical to SEQ ID NO: 16675
  Description of Artificial Sequence: Synthetic polypeptide
  XENP019610 1G6_H1.278_L1.201_IgG1_PVA_/S267K Heavy Chain

SEQ ID NO: 16876 - protein, 122 aa, Artificial Sequence; identical to SEQ ID NO: 10845
  Description of Artificial Sequence: Synthetic polypeptide
  VH of XENP019610

SEQ ID NO: 16877 - protein, 5 aa, Artificial Sequence
  Description of Artificial Sequence: Synthetic peptide
  XENP019610 vhCDR1
NYWMN

SEQ ID NO: 16878 - protein, 19 aa, Artificial Sequence
  Description of Artificial Sequence: Synthetic peptide
  XENP019610 vhCDR2
EIRLYSNNYATHYAESVKG

SEQ ID NO: 16879 - protein, 11 aa, Artificial Sequence
  Description of Artificial Sequence: Synthetic peptide
  XENP019610 vhCDR3
YYGNYGGYFDV

SEQ ID NO: 16880 - protein, 214 aa, Artificial Sequence; identical to SEQ ID NO: 16790
  Description of Artificial Sequence: Synthetic polypeptide
  XENP019610 1G6_H1.278_L1.201_IgG1_PVA_/S267K Light Chain

SEQ ID NO: 16881 - protein, 107 aa, Artificial Sequence; identical to SEQ ID NO: 10981
  Description of Artificial Sequence: Synthetic polypeptide
  VL of XENP019610

SEQ ID NO: 16882 - protein, 11 aa, Artificial Sequence
  Description of Artificial Sequence: Synthetic peptide
  XENP019610 vlCDR1
RASQSVGNDVA

SEQ ID NO: 16883 - protein, 7 aa, Artificial Sequence
  Description of Artificial Sequence: Synthetic peptide
  XENP019610 vlCDR2
YASHRYT

SEQ ID NO: 16884 - protein, 9 aa, Artificial Sequence
  Description of Artificial Sequence: Synthetic peptide
  XENP019610 vlCDR3
QQDFSSPRT

SEQ ID NO: 16885 - protein, 451 aa, Artificial Sequence; identical to SEQ ID NO: 16675
  Description of Artificial Sequence: Synthetic polypeptide
  XENP019611 1G6_H1.278_L1.202_IgG1_PVA_/S267K Heavy Chain

SEQ ID NO: 16886 - protein, 122 aa, Artificial Sequence; identical to SEQ ID NO: 10845
  Description of Artificial Sequence: Synthetic polypeptide
  VH of XENP019611

SEQ ID NO: 16887 - protein, 5 aa, Artificial Sequence
  Description of Artificial Sequence: Synthetic peptide
  XENP019611 vhCDR1
NYWMN

SEQ ID NO: 16888 - protein, 19 aa, Artificial Sequence
  Description of Artificial Sequence: Synthetic peptide
  XENP019611 vhCDR2
EIRLYSNNYATHYAESVKG

SEQ ID NO: 16889 - protein, 11 aa, Artificial Sequence
  Description of Artificial Sequence: Synthetic peptide
  XENP019611 vhCDR3
YYGNYGGYFDV

SEQ ID NO: 16890 - protein, 214 aa, Artificial Sequence
  Description of Artificial Sequence: Synthetic polypeptide
  XENP019611 1G6_H1.278_L1.202_IgG1_PVA_/S267K Light Chain
EIVLTQSPATLSVSVGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16891 - protein, 107 aa, Artificial Sequence; identical to SEQ ID NO: 11071
  Description of Artificial Sequence: Synthetic polypeptide
  VL of XENP019611

SEQ ID NO: 16892 - protein, 11 aa, Artificial Sequence
  Description of Artificial Sequence: Synthetic peptide
  XENP019611 vlCDR1
RASQSVGNDVA

SEQ ID NO: 16893 - protein, 7 aa, Artificial Sequence
  Description of Artificial Sequence: Synthetic peptide
  XENP019611 vlCDR2
YASHRYT

SEQ ID NO: 16894 - protein, 9 aa, Artificial Sequence
  Description of Artificial Sequence: Synthetic peptide
  XENP019611 vlCDR3
QQDFSSPRT

SEQ ID NO: 16895 - protein, 451 aa, Artificial Sequence; identical to SEQ ID NO: 16675
  Description of Artificial Sequence: Synthetic polypeptide
  XENP019612 1G6_H1.278_L1.203_IgG1_PVA_/S267K Heavy Chain

SEQ ID NO: 16896 - protein, 122 aa, Artificial Sequence; identical to SEQ ID NO: 10845
  Description of Artificial Sequence: Synthetic polypeptide
  VH of XENP019612

SEQ ID NO: 16897 - protein, 5 aa, Artificial Sequence
  Description of Artificial Sequence: Synthetic peptide
  XENP019612 vhCDR1
NYWMN

SEQ ID NO: 16898 - protein, 19 aa, Artificial Sequence
  Description of Artificial Sequence: Synthetic peptide
  XENP019612 vhCDR2
EIRLYSNNYATHYAESVKG

SEQ ID NO: 16899 - protein, 11 aa, Artificial Sequence
  Description of Artificial Sequence: Synthetic peptide
  XENP019612 vhCDR3
YYGNYGGYFDV

SEQ ID NO: 16900 - protein, 214 aa, Artificial Sequence
  Description of Artificial Sequence: Synthetic polypeptide
  XENP019612 1G6_H1.278_L1.203_IgG1_PVA_/S267K Light Chain
EIVLTQSPATLSVSLGERVTLTCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16901 - protein, 107 aa, Artificial Sequence; identical to SEQ ID NO: 11080
  Description of Artificial Sequence: Synthetic polypeptide
  VL of XENP019612

SEQ ID NO: 16902 - protein, 11 aa, Artificial Sequence
  Description of Artificial Sequence: Synthetic peptide
  XENP019612 vlCDR1
RASQSVGNDVA

SEQ ID NO: 16903 - protein, 7 aa, Artificial Sequence
  Description of Artificial Sequence: Synthetic peptide
  XENP019612 vlCDR2
YASHRYT

SEQ ID NO: 16904 - protein, 9 aa, Artificial Sequence
  Description of Artificial Sequence: Synthetic peptide
  XENP019612 vlCDR3
QQDFSSPRT

SEQ ID NO: 16905 - protein, 451 aa, Artificial Sequence; identical to SEQ ID NO: 16675
  Description of Artificial Sequence: Synthetic polypeptide
  XENP019613 1G6_H1.278_L1.204_IgG1_PVA_/S267K Heavy Chain

SEQ ID NO: 16906 - protein, 122 aa, Artificial Sequence; identical to SEQ ID NO: 10845
  Description of Artificial Sequence: Synthetic polypeptide
  VH of XENP019613

SEQ ID NO: 16907 - protein, 5 aa, Artificial Sequence
  Description of Artificial Sequence: Synthetic peptide
  XENP019613 vhCDR1
NYWMN

SEQ ID NO: 16908 - protein, 19 aa, Artificial Sequence
  Description of Artificial Sequence: Synthetic peptide
  XENP019613 vhCDR2
EIRLYSNNYATHYAESVKG

SEQ ID NO: 16909 - protein, 11 aa, Artificial Sequence
  Description of Artificial Sequence: Synthetic peptide
  XENP019613 vhCDR3
YYGNYGGYFDV

SEQ ID NO: 16910 - protein, 214 aa, Artificial Sequence
  Description of Artificial Sequence: Synthetic polypeptide
  XENP019613 1G6_H1.278_L1.204_IgG1_PVA_/S267K Light Chain
EIVLTQSPATLSVSPGERVTLNCRASQSVGNDVAWYQQKPGQAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16911 - protein, 107 aa, Artificial Sequence; identical to SEQ ID NO: 11089
  Description of Artificial Sequence: Synthetic polypeptide
  VL of XENP019613

SEQ ID NO: 16912 - protein, 11 aa, Artificial Sequence
  Description of Artificial Sequence: Synthetic peptide
  XENP019613 vlCDR1
RASQSVGNDVA

SEQ ID NO: 16913 - protein, 7 aa, Artificial Sequence
  Description of Artificial Sequence: Synthetic peptide
  XENP019613 vlCDR2
YASHRYT

SEQ ID NO: 16914 - protein, 9 aa, Artificial Sequence
  Description of Artificial Sequence: Synthetic peptide
  XENP019613 vlCDR3
QQDFSSPRT

SEQ ID NO: 16915 - protein, 451 aa, Artificial Sequence; identical to SEQ ID NO: 16675
  Description of Artificial Sequence: Synthetic polypeptide
  XENP019614 1G6_H1.278_L1.205_IgG1_PVA_/S267K Heavy Chain

SEQ ID NO: 16916 - protein, 122 aa, Artificial Sequence; identical to SEQ ID NO: 10845
  Description of Artificial Sequence: Synthetic polypeptide
  VH of XENP019614

SEQ ID NO: 16917 - protein, 5 aa, Artificial Sequence
  Description of Artificial Sequence: Synthetic peptide
  XENP019614 vhCDR1
NYWMN

SEQ ID NO: 16918 - protein, 19 aa, Artificial Sequence
  Description of Artificial Sequence: Synthetic peptide
  XENP019614 vhCDR2
EIRLYSNNYATHYAESVKG

SEQ ID NO: 16919 - protein, 11 aa, Artificial Sequence
  Description of Artificial Sequence: Synthetic peptide
  XENP019614 vhCDR3
YYGNYGGYFDV

SEQ ID NO: 16920 - protein, 214 aa, Artificial Sequence
  Description of Artificial Sequence: Synthetic polypeptide
  XENP019614 1G6_H1.278_L1.205_IgG1_PVA_/S267K Light Chain
EIVLTQSPATLSVSPGERVTLTCRASQSVGNDVAWYQQKPGKAPRLLINYASHRYTGVPDRFTGSGYGTEFTLTISSVQSEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16921 - protein, 107 aa, Artificial Sequence; identical to SEQ ID NO: 11098
  Description of Artificial Sequence: Synthetic polypeptide
  VL of XENP019614

SEQ ID NO: 16922 - protein, 11 aa, Artificial Sequence
  Description of Artificial Sequence: Synthetic peptide
  XENP019614 vlCDR1
RASQSVGNDVA

SEQ ID NO: 16923 - protein, 7 aa, Artificial Sequence
  Description of Artificial Sequence: Synthetic peptide
  XENP019614 vlCDR2
YASHRYT

SEQ ID NO: 16924 - protein, 9 aa, Artificial Sequence
  Description of Artificial Sequence: Synthetic peptide
  XENP019614 vlCDR3
QQDFSSPRT

SEQ ID NO: 16925 - protein, 451 aa, Artificial Sequence; identical to SEQ ID NO: 16675
  Description of Artificial Sequence: Synthetic polypeptide
  XENP019615 1G6_H1.278_L1.206_IgG1_PVA_/S267K Heavy Chain

SEQ ID NO: 16926 - protein, 122 aa, Artificial Sequence; identical to SEQ ID NO: 10845
  Description of Artificial Sequence: Synthetic polypeptide
  VH of XENP019615

SEQ ID NO: 16927 - protein, 5 aa, Artificial Sequence
  Description of Artificial Sequence: Synthetic peptide
  XENP019615 vhCDR1
NYWMN

SEQ ID NO: 16928 - protein, 19 aa, Artificial Sequence
  Description of Artificial Sequence: Synthetic peptide
  XENP019615 vhCDR2
EIRLYSNNYATHYAESVKG

SEQ ID NO: 16929 - protein, 11 aa, Artificial Sequence
  Description of Artificial Sequence: Synthetic peptide
  XENP019615 vhCDR3
YYGNYGGYFDV

SEQ ID NO: 16930 - protein, 214 aa, Artificial Sequence
  Description of Artificial Sequence: Synthetic polypeptide
  XENP019615 1G6_H1.278_L1.206_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQPEDFAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16931 - protein, 107 aa, Artificial Sequence; identical to SEQ ID NO: 11107
  Description of Artificial Sequence: Synthetic polypeptide
  VL of XENP019615

SEQ ID NO: 16932 - protein, 11 aa, Artificial Sequence
  Description of Artificial Sequence: Synthetic peptide
  XENP019615 vlCDR1
RASQSVGNDVA

SEQ ID NO: 16933 - protein, 7 aa, Artificial Sequence
  Description of Artificial Sequence: Synthetic peptide
  XENP019615 vlCDR2
YASHRYT

SEQ ID NO: 16934 - protein, 9 aa, Artificial Sequence
  Description of Artificial Sequence: Synthetic peptide
  XENP019615 vlCDR3
QQDFSSPRT

SEQ ID NO: 16935 - protein, 451 aa, Artificial Sequence; identical to SEQ ID NO: 16675
  Description of Artificial Sequence: Synthetic polypeptide
  XENP019616 1G6_H1.278_L1.207_IgG1_PVA_/S267K Heavy Chain

SEQ ID NO: 16936 - protein, 122 aa, Artificial Sequence; identical to SEQ ID NO: 10845
  Description of Artificial Sequence: Synthetic polypeptide
  VH of XENP019616

SEQ ID NO: 16937 - protein, 5 aa, Artificial Sequence
  Description of Artificial Sequence: Synthetic peptide
  XENP019616 vhCDR1
NYWMN

SEQ ID NO: 16938 - protein, 19 aa, Artificial Sequence
  Description of Artificial Sequence: Synthetic peptide
  XENP019616 vhCDR2
EIRLYSNNYATHYAESVKG

SEQ ID NO: 16939 - protein, 11 aa, Artificial Sequence
  Description of Artificial Sequence: Synthetic peptide
  XENP019616 vhCDR3
YYGNYGGYFDV

SEQ ID NO: 16940 - protein, 214 aa, Artificial Sequence
  Description of Artificial Sequence: Synthetic polypeptide
  XENP019616 1G6_H1.278_L1.207_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDVAVYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16941 - protein, 107 aa, Artificial Sequence; identical to SEQ ID NO: 11116
  Description of Artificial Sequence: Synthetic polypeptide
  VL of XENP019616

SEQ ID NO: 16942 - protein, 11 aa, Artificial Sequence
  Description of Artificial Sequence: Synthetic peptide
  XENP019616 vlCDR1
RASQSVGNDVA

SEQ ID NO: 16943 - protein, 7 aa, Artificial Sequence
  Description of Artificial Sequence: Synthetic peptide
  XENP019616 vlCDR2
YASHRYT

SEQ ID NO: 16944 - protein, 9 aa, Artificial Sequence
  Description of Artificial Sequence: Synthetic peptide
  XENP019616 vlCDR3
QQDFSSPRT

SEQ ID NO: 16945 - protein, 451 aa, Artificial Sequence; identical to SEQ ID NO: 16675
  Description of Artificial Sequence: Synthetic polypeptide
  XENP019617 1G6_H1.278_L1.208_IgG1_PVA_/S267K Heavy Chain

SEQ ID NO: 16946 - protein, 122 aa, Artificial Sequence; identical to SEQ ID NO: 10845
  Description of Artificial Sequence: Synthetic polypeptide
  VH of XENP019617

SEQ ID NO: 16947 - protein, 5 aa, Artificial Sequence
  Description of Artificial Sequence: Synthetic peptide
  XENP019617 vhCDR1
NYWMN

SEQ ID NO: 16948 - protein, 19 aa, Artificial Sequence
  Description of Artificial Sequence: Synthetic peptide
  XENP019617 vhCDR2
EIRLYSNNYATHYAESVKG

SEQ ID NO: 16949 - protein, 11 aa, Artificial Sequence
  Description of Artificial Sequence: Synthetic peptide
  XENP019617 vhCDR3
YYGNYGGYFDV

SEQ ID NO: 16950 - protein, 214 aa, Artificial Sequence
  Description of Artificial Sequence: Synthetic polypeptide
  XENP019617 1G6_H1.278_L1.208_IgG1_PVA_/S267K Light Chain
EIVLTQSPATLSVSPGERVTLTCRASQSVGNDVAWYQQKPGQAPRLLINYASHRYTGVPDRFTGSGYGTEFTLTISSVQSEDFATYYCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16951 - protein, 107 aa, Artificial Sequence; identical to SEQ ID NO: 11125
  Description of Artificial Sequence: Synthetic polypeptide
  VL of XENP019617

SEQ ID NO: 16952 - protein, 11 aa, Artificial Sequence
  Description of Artificial Sequence: Synthetic peptide
  XENP019617 vlCDR1
RASQSVGNDVA

SEQ ID NO: 16953 - protein, 7 aa, Artificial Sequence
  Description of Artificial Sequence: Synthetic peptide
  XENP019617 vlCDR2
YASHRYT

SEQ ID NO: 16954 - protein, 9 aa, Artificial Sequence
  Description of Artificial Sequence: Synthetic peptide
  XENP019617 vlCDR3
QQDFSSPRT

SEQ ID NO: 16955 - protein, 451 aa, Artificial Sequence; identical to SEQ ID NO: 16705
  Description of Artificial Sequence: Synthetic polypeptide
  XENP019678 1G6_H1.279_L1.192_IgG1_PVA_/S267K Heavy Chain

SEQ ID NO: 16956 - protein, 122 aa, Artificial Sequence; identical to SEQ ID NO: 10908
  Description of Artificial Sequence: Synthetic polypeptide
  VH of XENP019678

SEQ ID NO: 16957 - protein, 5 aa, Artificial Sequence
  Description of Artificial Sequence: Synthetic peptide
  XENP019678 vhCDR1
NYWMN

SEQ ID NO: 16958 - protein, 19 aa, Artificial Sequence
  Description of Artificial Sequence: Synthetic peptide
  XENP019678 vhCDR2
EIRLYSNNYATHYAESVKG

SEQ ID NO: 16959 - protein, 11 aa, Artificial Sequence
  Description of Artificial Sequence: Synthetic peptide
  XENP019678 vhCDR3
YYGNYGGYFDV

SEQ ID NO: 16960 - protein, 214 aa, Artificial Sequence; identical to SEQ ID NO: 16790
  Description of Artificial Sequence: Synthetic polypeptide
  XENP019678 1G6_H1.279_L1.192_IgG1_PVA_/S267K Light Chain

SEQ ID NO: 16961 - protein, 107 aa, Artificial Sequence; identical to SEQ ID NO: 10981
  Description of Artificial Sequence: Synthetic polypeptide
  VL of XENP019678

SEQ ID NO: 16962 - protein, 11 aa, Artificial Sequence
  Description of Artificial Sequence: Synthetic peptide
  XENP019678 vlCDR1
RASQSVGNDVA

SEQ ID NO: 16963 - protein, 7 aa, Artificial Sequence
  Description of Artificial Sequence: Synthetic peptide
  XENP019678 vlCDR2
YASHRYT

SEQ ID NO: 16964 - protein, 9 aa, Artificial Sequence
  Description of Artificial Sequence: Synthetic peptide
  XENP019678 vlCDR3
QQDFSSPRT

SEQ ID NO: 16965 - protein, 451 aa, Artificial Sequence; identical to SEQ ID NO: 16715
  Description of Artificial Sequence: Synthetic polypeptide
  XENP019679 1G6_H1.280_L1.192_IgG1_PVA_/S267K Heavy Chain

SEQ ID NO: 16966 - protein, 122 aa, Artificial Sequence; identical to SEQ ID NO: 10917
  Description of Artificial Sequence: Synthetic polypeptide
  VH of XENP019679

SEQ ID NO: 16967 - protein, 5 aa, Artificial Sequence
  Description of Artificial Sequence: Synthetic peptide
  XENP019679 vhCDR1
NYWMN

SEQ ID NO: 16968 - protein, 19 aa, Artificial Sequence
  Description of Artificial Sequence: Synthetic peptide
  XENP019679 vhCDR2
EIRLYSNNYATHYAESVKG

SEQ ID NO: 16969 - protein, 11 aa, Artificial Sequence
  Description of Artificial Sequence: Synthetic peptide
  XENP019679 vhCDR3
YYGNYGGYFDV

SEQ ID NO: 16970 - protein, 214 aa, Artificial Sequence; identical to SEQ ID NO: 16790
  Description of Artificial Sequence: Synthetic polypeptide
  XENP019679 1G6_H1.280_L1.192_IgG1_PVA_/S267K Light Chain

SEQ ID NO: 16971 - protein, 107 aa, Artificial Sequence; identical to SEQ ID NO: 10981
  Description of Artificial Sequence: Synthetic polypeptide
  VL of XENP019679

SEQ ID NO: 16972 - protein, 11 aa, Artificial Sequence
  Description of Artificial Sequence: Synthetic peptide
  XENP019679 vlCDR1
RASQSVGNDVA

SEQ ID NO: 16973 - protein, 7 aa, Artificial Sequence
  Description of Artificial Sequence: Synthetic peptide
  XENP019679 vlCDR2
YASHRYT

SEQ ID NO: 16974 - protein, 9 aa, Artificial Sequence
  Description of Artificial Sequence: Synthetic peptide
  XENP019679 vlCDR3
QQDFSSPRT

SEQ ID NO: 16975 - protein, 451 aa, Artificial Sequence; identical to SEQ ID NO: 16725
  Description of Artificial Sequence: Synthetic polypeptide
  XENP019680 1G6_H1.281_L1.192_IgG1_PVA_/S267K Heavy Chain

SEQ ID NO: 16976 - protein, 122 aa, Artificial Sequence; identical to SEQ ID NO: 10926
  Description of Artificial Sequence: Synthetic polypeptide
  VH of XENP019680

SEQ ID NO: 16977 - protein, 5 aa, Artificial Sequence
  Description of Artificial Sequence: Synthetic peptide
  XENP019680 vhCDR1
NYWMN

SEQ ID NO: 16978 - protein, 19 aa, Artificial Sequence
  Description of Artificial Sequence: Synthetic peptide
  XENP019680 vhCDR2
EIRLYSNNYATHYAESVKG

SEQ ID NO: 16979 - protein, 11 aa, Artificial Sequence
  Description of Artificial Sequence: Synthetic peptide
  XENP019680 vhCDR3
YYGNYGGYFDV

SEQ ID NO: 16980 - protein, 214 aa, Artificial Sequence; identical to SEQ ID NO: 16790
  Description of Artificial Sequence: Synthetic polypeptide
  XENP019680 1G6_H1.281_L1.192_IgG1_PVA_/S267K Light Chain

SEQ ID NO: 16981 - protein, 107 aa, Artificial Sequence; identical to SEQ ID NO: 10981
  Description of Artificial Sequence: Synthetic polypeptide
  VL of XENP019680

SEQ ID NO: 16982 - protein, 11 aa, Artificial Sequence
  Description of Artificial Sequence: Synthetic peptide
  XENP019680 vlCDR1
RASQSVGNDVA

SEQ ID NO: 16983 - protein, 7 aa, Artificial Sequence
  Description of Artificial Sequence: Synthetic peptide
  XENP019680 vlCDR2
YASHRYT

SEQ ID NO: 16984 - protein, 9 aa, Artificial Sequence
  Description of Artificial Sequence: Synthetic peptide
  XENP019680 vlCDR3
QQDFSSPRT

SEQ ID NO: 16985 - protein, 451 aa, Artificial Sequence; identical to SEQ ID NO: 16735
  Description of Artificial Sequence: Synthetic polypeptide
  XENP019681 1G6_H1.282_L1.192_IgG1_PVA_/S267K Heavy Chain

SEQ ID NO: 16986 - protein, 122 aa, Artificial Sequence; identical to SEQ ID NO: 10935
  Description of Artificial Sequence: Synthetic polypeptide
  VH of XENP019681

SEQ ID NO: 16987 - protein, 5 aa, Artificial Sequence
  Description of Artificial Sequence: Synthetic peptide
  XENP019681 vhCDR1
NYWMN

SEQ ID NO: 16988 - protein, 19 aa, Artificial Sequence
  Description of Artificial Sequence: Synthetic peptide
  XENP019681 vhCDR2
EIRLYSNNYATHYAESVKG

SEQ ID NO: 16989 - protein, 11 aa, Artificial Sequence
  Description of Artificial Sequence: Synthetic peptide
  XENP019681 vhCDR3
YYGNYGGYFDV

SEQ ID NO: 16990 - protein, 214 aa, Artificial Sequence; identical to SEQ ID NO: 16790
  Description of Artificial Sequence: Synthetic polypeptide
  XENP019681 1G6_H1.282_L1.192_IgG1_PVA_/S267K Light Chain

SEQ ID NO: 16991 - protein, 107 aa, Artificial Sequence; identical to SEQ ID NO: 10981
  Description of Artificial Sequence: Synthetic polypeptide
  VL of XENP019681

SEQ ID NO: 16992 - protein, 11 aa, Artificial Sequence
  Description of Artificial Sequence: Synthetic peptide
  XENP019681 vlCDR1
RASQSVGNDVA

SEQ ID NO: 16993 - protein, 7 aa, Artificial Sequence
  Description of Artificial Sequence: Synthetic peptide
  XENP019681 vlCDR2
YASHRYT

SEQ ID NO: 16994 - protein, 9 aa, Artificial Sequence
  Description of Artificial Sequence: Synthetic peptide
  XENP019681 vlCDR3
QQDFSSPRT

SEQ ID NO: 16995 - protein, 451 aa, Artificial Sequence; identical to SEQ ID NO: 16705
  Description of Artificial Sequence: Synthetic polypeptide
  XENP019682 1G6_H1.279_L1.193_IgG1_PVA_/S267K Heavy Chain

SEQ ID NO: 16996 - protein, 122 aa, Artificial Sequence; identical to SEQ ID NO: 10908
  Description of Artificial Sequence: Synthetic polypeptide
  VH of XENP019682

SEQ ID NO: 16997 - protein, 5 aa, Artificial Sequence
  Description of Artificial Sequence: Synthetic peptide
  XENP019682 vhCDR1
NYWMN

SEQ ID NO: 16998 - protein, 19 aa, Artificial Sequence
  Description of Artificial Sequence: Synthetic peptide
  XENP019682 vhCDR2
EIRLYSNNYATHYAESVKG

SEQ ID NO: 16999 - protein, 11 aa, Artificial Sequence
  Description of Artificial Sequence: Synthetic peptide
  XENP019682 vhCDR3
YYGNYGGYFDV

SEQ ID NO: 17000 - protein, 214 aa, Artificial Sequence; identical to SEQ ID NO: 16800
  Description of Artificial Sequence: Synthetic polypeptide
  XENP019682 1G6_H1.279_L1.193_IgG1_PVA_/S267K Light Chain

SEQ ID NO: 17001 - protein, 107 aa, Artificial Sequence; identical to SEQ ID NO: 10990
  Description of Artificial Sequence: Synthetic polypeptide
  VL of XENP019682

SEQ ID NO: 17002 - protein, 11 aa, Artificial Sequence
  Description of Artificial Sequence: Synthetic peptide
  XENP019682 vlCDR1
RASQSVGNDVA

SEQ ID NO: 17003 - protein, 7 aa, Artificial Sequence
  Description of Artificial Sequence: Synthetic peptide
  XENP019682 vlCDR2
YASHRYT

SEQ ID NO: 17004 - protein, 9 aa, Artificial Sequence
  Description of Artificial Sequence: Synthetic peptide
  XENP019682 vlCDR3
QQDFSSPRT

SEQ ID NO: 17005 - protein, 451 aa, Artificial Sequence; identical to SEQ ID NO: 16715
  Description of Artificial Sequence: Synthetic polypeptide
  XENP019683 1G6_H1.280_L1.193_IgG1_PVA_/S267K Heavy Chain

SEQ ID NO: 17006 - protein, 122 aa, Artificial Sequence; identical to SEQ ID NO: 10917
  Description of Artificial Sequence: Synthetic polypeptide
  VH of XENP019683

SEQ ID NO: 17007 - protein, 5 aa, Artificial Sequence
  Description of Artificial Sequence: Synthetic peptide
  XENP019683 vhCDR1
NYWMN

SEQ ID NO: 17008 - protein, 19 aa, Artificial Sequence
  Description of Artificial Sequence: Synthetic peptide
  XENP019683 vhCDR2
EIRLYSNNYATHYAESVKG

SEQ ID NO: 17009 - protein, 11 aa, Artificial Sequence
  Description of Artificial Sequence: Synthetic peptide
  XENP019683 vhCDR3
YYGNYGGYFDV

SEQ ID NO: 17010 - protein, 214 aa, Artificial Sequence; identical to SEQ ID NO: 16800
  Description of Artificial Sequence: Synthetic polypeptide
  XENP019683 1G6_H1.280_L1.193_IgG1_PVA_/S267K Light Chain

SEQ ID NO: 17011 - protein, 107 aa, Artificial Sequence; identical to SEQ ID NO: 10990
  Description of Artificial Sequence: Synthetic polypeptide
  VL of XENP019683

SEQ ID NO: 17012 - protein, 11 aa, Artificial Sequence
  Description of Artificial Sequence: Synthetic peptide
  XENP019683 vlCDR1
RASQSVGNDVA

SEQ ID NO: 17013 - protein, 7 aa, Artificial Sequence
  Description of Artificial Sequence: Synthetic peptide
  XENP019683 vlCDR2
YASHRYT

SEQ ID NO: 17014 - protein, 9 aa, Artificial Sequence
  Description of Artificial Sequence: Synthetic peptide
  XENP019683 vlCDR3
QQDFSSPRT

SEQ ID NO: 17015 - protein, 451 aa, Artificial Sequence; identical to SEQ ID NO: 16725
  Description of Artificial Sequence: Synthetic polypeptide
  XENP019684 1G6_H1.281_L1.193_IgG1_PVA_/S267K Heavy Chain

SEQ ID NO: 17016 - protein, 122 aa, Artificial Sequence; identical to SEQ ID NO: 10926
  Description of Artificial Sequence: Synthetic polypeptide
  VH of XENP019684

SEQ ID NO: 17017 - protein, 5 aa, Artificial Sequence
  Description of Artificial Sequence: Synthetic peptide
  XENP019684 vhCDR1
NYWMN

SEQ ID NO: 17018 - protein, 19 aa, Artificial Sequence
  Description of Artificial Sequence: Synthetic peptide
  XENP019684 vhCDR2
EIRLYSNNYATHYAESVKG

SEQ ID NO: 17019 - protein, 11 aa, Artificial Sequence
  Description of Artificial Sequence: Synthetic peptide
  XENP019684 vhCDR3
YYGNYGGYFDV

SEQ ID NO: 17020 - protein, 214 aa, Artificial Sequence; identical to SEQ ID NO: 16800
  Description of Artificial Sequence: Synthetic polypeptide
  XENP019684 1G6_H1.281_L1.193_IgG1_PVA_/S267K Light Chain

SEQ ID NO: 17021 - protein, 107 aa, Artificial Sequence; identical to SEQ ID NO: 10990
  Description of Artificial Sequence: Synthetic polypeptide
  VL of XENP019684

SEQ ID NO: 17022 - protein, 11 aa, Artificial Sequence
  Description of Artificial Sequence: Synthetic peptide
  XENP019684 vlCDR1
RASQSVGNDVA

SEQ ID NO: 17023 - protein, 7 aa, Artificial Sequence
  Description of Artificial Sequence: Synthetic peptide
  XENP019684 vlCDR2
YASHRYT

SEQ ID NO: 17024 - protein, 9 aa, Artificial Sequence
  Description of Artificial Sequence: Synthetic peptide
  XENP019684 vlCDR3
QQDFSSPRT

SEQ ID NO: 17025 - protein, 451 aa, Artificial Sequence; identical to SEQ ID NO: 16735
  Description of Artificial Sequence: Synthetic polypeptide
  XENP019685 1G6_H1.282_L1.193_IgG1_PVA_/S267K Heavy Chain

SEQ ID NO: 17026 - protein, 122 aa, Artificial Sequence; identical to SEQ ID NO: 10935
  Description of Artificial Sequence: Synthetic polypeptide
  VH of XENP019685

SEQ ID NO: 17027 - protein, 5 aa, Artificial Sequence
  Description of Artificial Sequence: Synthetic peptide
  XENP019685 vhCDR1
NYWMN

SEQ ID NO: 17028 - protein, 19 aa, Artificial Sequence
  Description of Artificial Sequence: Synthetic peptide
  XENP019685 vhCDR2
EIRLYSNNYATHYAESVKG

SEQ ID NO: 17029 - protein, 11 aa, Artificial Sequence
  Description of Artificial Sequence: Synthetic peptide
  XENP019685 vhCDR3
YYGNYGGYFDV

SEQ ID NO: 17030 - protein, 214 aa, Artificial Sequence; identical to SEQ ID NO: 16800
  Description of Artificial Sequence: Synthetic polypeptide
  XENP019685 1G6_H1.282_L1.193_IgG1_PVA_/S267K Light Chain

SEQ ID NO: 17031 - protein, 107 aa, Artificial Sequence; identical to SEQ ID NO: 10990
  Description of Artificial Sequence: Synthetic polypeptide
  VL of XENP019685

SEQ ID NO: 17032 - protein, 11 aa, Artificial Sequence
  Description of Artificial Sequence: Synthetic peptide
  XENP019685 vlCDR1
RASQSVGNDVA

SEQ ID NO: 17033 - protein, 7 aa, Artificial Sequence
  Description of Artificial Sequence: Synthetic peptide
  XENP019685 vlCDR2
YASHRYT

SEQ ID NO: 17034 - protein, 9 aa, Artificial Sequence
  Description of Artificial Sequence: Synthetic peptide
  XENP019685 vlCDR3
QQDFSSPRT

SEQ ID NO: 17035 - protein, 451 aa, Artificial Sequence; identical to SEQ ID NO: 16705
  Description of Artificial Sequence: Synthetic polypeptide
  XENP019686 1G6_H1.279_L1.194_IgG1_PVA_/S267K Heavy Chain

SEQ ID NO: 17036 - protein, 122 aa, Artificial Sequence; identical to SEQ ID NO: 10908
  Description of Artificial Sequence: Synthetic polypeptide
  VH of XENP019686

SEQ ID NO: 17037 - protein, 5 aa, Artificial Sequence
  Description of Artificial Sequence: Synthetic peptide
  XENP019686 vhCDR1
NYWMN

SEQ ID NO: 17038 - protein, 19 aa, Artificial Sequence
  Description of Artificial Sequence: Synthetic peptide
  XENP019686 vhCDR2
EIRLYSNNYATHYAESVKG

SEQ ID NO: 17039 - protein, 11 aa, Artificial Sequence
  Description of Artificial Sequence: Synthetic peptide
  XENP019686 vhCDR3
YYGNYGGYFDV

SEQ ID NO: 17040 - protein, 214 aa, Artificial Sequence; identical to SEQ ID NO: 16810
  Description of Artificial Sequence: Synthetic polypeptide
  XENP019686 1G6_H1.279_L1.194_IgG1_PVA_/S267K Light Chain

SEQ ID NO: 17041 - protein, 107 aa, Artificial Sequence; identical to SEQ ID NO: 10999
  Description of Artificial Sequence: Synthetic polypeptide
  VL of XENP019686

SEQ ID NO: 17042 - protein, 11 aa, Artificial Sequence
  Description of Artificial Sequence: Synthetic peptide
  XENP019686 vlCDR1
RASQSVGNDVA

SEQ ID NO: 17043 - protein, 7 aa, Artificial Sequence
  Description of Artificial Sequence: Synthetic peptide
  XENP019686 vlCDR2
YASHRYT

SEQ ID NO: 17044 - protein, 9 aa, Artificial Sequence
  Description of Artificial Sequence: Synthetic peptide
  XENP019686 vlCDR3
QQDFSSPRT

SEQ ID NO: 17045 - protein, 451 aa, Artificial Sequence; identical to SEQ ID NO: 16715
  Description of Artificial Sequence: Synthetic polypeptide
  XENP019687 1G6_H1.280_L1.194_IgG1_PVA_/S267K Heavy Chain

SEQ ID NO: 17046 - protein, 122 aa, Artificial Sequence; identical to SEQ ID NO: 10917
  Description of Artificial Sequence: Synthetic polypeptide
  VH of XENP019687

SEQ ID NO: 17047 - protein, 5 aa, Artificial Sequence
  Description of Artificial Sequence: Synthetic peptide
  XENP019687 vhCDR1
NYWMN

SEQ ID NO: 17048 - protein, 19 aa, Artificial Sequence
  Description of Artificial Sequence: Synthetic peptide
  XENP019687 vhCDR2
EIRLYSNNYATHYAESVKG

SEQ ID NO: 17049 - protein, 11 aa, Artificial Sequence
  Description of Artificial Sequence: Synthetic peptide
  XENP019687 vhCDR3
YYGNYGGYFDV

SEQ ID NO: 17050 - protein, 214 aa, Artificial Sequence; identical to SEQ ID NO: 16810
  Description of Artificial Sequence: Synthetic polypeptide
  XENP019687 1G6_H1.280_L1.194_IgG1_PVA_/S267K Light Chain

SEQ ID NO: 17051 - protein, 107 aa, Artificial Sequence; identical to SEQ ID NO: 10999
  Description of Artificial Sequence: Synthetic polypeptide
  VL of XENP019687

SEQ ID NO: 17052 - protein, 11 aa, Artificial Sequence
  Description of Artificial Sequence: Synthetic peptide
  XENP019687 vlCDR1
RASQSVGNDVA

SEQ ID NO: 17053 - protein, 7 aa, Artificial Sequence
  Description of Artificial Sequence: Synthetic peptide
  XENP019687 vlCDR2
YASHRYT

SEQ ID NO: 17054 - protein, 9 aa, Artificial Sequence
  Description of Artificial Sequence: Synthetic peptide
  XENP019687 vlCDR3
QQDFSSPRT

SEQ ID NO: 17055 - protein, 451 aa, Artificial Sequence; identical to SEQ ID NO: 16725
  Description of Artificial Sequence: Synthetic polypeptide
  XENP019688 1G6_H1.281_L1.194_IgG1_PVA_/S267K Heavy Chain

SEQ ID NO: 17056 - protein, 122 aa, Artificial Sequence; identical to SEQ ID NO: 10926
  Description of Artificial Sequence: Synthetic polypeptide
  VH of XENP019688

SEQ ID NO: 17057 - protein, 5 aa, Artificial Sequence
  Description of Artificial Sequence: Synthetic peptide
  XENP019688 vhCDR1
NYWMN

SEQ ID NO: 17058 - protein, 19 aa, Artificial Sequence
  Description of Artificial Sequence: Synthetic peptide
  XENP019688 vhCDR2
EIRLYSNNYATHYAESVKG

SEQ ID NO: 17059 - protein, 11 aa, Artificial Sequence
  Description of Artificial Sequence: Synthetic peptide
  XENP019688 vhCDR3
YYGNYGGYFDV

SEQ ID NO: 17060 - protein, 214 aa, Artificial Sequence; identical to SEQ ID NO: 16810
  Description of Artificial Sequence: Synthetic polypeptide
  XENP019688 1G6_H1.281_L1.194_IgG1_PVA_/S267K Light Chain

SEQ ID NO: 17061 - protein, 107 aa, Artificial Sequence; identical to SEQ ID NO: 10999
  Description of Artificial Sequence: Synthetic polypeptide
  VL of XENP019688

SEQ ID NO: 17062 - protein, 11 aa, Artificial Sequence
  Description of Artificial Sequence: Synthetic peptide
  XENP019688 vlCDR1
RASQSVGNDVA

SEQ ID NO: 17063 - protein, 7 aa, Artificial Sequence
  Description of Artificial Sequence: Synthetic peptide
  XENP019688 vlCDR2
YASHRYT

SEQ ID NO: 17064 - protein, 9 aa, Artificial Sequence
  Description of Artificial Sequence: Synthetic peptide
  XENP019688 vlCDR3
QQDFSSPRT

SEQ ID NO: 17065 - protein, 451 aa, Artificial Sequence; identical to SEQ ID NO: 16735
  Description of Artificial Sequence: Synthetic polypeptide
  XENP019689 1G6_H1.282_L1.194_IgG1_PVA_/S267K Heavy Chain

SEQ ID NO: 17066 - protein, 122 aa, Artificial Sequence; identical to SEQ ID NO: 10935
  Description of Artificial Sequence: Synthetic polypeptide
  VH of XENP019689

SEQ ID NO: 17067 - protein, 5 aa, Artificial Sequence
  Description of Artificial Sequence: Synthetic peptide
  XENP019689 vhCDR1
NYWMN

SEQ ID NO: 17068 - protein, 19 aa, Artificial Sequence
  Description of Artificial Sequence: Synthetic peptide
  XENP019689 vhCDR2
EIRLYSNNYATHYAESVKG

SEQ ID NO: 17069 - protein, 11 aa, Artificial Sequence
  Description of Artificial Sequence: Synthetic peptide
  XENP019689 vhCDR3
YYGNYGGYFDV

SEQ ID NO: 17070 - protein, 214 aa, Artificial Sequence; identical to SEQ ID NO: 16810
  Description of Artificial Sequence: Synthetic polypeptide
  XENP019689 1G6_H1.282_L1.194_IgG1_PVA_/S267K Light Chain

SEQ ID NO: 17071 - protein, 107 aa, Artificial Sequence; identical to SEQ ID NO: 10999
  Description of Artificial Sequence: Synthetic polypeptide
  VL of XENP019689

SEQ ID NO: 17072 - protein, 11 aa, Artificial Sequence
  Description of Artificial Sequence: Synthetic peptide
  XENP019689 vlCDR1
RASQSVGNDVA

SEQ ID NO: 17073 - protein, 7 aa, Artificial Sequence
  Description of Artificial Sequence: Synthetic peptide
  XENP019689 vlCDR2
YASHRYT

SEQ ID NO: 17074 - protein, 9 aa, Artificial Sequence
  Description of Artificial Sequence: Synthetic peptide
  XENP019689 vlCDR3
QQDFSSPRT

SEQ ID NO: 17075 - protein, 449 aa, Artificial Sequence
  Description of Artificial Sequence: Synthetic polypeptide
  XENP020156 2E9_H1L1_IgG1_PVA_/S267K Heavy Chain
QVQLVQSGAEVKKPGASVKVSCKASGYAFTNYWLGWVRQAPGQGLEWMGNFYPGSSNTYYNEKFQGRVTMTADKSISTAYMELSRLRSDDTAVYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17076 - protein, 120 aa, Artificial Sequence; identical to SEQ ID NO: 11412
  Description of Artificial Sequence: Synthetic polypeptide
  VH of XENP020156

SEQ ID NO: 17077 - protein, 5 aa, Artificial Sequence
  Description of Artificial Sequence: Synthetic peptide
  XENP020156 vhCDR1
NYWLG

SEQ ID NO: 17078 - protein, 17 aa, Artificial Sequence
  Description of Artificial Sequence: Synthetic peptide
  XENP020156 vhCDR2
NFYPGSSNTYYNEKFQG

SEQ ID NO: 17079 - protein, 11 aa, Artificial Sequence
  Description of Artificial Sequence: Synthetic peptide
  XENP020156 vhCDR3
HYGTNYRYFDV

SEQ ID NO: 17080 - protein, 214 aa, Artificial Sequence
  Description of Artificial Sequence: Synthetic polypeptide
  XENP020156 2E9_H1L1_IgG1_PVA_/S267K Light Chain
DIVLTQSPGTLSLSPGERATLSCRASQSVSNDVAWYQQKPGQSPRLLIYYASNRYTGVPDRFTGSGYGTDFTLTISRLEPEDFAVYFCQQDYSSPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17081 - protein, 107 aa, Artificial Sequence; identical to SEQ ID NO: 11413
  Description of Artificial Sequence: Synthetic polypeptide
  VL of XENP020156

SEQ ID NO: 17082 - protein, 11 aa, Artificial Sequence
  Description of Artificial Sequence: Synthetic peptide
  XENP020156 vlCDR1
RASQSVSNDVA

SEQ ID NO: 17083 - protein, 7 aa, Artificial Sequence
  Description of Artificial Sequence: Synthetic peptide
  XENP020156 vlCDR2
YASNRYT

SEQ ID NO: 17084 - protein, 9 aa, Artificial Sequence
  Description of Artificial Sequence: Synthetic peptide
  XENP020156 vlCDR3
QQDYSSPYT

SEQ ID NO: 17085 - protein, 449 aa, Artificial Sequence
  Description of Artificial Sequence: Synthetic polypeptide
  XENP020157 2E9_H2L1_IgG1_PVA_/S267K Heavy Chain
EVQLVQSGAEVKKPGESLKISCKASGYAFTNYWLGWVRQMPGKGLEWMGNFYPGSSNTYYNPSFQGQVTISADKSISTAYLQWSSLKASDTAMYFCARHYGTNYRYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17086 - protein, 120 aa, Artificial Sequence; identical to SEQ ID NO: 11421
  Description of Artificial Sequence: Synthetic polypeptide
  VH of XENP020157

SEQ ID NO: 17087 - protein, 5 aa, Artificial Sequence
  Description of Artificial Sequence: Synthetic peptide
  XENP020157 vhCDR1
NYWLG

SEQ ID NO: 17088 - protein, 17 aa, Artificial Sequence
  Description of Artificial Sequence: Synthetic peptide
  XENP020157 vhCDR2
NFYPGSSNTYYNPSFQG

SEQ ID NO: 17089 - protein, 11 aa, Artificial Sequence
  Description of Artificial Sequence: Synthetic peptide
  XENP020157 vhCDR3
HYGTNYRYFDV

SEQ ID NO: 17090 - protein, 214 aa, Artificial Sequence; identical to SEQ ID NO: 17080
  Description of Artificial Sequence: Synthetic polypeptide
  XENP020157 2E9_H2L1_IgG1_PVA_/S267K Light Chain

SEQ ID NO: 17091 - protein, 107 aa, Artificial Sequence; identical to SEQ ID NO: 11413
  Description of Artificial Sequence: Synthetic polypeptide
  VL of XENP020157

SEQ ID NO: 17092 - protein, 11 aa, Artificial Sequence
  Description of Artificial Sequence: Synthetic peptide
  XENP020157 vlCDR1
RASQSVSNDVA

SEQ ID NO: 17093 - protein, 7 aa, Artificial Sequence
  Description of Artificial Sequence: Synthetic peptide
  XENP020157 vlCDR2
YASNRYT

SEQ ID NO: 17094 - protein, 9 aa, Artificial Sequence
  Description of Artificial Sequence: Synthetic peptide
  XENP020157 vlCDR3
QQDYSSPYT

SEQ ID NO: 17095 - protein, 444 aa, Artificial Sequence
  Description of Artificial Sequence: Synthetic polypeptide
  XENP020158 3C11(PD-1)_H1L1_IgG1_PVA_/S267K Heavy Chain
QVQLVQSGAEVKKPGASVKVSCKASGYTFTSYWMHWVRQAPGQGLEWMGAIYPGNIATSYNQKFQGRVTMTADTSTSTAYMELSSLRSEDTAVYYCTTSYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17096 - protein, 115 aa, Artificial Sequence; identical to SEQ ID NO: 11430
  Description of Artificial Sequence: Synthetic polypeptide
  VH of XENP020158

SEQ ID NO: 17097 - protein, 5 aa, Artificial Sequence
  Description of Artificial Sequence: Synthetic peptide
  XENP020158 vhCDR1
SYWMH

SEQ ID NO: 17098 - protein, 17 aa, Artificial Sequence
  Description of Artificial Sequence: Synthetic peptide
  XENP020158 vhCDR2
AIYPGNIATSYNQKFQG

SEQ ID NO: 17099 - protein, 6 aa, Artificial Sequence
  Description of Artificial Sequence: Synthetic peptide
  XENP020158 vhCDR3
SYVMDY

SEQ ID NO: 17100 - protein, 214 aa, Artificial Sequence
  Description of Artificial Sequence: Synthetic polypeptide
  XENP020158 3C11(PD-1)_H1L1_IgG1_PVA_/S267K Light Chain
DIVMTQSPSSLSASVGDRVTITCQASQDINSYLSWFQQKPGKSPKTLIYRANRLVDGVPSRFSGSGSGQDYTFTISSLQPEDIATYYCLQYDEFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17101 - protein, 107 aa, Artificial Sequence; identical to SEQ ID NO: 11431
  Description of Artificial Sequence: Synthetic polypeptide
  VL of XENP020158

SEQ ID NO: 17102 - protein, 11 aa, Artificial Sequence
  Description of Artificial Sequence: Synthetic peptide
  XENP020158 vlCDR1
QASQDINSYLS

SEQ ID NO: 17103 - protein, 7 aa, Artificial Sequence
  Description of Artificial Sequence: Synthetic peptide
  XENP020158 vlCDR2
RANRLVD

SEQ ID NO: 17104 - protein, 9 aa, Artificial Sequence
  Description of Artificial Sequence: Synthetic peptide
  XENP020158 vlCDR3
LQYDEFPYT

SEQ ID NO: 17105 - protein, 441 aa, Artificial Sequence
  Description of Artificial Sequence: Synthetic polypeptide
  XENP020159 3G12_H1L1_IgG1_PVA_/S267K Heavy Chain
QVQLVQSGAEVKKPGASVKVSCKASGYTFTSYWMHWVRQAPGQGLEWMGVIDPSDSYTSYNQKFQGRVTMTVDTSTSTAYMELSSLRSEDTAVYYCTGAYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17106 - protein, 112 aa, Artificial Sequence; identical to SEQ ID NO: 11439
  Description of Artificial Sequence: Synthetic polypeptide
  VH of XENP020159

SEQ ID NO: 17107 - protein, 5 aa, Artificial Sequence
  Description of Artificial Sequence: Synthetic peptide
  XENP020159 vhCDR1
SYWMH

SEQ ID NO: 17108 - protein, 17 aa, Artificial Sequence
  Description of Artificial Sequence: Synthetic peptide
  XENP020159 vhCDR2
VIDPSDSYTSYNQKFQG

SEQ ID NO: 17109 - protein, 3 aa, Artificial Sequence
  Description of Artificial Sequence: Synthetic peptide
  XENP020159 vhCDR3
AYY

SEQ ID NO: 17110 - protein, 214 aa, Artificial Sequence
  Description of Artificial Sequence: Synthetic polypeptide
  XENP020159 3G12_H1L1_IgG1_PVA_/S267K Light Chain
DIVLTQSPSSLSASVGDRVTITCRASQGISSNIGWLQQKPGKSFKGLIYHGTNLEDGVPSRFTGSGSGADYTLTISSLQPEDFATYYCVQYAQSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17111 - protein, 107 aa, Artificial Sequence; identical to SEQ ID NO: 11440
  Description of Artificial Sequence: Synthetic polypeptide
  VL of XENP020159

SEQ ID NO: 17112 - protein, 11 aa, Artificial Sequence
  Description of Artificial Sequence: Synthetic peptide
  XENP020159 vlCDR1
RASQGISSNIG

SEQ ID NO: 17113 - protein, 7 aa, Artificial Sequence
  Description of Artificial Sequence: Synthetic peptide
  XENP020159 vlCDR2
HGTNLED

SEQ ID NO: 17114 - protein, 9 aa, Artificial Sequence
  Description of Artificial Sequence: Synthetic peptide
  XENP020159 vlCDR3
VQYAQSPWT

SEQ ID NO: 17115 - protein, 441 aa, Artificial Sequence
  Description of Artificial Sequence: Synthetic polypeptide
  XENP020160 5C4_H1L1_IgG1_PVA_/S267K Heavy Chain
QVQLVQSGAEVKKPGASVKVSCKASGYTFTDYWMHWLRQAPGQGLEWMGAIDTSDSYPTYNQKFQGRVTMTVDDSTSTAYMELSSLRSEDTAVYYCTRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17116 - protein, 112 aa, Artificial Sequence; identical to SEQ ID NO: 11448
  Description of Artificial Sequence: Synthetic polypeptide
  VH of XENP020160

SEQ ID NO: 17117 - protein, 5 aa, Artificial Sequence
  Description of Artificial Sequence: Synthetic peptide
  XENP020160 vhCDR1
DYWMH

SEQ ID NO: 17118 - protein, 17 aa, Artificial Sequence
  Description of Artificial Sequence: Synthetic peptide
  XENP020160 vhCDR2
AIDTSDSYPTYNQKFQG

SEQ ID NO: 17119 - protein, 3 aa, Artificial Sequence
  Description of Artificial Sequence: Synthetic peptide
  XENP020160 vhCDR3
FDY

SEQ ID NO: 17120 - protein, 214 aa, Artificial Sequence
  Description of Artificial Sequence: Synthetic polypeptide
  XENP020160 5C4_H1L1_IgG1_PVA_/S267K Light Chain
DIVMTQSPDSLAVSLGERATINCKASQSVSNDVAWYQQKPGQSPKLLIYYASNRYTGVPDRFTGSGYGTDFTLTISSLQAEDVAVYFCQQDYSSPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17121 - protein, 107 aa, Artificial Sequence; identical to SEQ ID NO: 11449
  Description of Artificial Sequence: Synthetic polypeptide
  VL of XENP020160

SEQ ID NO: 17122 - protein, 11 aa, Artificial Sequence
  Description of Artificial Sequence: Synthetic peptide
  XENP020160 vlCDR1
KASQSVSNDVA

SEQ ID NO: 17123 - protein, 7 aa, Artificial Sequence
  Description of Artificial Sequence: Synthetic peptide
  XENP020160 vlCDR2
YASNRYT

SEQ ID NO: 17124 - protein, 9 aa, Artificial Sequence
  Description of Artificial Sequence: Synthetic peptide
  XENP020160 vlCDR3
QQDYSSPYT

SEQ ID NO: 17125 - protein, 441 aa, Artificial Sequence
  Description of Artificial Sequence: Synthetic polypeptide
  XENP020161 5C4_H2L1_IgG1_PVA_/S267K Heavy Chain
QVQLVQSGSELKKPGASVKVSCKASGYTFTDYWMHWLRQAPGQGLEWMGAIDTSDSYPTYNQGFTGRFVFSVDDSVSTAYLQISSLKAEDTAVYYCTRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17126 - protein, 112 aa, Artificial Sequence; identical to SEQ ID NO: 11457
  Description of Artificial Sequence: Synthetic polypeptide
  VH of XENP020161

SEQ ID NO: 17127 - protein, 5 aa, Artificial Sequence
  Description of Artificial Sequence: Synthetic peptide
  XENP020161 vhCDR1
DYWMH

SEQ ID NO: 17128 - protein, 17 aa, Artificial Sequence
  Description of Artificial Sequence: Synthetic peptide
  XENP020161 vhCDR2
AIDTSDSYPTYNQGFTG

SEQ ID NO: 17129 - protein, 3 aa, Artificial Sequence
  Description of Artificial Sequence: Synthetic peptide
  XENP020161 vhCDR3
FDY

SEQ ID NO: 17130 - protein, 214 aa, Artificial Sequence; identical to SEQ ID NO: 17120
  Description of Artificial Sequence: Synthetic polypeptide
  XENP020161 5C4_H2L1_IgG1_PVA_/S267K Light Chain

SEQ ID NO: 17131 - protein, 107 aa, Artificial Sequence; identical to SEQ ID NO: 11449
  Description of Artificial Sequence: Synthetic polypeptide
  VL of XENP020161

SEQ ID NO: 17132 - protein, 11 aa, Artificial Sequence
  Description of Artificial Sequence: Synthetic peptide
  XENP020161 vlCDR1
KASQSVSNDVA

SEQ ID NO: 17133 - protein, 7 aa, Artificial Sequence
  Description of Artificial Sequence: Synthetic peptide
  XENP020161 vlCDR2
YASNRYT

SEQ ID NO: 17134 - protein, 9 aa, Artificial Sequence
  Description of Artificial Sequence: Synthetic peptide
  XENP020161 vlCDR3
QQDYSSPYT

SEQ ID NO: 17135 - protein, 449 aa, Artificial Sequence
  Description of Artificial Sequence: Synthetic polypeptide
  XENP016436 25F7_H0L0_IgG1_PVA_/S267K Heavy Chain
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17136 - protein, 120 aa, Artificial Sequence
  Description of Artificial Sequence: Synthetic polypeptide
  VH of XENP016436
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSS

SEQ ID NO: 17137 - protein, 5 aa, Artificial Sequence
  Description of Artificial Sequence: Synthetic peptide
  XENP016436 vhCDR1
DYYWN

SEQ ID NO: 17138 - protein, 16 aa, Artificial Sequence
  Description of Artificial Sequence: Synthetic peptide
  XENP016436 vhCDR2
EINHNGNTNSNPSLKS

SEQ ID NO: 17139 - protein, 12 aa, Artificial Sequence
  Description of Artificial Sequence: Synthetic peptide
  XENP016436 vhCDR3
GYSDYEYNWFDP

SEQ ID NO: 17140 - protein, 214 aa, Artificial Sequence
  Description of Artificial Sequence: Synthetic polypeptide
  XENP016436 25F7_H0L0_IgG1_PVA_/S267K Light Chain
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17141 - protein, 107 aa, Artificial Sequence
  Description of Artificial Sequence: Synthetic polypeptide
  VL of XENP016436
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIK

SEQ ID NO: 17142 - protein, 11 aa, Artificial Sequence
  Description of Artificial Sequence: Synthetic peptide
  XENP016436 vlCDR1
RASQSISSYLA

SEQ ID NO: 17143 - protein, 7 aa, Artificial Sequence
  Description of Artificial Sequence: Synthetic peptide
  XENP016436 vlCDR2
DASNRAT

SEQ ID NO: 17144 - protein, 9 aa, Artificial Sequence
  Description of Artificial Sequence: Synthetic peptide
  XENP016436 vlCDR3
QQRSNWPLT

SEQ ID NO: 17145 - protein, 447 aa, Artificial Sequence
  Description of Artificial Sequence: Synthetic polypeptide
  XENP019353 1H11_H0L0_IgG1_PVA_/S267K Heavy Chain
QIQLVQSGPELKKPGETVKISCKASGYTFTNYGMNWVKQAPGKGLKWMGWINTYTGEPTYADDFKGRFAFSLETSASTAYLQINNLKNEDTATYFCARGRGMGYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17146 - protein, 118 aa, Artificial Sequence
  Description of Artificial Sequence: Synthetic polypeptide
  VH of XENP019353
QIQLVQSGPELKKPGETVKISCKASGYTFTNYGMNWVKQAPGKGLKWMGWINTYTGEPTYADDFKGRFAFSLETSASTAYLQINNLKNEDTATYFCARGRGMGYFDYWGQGTTLTVSS

SEQ ID NO: 17147 - protein, 5 aa, Artificial Sequence
  Description of Artificial Sequence: Synthetic peptide
  XENP019353 vhCDR1
NYGMN

SEQ ID NO: 17148 - protein, 17 aa, Artificial Sequence
  Description of Artificial Sequence: Synthetic peptide
  XENP019353 vhCDR2
WINTYTGEPTYADDFKG

SEQ ID NO: 17149 - protein, 9 aa, Artificial Sequence
  Description of Artificial Sequence: Synthetic peptide
  XENP019353 vhCDR3
GRGMGYFDY

SEQ ID NO: 17150 - protein, 214 aa, Artificial Sequence
  Description of Artificial Sequence: Synthetic polypeptide
  XENP019353 1H11_H0L0_IgG1_PVA_/S267K Light Chain
DIQMTQSPASLSVSVGETVTITCRASENIYSNLAWYQQKQGKSPQLLVYAATNLADGVPSRFSGSGSGTQYSLKINSLQSGDFGNYYCQHFWTTPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17151 - protein, 107 aa, Artificial Sequence
  Description of Artificial Sequence: Synthetic polypeptide
  VL of XENP019353
DIQMTQSPASLSVSVGETVTITCRASENIYSNLAWYQQKQGKSPQLLVYAATNLADGVPSRFSGSGSGTQYSLKINSLQSGDFGNYYCQHFWTTPRTFGGGTKLEIK

SEQ ID NO: 17152 - protein, 11 aa, Artificial Sequence
  Description of Artificial Sequence: Synthetic peptide
  XENP019353 vlCDR1
RASENIYSNLA

SEQ ID NO: 17153 - protein, 7 aa, Artificial Sequence
  Description of Artificial Sequence: Synthetic peptide
  XENP019353 vlCDR2
AATNLAD

SEQ ID NO: 17154 - protein, 9 aa, Artificial Sequence
  Description of Artificial Sequence: Synthetic peptide
  XENP019353 vlCDR3
QHFWTTPRT

SEQ ID NO: 17155 - protein, 447 aa, Artificial Sequence
  Description of Artificial Sequence: Synthetic polypeptide
  XENP019354 1H11_H1L1_IgG1_PVA_/S267K Heavy Chain
QIQLVQSGAEVKKPGASVKVSCKASGYTFTNYGMNWVRQAPGQGLEWMGWINTYTGEPTYADKFQGRVTMTLDTSTSTAYMELSSLRSEDTAVYFCARGRGMGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17156 - protein, 118 aa, Artificial Sequence
  Description of Artificial Sequence: Synthetic polypeptide
  VH of XENP019354
QIQLVQSGAEVKKPGASVKVSCKASGYTFTNYGMNWVRQAPGQGLEWMGWINTYTGEPTYADKFQGRVTMTLDTSTSTAYMELSSLRSEDTAVYFCARGRGMGYFDYWGQGTLVTVSS

SEQ ID NO: 17157 - protein, 5 aa, Artificial Sequence
  Description of Artificial Sequence: Synthetic peptide
  XENP019354 vhCDR1
NYGMN

SEQ ID NO: 17158 - protein, 17 aa, Artificial Sequence
  Description of Artificial Sequence: Synthetic peptide
  XENP019354 vhCDR2
WINTYTGEPTYADKFQG

SEQ ID NO: 17159 - protein, 9 aa, Artificial Sequence
  Description of Artificial Sequence: Synthetic peptide
  XENP019354 vhCDR3
GRGMGYFDY

SEQ ID NO: 17160 - protein, 214 aa, Artificial Sequence
  Description of Artificial Sequence: Synthetic polypeptide
  XENP019354 1H11_H1L1_IgG1_PVA_/S267K Light Chain
DIQMTQSPSSLSASVGDRVTITCRASENIYSNLAWYQQKPGKSPKLLVYAATNLADGVPSRFSGSGSGTDYTLTISSLQPEDFATYYCQHFWTTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17161 - protein, 107 aa, Artificial Sequence
  Description of Artificial Sequence: Synthetic polypeptide
  VL of XENP019354
DIQMTQSPSSLSASVGDRVTITCRASENIYSNLAWYQQKPGKSPKLLVYAATNLADGVPSRFSGSGSGTDYTLTISSLQPEDFATYYCQHFWTTPRTFGGGTKVEIK

SEQ ID NO: 17162 - protein, 11 aa, Artificial Sequence
  Description of Artificial Sequence: Synthetic peptide
  XENP019354 vlCDR1
RASENIYSNLA

SEQ ID NO: 17163 - protein, 7 aa, Artificial Sequence
  Description of Artificial Sequence: Synthetic peptide
  XENP019354 vlCDR2
AATNLAD

SEQ ID NO: 17164 - protein, 9 aa, Artificial Sequence
  Description of Artificial Sequence: Synthetic peptide
  XENP019354 vlCDR3
QHFWTTPRT

SEQ ID NO: 17165 - protein, 447 aa, Artificial Sequence; identical to SEQ ID NO: 17155
  Description of Artificial Sequence: Synthetic polypeptide
  XENP019355 1H11_H1L2_IgG1_PVA_/S267K Heavy Chain

SEQ ID NO: 17166 - protein, 118 aa, Artificial Sequence; identical to SEQ ID NO: 17156
  Description of Artificial Sequence: Synthetic polypeptide
  VH of XENP019355

SEQ ID NO: 17167 - protein, 5 aa, Artificial Sequence
  Description of Artificial Sequence: Synthetic peptide
  XENP019355 vhCDR1
NYGMN

SEQ ID NO: 17168 - protein, 17 aa, Artificial Sequence
  Description of Artificial Sequence: Synthetic peptide
  XENP019355 vhCDR2
WINTYTGEPTYADKFQG

SEQ ID NO: 17169 - protein, 9 aa, Artificial Sequence
  Description of Artificial Sequence: Synthetic peptide
  XENP019355 vhCDR3
GRGMGYFDY

SEQ ID NO: 17170 - protein, 214 aa, Artificial Sequence
  Description of Artificial Sequence: Synthetic polypeptide
  XENP019355 1H11_H1L2_IgG1_PVA_/S267K Light Chain
DIQMTQSPATLSVSPGERATLSCRASENIYSNLAWYQQKPGQSPRLLVYAATNLADGVPSRFSGSGSGTEYTLTISSLQSEDFAVYYCQHFWTTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17171 - protein, 107 aa, Artificial Sequence
  Description of Artificial Sequence: Synthetic polypeptide
  VL of XENP019355
DIQMTQSPATLSVSPGERATLSCRASENIYSNLAWYQQKPGQSPRLLVYAATNLADGVPSRFSGSGSGTEYTLTISSLQSEDFAVYYCQHFWTTPRTFGGGTKVEIK

SEQ ID NO: 17172 - protein, 11 aa, Artificial Sequence
  Description of Artificial Sequence: Synthetic peptide
  XENP019355 vlCDR1
RASENIYSNLA

SEQ ID NO: 17173 - protein, 7 aa, Artificial Sequence
  Description of Artificial Sequence: Synthetic peptide
  XENP019355 vlCDR2
AATNLAD

SEQ ID NO: 17174 - protein, 9 aa, Artificial Sequence
  Description of Artificial Sequence: Synthetic peptide
  XENP019355 vlCDR3
QHFWTTPRT

SEQ ID NO: 17175 - protein, 447 aa, Artificial Sequence
  Description of Artificial Sequence: Synthetic polypeptide
  XENP019356 1H11_H2L1_IgG1_PVA_/S267K Heavy Chain
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGMGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17176 - protein, 118 aa, Artificial Sequence
  Description of Artificial Sequence: Synthetic polypeptide
  VH of XENP019356
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGMGYFDYWGQGTLVTVSS

SEQ ID NO: 17177 - protein, 5 aa, Artificial Sequence
  Description of Artificial Sequence: Synthetic peptide
  XENP019356 vhCDR1
NYGMN

SEQ ID NO: 17178 - protein, 17 aa, Artificial Sequence
  Description of Artificial Sequence: Synthetic peptide
  XENP019356 vhCDR2
WINTYTGEPTYADGFTG

SEQ ID NO: 17179 - protein, 9 aa, Artificial Sequence
  Description of Artificial Sequence: Synthetic peptide
  XENP019356 vhCDR3
GRGMGYFDY

SEQ ID NO: 17180 - protein, 214 aa, Artificial Sequence; identical to SEQ ID NO: 17160
  Description of Artificial Sequence: Synthetic polypeptide
  XENP019356 1H11_H2L1_IgG1_PVA_/S267K Light Chain

SEQ ID NO: 17181 - protein, 107 aa, Artificial Sequence; identical to SEQ ID NO: 17161
  Description of Artificial Sequence: Synthetic polypeptide
  VL of XENP019356

SEQ ID NO: 17182 - protein, 11 aa, Artificial Sequence
  Description of Artificial Sequence: Synthetic peptide
  XENP019356 vlCDR1
RASENIYSNLA

SEQ ID NO: 17183 - protein, 7 aa, Artificial Sequence
  Description of Artificial Sequence: Synthetic peptide
  XENP019356 vlCDR2
AATNLAD

SEQ ID NO: 17184 - protein, 9 aa, Artificial Sequence
  Description of Artificial Sequence: Synthetic peptide
  XENP019356 vlCDR3
QHFWTTPRT

SEQ ID NO: 17185 - protein, 447 aa, Artificial Sequence; identical to SEQ ID NO: 17175
  Description of Artificial Sequence: Synthetic polypeptide
  XENP019357 1H11_H2L2_IgG1_PVA_/S267K Heavy Chain

SEQ ID NO: 17186 - protein, 118 aa, Artificial Sequence; identical to SEQ ID NO: 17176
  Description of Artificial Sequence: Synthetic polypeptide
  VH of XENP019357

SEQ ID NO: 17187 - protein, 5 aa, Artificial Sequence
  Description of Artificial Sequence: Synthetic peptide
  XENP019357 vhCDR1
NYGMN

SEQ ID NO: 17188 - protein, 17 aa, Artificial Sequence
  Description of Artificial Sequence: Synthetic peptide
  XENP019357 vhCDR2
WINTYTGEPTYADGFTG

SEQ ID NO: 17189 - protein, 9 aa, Artificial Sequence
  Description of Artificial Sequence: Synthetic peptide
  XENP019357 vhCDR3
GRGMGYFDY

SEQ ID NO: 17190 - protein, 214 aa, Artificial Sequence; identical to SEQ ID NO: 17170
  Description of Artificial Sequence: Synthetic polypeptide
  XENP019357 1H11_H2L2_IgG1_PVA_/S267K Light Chain

SEQ ID NO: 17191 - protein, 107 aa, Artificial Sequence; identical to SEQ ID NO: 17171
  Description of Artificial Sequence: Synthetic polypeptide
  VL of XENP019357

SEQ ID NO: 17192 - protein, 11 aa, Artificial Sequence
  Description of Artificial Sequence: Synthetic peptide
  XENP019357 vlCDR1
RASENIYSNLA

SEQ ID NO: 17193 - protein, 7 aa, Artificial Sequence
  Description of Artificial Sequence: Synthetic peptide
  XENP019357 vlCDR2
AATNLAD

SEQ ID NO: 17194 - protein, 9 aa, Artificial Sequence
  Description of Artificial Sequence: Synthetic peptide
  XENP019357 vlCDR3
QHFWTTPRT

SEQ ID NO: 17195 - protein, 450 aa, Artificial Sequence
  Description of Artificial Sequence: Synthetic polypeptide
  XENP019358 3C11_H1L1_IgG1_PVA_/S267K Heavy Chain
QVQLQESGPGLVKPSETLSLTCTVSGYSITSDYAWNWIRQPPGKKLEWIGYISYSSTSYNPSLKSRVTISRDTSKNQFSLKLSSVTAADTAVYFCARNNLLWSYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17196 - protein, 121 aa, Artificial Sequence
  Description of Artificial Sequence: Synthetic polypeptide
  VH of XENP019358
QVQLQESGPGLVKPSETLSLTCTVSGYSITSDYAWNWIRQPPGKKLEWIGYISYSSTSYNPSLKSRVTISRDTSKNQFSLKLSSVTAADTAVYFCARNNLLWSYYYAMDYWGQGTLVTVSS

SEQ ID NO: 17197 - protein, 6 aa, Artificial Sequence
  Description of Artificial Sequence: Synthetic peptide
  XENP019358 vhCDR1
SDYAWN

SEQ ID NO: 17198 - protein, 15 aa, Artificial Sequence
  Description of Artificial Sequence: Synthetic peptide
  XENP019358 vhCDR2
YISYSSTSYNPSLKS

SEQ ID NO: 17199 - protein, 13 aa, Artificial Sequence
  Description of Artificial Sequence: Synthetic peptide
  XENP019358 vhCDR3
NNLLWSYYYAMDY

SEQ ID NO: 17200 - protein, 218 aa, Artificial Sequence
  Description of Artificial Sequence: Synthetic polypeptide
  XENP019358 3C11_H1L1_IgG1_PVA_/S267K Light Chain
DIVLTQSPATLSLSPGERATLSCRASESVDSYGNSFMHWYQQKPGQPPRLLIYRASNLESGIPARFSGSGSGTDFTLTISSLEPEDFAVYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17201 - protein, 111 aa, Artificial Sequence
  Description of Artificial Sequence: Synthetic polypeptide
  VL of XENP019358
DIVLTQSPATLSLSPGERATLSCRASESVDSYGNSFMHWYQQKPGQPPRLLIYRASNLESGIPARFSGSGSGTDFTLTISSLEPEDFAVYYCQQSNEDPYTFGGGTKVEIK

SEQ ID NO: 17202 - protein, 15 aa, Artificial Sequence
  Description of Artificial Sequence: Synthetic peptide
  XENP019358 vlCDR1
RASESVDSYGNSFMH

SEQ ID NO: 17203 - protein, 7 aa, Artificial Sequence
  Description of Artificial Sequence: Synthetic peptide
  XENP019358 vlCDR2
RASNLES

SEQ ID NO: 17204 - protein, 9 aa, Artificial Sequence
  Description of Artificial Sequence: Synthetic peptide
  XENP019358 vlCDR3
QQSNEDPYT

SEQ ID NO: 17205 - protein, 447 aa, Artificial Sequence; identical to SEQ ID NO: 17155
  Description of Artificial Sequence: Synthetic polypeptide
  XENP019359 1H11_H1_5D8_L1_IgG1_PVA_/S267K Heavy Chain

SEQ ID NO: 17206 - protein, 118 aa, Artificial Sequence; identical to SEQ ID NO: 17156
  Description of Artificial Sequence: Synthetic polypeptide
  VH of XENP019359

SEQ ID NO: 17207 - protein, 5 aa, Artificial Sequence
  Description of Artificial Sequence: Synthetic peptide
  XENP019359 vhCDR1
NYGMN

SEQ ID NO: 17208 - protein, 17 aa, Artificial Sequence
  Description of Artificial Sequence: Synthetic peptide
  XENP019359 vhCDR2
WINTYTGEPTYADKFQG

SEQ ID NO: 17209 - protein, 9 aa, Artificial Sequence
  Description of Artificial Sequence: Synthetic peptide
  XENP019359 vhCDR3
GRGMGYFDY

SEQ ID NO: 17210 - protein, 214 aa, Artificial Sequence
  Description of Artificial Sequence: Synthetic polypeptide
  XENP019359 1H11_H1_5D8_L1_IgG1_PVA_/S267K Light Chain
DIQMTQSPSSLSASVGDRVTITCRASENIYSNLAWYQQKPGKSPKLLVYAATNLGDGVPSRFSGSGSGTDYTLTISSLQPEDFATYYCQHFWATPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17211 - protein, 107 aa, Artificial Sequence
  Description of Artificial Sequence: Synthetic polypeptide
  VL of XENP019359
DIQMTQSPSSLSASVGDRVTITCRASENIYSNLAWYQQKPGKSPKLLVYAATNLGDGVPSRFSGSGSGTDYTLTISSLQPEDFATYYCQHFWATPRTFGGGTKVEIK

SEQ ID NO: 17212 - protein, 11 aa, Artificial Sequence
  Description of Artificial Sequence: Synthetic peptide
  XENP019359 vlCDR1
RASENIYSNLA

SEQ ID NO: 17213 - protein, 7 aa, Artificial Sequence
  Description of Artificial Sequence: Synthetic peptide
  XENP019359 vlCDR2
AATNLGD

SEQ ID NO: 17214 - protein, 9 aa, Artificial Sequence
  Description of Artificial Sequence: Synthetic peptide
  XENP019359 vlCDR3
QHFWATPRT

SEQ ID NO: 17215 - protein, 444 aa, Artificial Sequence
  Description of Artificial Sequence: Synthetic polypeptide
  XENP019360 8D7_H1L1_IgG1_PVA_/S267K Heavy Chain
QVTLKESGPVLVKPTETLTLTCTVSGFSLSSYGVHWVRQPPGKGLEWLAVIWSGSTDYNPSLKSRLTISKDNSKSQVVLTMTNMDPVDTATYYCARTYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17216 - protein, 115 aa, Artificial Sequence
  Description of Artificial Sequence: Synthetic polypeptide
  VH of XENP019360
QVTLKESGPVLVKPTETLTLTCTVSGFSLSSYGVHWVRQPPGKGLEWLAVIWSGSTDYNPSLKSRLTISKDNSKSQVVLTMTNMDPVDTATYYCARTYYYAMDYWGQGTLVTVSS

SEQ ID NO: 17217 - protein, 5 aa, Artificial Sequence
  Description of Artificial Sequence: Synthetic peptide
  XENP019360 vhCDR1
SYGVH

SEQ ID NO: 17218 - protein, 15 aa, Artificial Sequence
  Description of Artificial Sequence: Synthetic peptide
  XENP019360 vhCDR2
VIWSGSTDYNPSLKS

SEQ ID NO: 17219 - protein, 8 aa, Artificial Sequence
  Description of Artificial Sequence: Synthetic peptide
  XENP019360 vhCDR3
TYYYAMDY

SEQ ID NO: 17220 - protein, 214 aa, Artificial Sequence
  Description of Artificial Sequence: Synthetic polypeptide
  XENP019360 8D7_H1L1_IgG1_PVA_/S267K Light Chain
DIQMTQSPSSLSASVGDRVTITCRASENIYSNLAWYQQKPGKSPKFLIYAATNLADGVPSRFSGSGSGTDYTLTISSLQPEDFATYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17221 - protein, 107 aa, Artificial Sequence
  Description of Artificial Sequence: Synthetic polypeptide
  VL of XENP019360
DIQMTQSPSSLSASVGDRVTITCRASENIYSNLAWYQQKPGKSPKFLIYAATNLADGVPSRFSGSGSGTDYTLTISSLQPEDFATYYCQHFWGTPWTFGGGTKVEIK

SEQ ID NO: 17222 - protein, 11 aa, Artificial Sequence
  Description of Artificial Sequence: Synthetic peptide
  XENP019360 vlCDR1
RASENIYSNLA

SEQ ID NO: 17223 - protein, 7 aa, Artificial Sequence
  Description of Artificial Sequence: Synthetic peptide
  XENP019360 vlCDR2
AATNLAD

SEQ ID NO: 17224 - protein, 9 aa, Artificial Sequence
  Description of Artificial Sequence: Synthetic peptide
  XENP019360 vlCDR3
QHFWGTPWT

SEQ ID NO: 17225 - protein, 447 aa, Artificial Sequence
  Description of Artificial Sequence: Synthetic polypeptide
  XENP019361 2A11_H0L0_IgG1_PVA_/S267K Heavy Chain
EVQLQQSGAELVRSGASVKLSCTASGFNIKDYYMHWVKQRPEQGLEWIGWIDPENGDTEYAPKFQGKATMTADTSSNTAYLQLSSLTSEDTAVYYCYARGVRQALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17226 - protein, 118 aa, Artificial Sequence
  Description of Artificial Sequence: Synthetic polypeptide
  VH of XENP019361
EVQLQQSGAELVRSGASVKLSCTASGFNIKDYYMHWVKQRPEQGLEWIGWIDPENGDTEYAPKFQGKATMTADTSSNTAYLQLSSLTSEDTAVYYCYARGVRQALDYWGQGTSVTVSS

SEQ ID NO: 17227 - protein, 5 aa, Artificial Sequence
  Description of Artificial Sequence: Synthetic peptide
  XENP019361 vhCDR1
DYYMH

SEQ ID NO: 17228 - protein, 17 aa, Artificial Sequence
  Description of Artificial Sequence: Synthetic peptide
  XENP019361 vhCDR2
WIDPENGDTEYAPKFQG

SEQ ID NO: 17229 - protein, 9 aa, Artificial Sequence
  Description of Artificial Sequence: Synthetic peptide
  XENP019361 vhCDR3
RGVRQALDY

SEQ ID NO: 17230 - protein, 214 aa, Artificial Sequence
  Description of Artificial Sequence: Synthetic polypeptide
  XENP019361 2A11_H0L0_IgG1_PVA_/S267K Light Chain
DIQMTQTTSSLSASLGDRVTISCRASQDIGNYLNWFQQKPDGTVKLLIYYTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17231 - protein, 107 aa, Artificial Sequence
  Description of Artificial Sequence: Synthetic polypeptide
  VL of XENP019361
DIQMTQTTSSLSASLGDRVTISCRASQDIGNYLNWFQQKPDGTVKLLIYYTSRLHSGVPSRFSGSGSGTDYSLTISNLEQEDIATYFCQQGNTLPYTFGGGTKLEIK

SEQ ID NO: 17232 - protein, 11 aa, Artificial Sequence
  Description of Artificial Sequence: Synthetic peptide
  XENP019361 vlCDR1
RASQDIGNYLN

SEQ ID NO: 17233 - protein, 7 aa, Artificial Sequence
  Description of Artificial Sequence: Synthetic peptide
  XENP019361 vlCDR2
YTSRLHS

SEQ ID NO: 17234 - protein, 9 aa, Artificial Sequence
  Description of Artificial Sequence: Synthetic peptide
  XENP019361 vlCDR3
QQGNTLPYT

SEQ ID NO: 17235 - protein, 447 aa, Artificial Sequence
  Description of Artificial Sequence: Synthetic polypeptide
  XENP019362 2A11_H1L1_IgG1_PVA_/S267K Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17236 - protein, 118 aa, Artificial Sequence
  Description of Artificial Sequence: Synthetic polypeptide
  VH of XENP019362
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 17237 - protein, 5 aa, Artificial Sequence
  Description of Artificial Sequence: Synthetic peptide
  XENP019362 vhCDR1
DYYMH

SEQ ID NO: 17238 - protein, 17 aa, Artificial Sequence
  Description of Artificial Sequence: Synthetic peptide
  XENP019362 vhCDR2
WIDPENGDTEYAPKFQG

SEQ ID NO: 17239 - protein, 9 aa, Artificial Sequence
  Description of Artificial Sequence: Synthetic peptide
  XENP019362 vhCDR3
RGVRQALDY

SEQ ID NO: 17240 - protein, 214 aa, Artificial Sequence
  Description of Artificial Sequence: Synthetic polypeptide
  XENP019362 2A11_H1L1_IgG1_PVA_/S267K Light Chain
DIQMTQSPSSLSASVGDRVTITCRASQDIGNYLNWFQQKPGKTVKLLIYYTSRLHSGVPSRFSGSGSGTDYTLTISSLQPEDFATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17241 - protein, 107 aa, Artificial Sequence
  Description of Artificial Sequence: Synthetic polypeptide
  VL of XENP019362
DIQMTQSPSSLSASVGDRVTITCRASQDIGNYLNWFQQKPGKTVKLLIYYTSRLHSGVPSRFSGSGSGTDYTLTISSLQPEDFATYFCQQGNTLPYTFGGGTKVEIK

SEQ ID NO: 17242 - protein, 11 aa, Artificial Sequence
  Description of Artificial Sequence: Synthetic peptide
  XENP019362 vlCDR1
RASQDIGNYLN

SEQ ID NO: 17243 - protein, 7 aa, Artificial Sequence
  Description of Artificial Sequence: Synthetic peptide
  XENP019362 vlCDR2
YTSRLHS

SEQ ID NO: 17244 - protein, 9 aa, Artificial Sequence
  Description of Artificial Sequence: Synthetic peptide
  XENP019362 vlCDR3
QQGNTLPYT

SEQ ID NO: 17245 - protein, 447 aa, Artificial Sequence; identical to SEQ ID NO: 17235
  Description of Artificial Sequence: Synthetic polypeptide
  XENP019363 2A11_H1L2_IgG1_PVA_/S267K Heavy Chain

SEQ ID NO: 17246 - protein, 118 aa, Artificial Sequence; identical to SEQ ID NO: 17236
  Description of Artificial Sequence: Synthetic polypeptide
  VH of XENP019363

SEQ ID NO: 17247 - protein, 5 aa, Artificial Sequence
  Description of Artificial Sequence: Synthetic peptide
  XENP019363 vhCDR1
DYYMH

SEQ ID NO: 17248 - protein, 17 aa, Artificial Sequence
  Description of Artificial Sequence: Synthetic peptide
  XENP019363 vhCDR2
WIDPENGDTEYAPKFQG

SEQ ID NO: 17249 - protein, 9 aa, Artificial Sequence
  Description of Artificial Sequence: Synthetic peptide
  XENP019363 vhCDR3
RGVRQALDY

SEQ ID NO: 17250 - protein, 214 aa, Artificial Sequence
  Description of Artificial Sequence: Synthetic polypeptide
  XENP019363 2A11_H1L2_IgG1_PVA_/S267K Light Chain
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17251 - protein, 107 aa, Artificial Sequence
  Description of Artificial Sequence: Synthetic polypeptide
  VL of XENP019363
DIQMTQSPAFLSVTPGEKVTITCQASQDIGNYLNWFQQKPDQTVKLLIYYTSRLHSGVPSRFSGSGSGTDYTFTISSLEAEDAATYFCQQGNTLPYTFGGGTKVEIK

SEQ ID NO: 17252 - protein, 11 aa, Artificial Sequence
  Description of Artificial Sequence: Synthetic peptide
  XENP019363 vlCDR1
QASQDIGNYLN

SEQ ID NO: 17253 - protein, 7 aa, Artificial Sequence
  Description of Artificial Sequence: Synthetic peptide
  XENP019363 vlCDR2
YTSRLHS

SEQ ID NO: 17254 - protein, 9 aa, Artificial Sequence
  Description of Artificial Sequence: Synthetic peptide
  XENP019363 vlCDR3
QQGNTLPYT

SEQ ID NO: 17255 - protein, 446 aa, Artificial Sequence
  Description of Artificial Sequence: Synthetic polypeptide
  XENP019364 2A11_H2L1_IgG1_PVA_/S267K Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17256 - protein, 117 aa, Artificial Sequence
  Description of Artificial Sequence: Synthetic polypeptide
  VH of XENP019364
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARGVRQALDYWGQGTLVTVSS

SEQ ID NO: 17257 - protein, 5 aa, Artificial Sequence
  Description of Artificial Sequence: Synthetic peptide
  XENP019364 vhCDR1
DYYMH

SEQ ID NO: 17258 - protein, 17 aa, Artificial Sequence
  Description of Artificial Sequence: Synthetic peptide
  XENP019364 vhCDR2
WIDPENGDTEYAPKFQG

SEQ ID NO: 17259 - protein, 8 aa, Artificial Sequence
  Description of Artificial Sequence: Synthetic peptide
  XENP019364 vhCDR3
GVRQALDY

SEQ ID NO: 17260 - protein, 214 aa, Artificial Sequence; identical to SEQ ID NO: 17240
  Description of Artificial Sequence: Synthetic polypeptide
  XENP019364 2A11_H2L1_IgG1_PVA_/S267K Light Chain

SEQ ID NO: 17261 - protein, 107 aa, Artificial Sequence; identical to SEQ ID NO: 17241
  Description of Artificial Sequence: Synthetic polypeptide
  VL of XENP019364

SEQ ID NO: 17262 - protein, 11 aa, Artificial Sequence
  Description of Artificial Sequence: Synthetic peptide
  XENP019364 vlCDR1
RASQDIGNYLN

SEQ ID NO: 17263 - protein, 7 aa, Artificial Sequence
  Description of Artificial Sequence: Synthetic peptide
  XENP019364 vlCDR2
YTSRLHS

SEQ ID NO: 17264 - protein, 9 aa, Artificial Sequence
  Description of Artificial Sequence: Synthetic peptide
  XENP019364 vlCDR3
QQGNTLPYT

SEQ ID NO: 17265 - protein, 446 aa, Artificial Sequence; identical to SEQ ID NO: 17255
  Description of Artificial Sequence: Synthetic polypeptide
  XENP019365 2A11_H2L2_IgG1_PVA_/S267K Heavy Chain

SEQ ID NO: 17266 - protein, 117 aa, Artificial Sequence; identical to SEQ ID NO: 17256
  Description of Artificial Sequence: Synthetic polypeptide
  VH of XENP019365

SEQ ID NO: 17267 - protein, 5 aa, Artificial Sequence
  Description of Artificial Sequence: Synthetic peptide
  XENP019365 vhCDR1
DYYMH

SEQ ID NO: 17268 - protein, 17 aa, Artificial Sequence
  Description of Artificial Sequence: Synthetic peptide
  XENP019365 vhCDR2
WIDPENGDTEYAPKFQG

SEQ ID NO: 17269 - protein, 8 aa, Artificial Sequence
  Description of Artificial Sequence: Synthetic peptide
  XENP019365 vhCDR3
GVRQALDY

SEQ ID NO: 17270 - protein, 214 aa, Artificial Sequence; identical to SEQ ID NO: 17250
  Description of Artificial Sequence: Synthetic polypeptide
  XENP019365 2A11_H2L2_IgG1_PVA_/S267K Light Chain

SEQ ID NO: 17271 - protein, 107 aa, Artificial Sequence; identical to SEQ ID NO: 17251
  Description of Artificial Sequence: Synthetic polypeptide
  VL of XENP019365

SEQ ID NO: 17272 - protein, 11 aa, Artificial Sequence
  Description of Artificial Sequence: Synthetic peptide
  XENP019365 vlCDR1
QASQDIGNYLN

SEQ ID NO: 17273 - protein, 7 aa, Artificial Sequence
  Description of Artificial Sequence: Synthetic peptide
  XENP019365 vlCDR2
YTSRLHS

SEQ ID NO: 17274 - protein, 9 aa, Artificial Sequence
  Description of Artificial Sequence: Synthetic peptide
  XENP019365 vlCDR3
QQGNTLPYT

SEQ ID NO: 17275 - protein, 447 aa, Artificial Sequence
  Description of Artificial Sequence: Synthetic polypeptide
  XENP019366 2A11_H3L1_IgG1_PVA_/S267K Heavy Chain
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17276 - protein, 118 aa, Artificial Sequence
  Description of Artificial Sequence: Synthetic polypeptide
  VH of XENP019366
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCYARGVRQALDYWGQGTLVTVSS

SEQ ID NO: 17277 - protein, 5 aa, Artificial Sequence
  Description of Artificial Sequence: Synthetic peptide
  XENP019366 vhCDR1
DYYMH

SEQ ID NO: 17278 - protein, 17 aa, Artificial Sequence
  Description of Artificial Sequence: Synthetic peptide
  XENP019366 vhCDR2
WIDPENGDTEYAPSVKG

SEQ ID NO: 17279 - protein, 9 aa, Artificial Sequence
  Description of Artificial Sequence: Synthetic peptide
  XENP019366 vhCDR3
RGVRQALDY

SEQ ID NO: 17280 - protein, 214 aa, Artificial Sequence; identical to SEQ ID NO: 17240
  Description of Artificial Sequence: Synthetic polypeptide
  XENP019366 2A11_H3L1_IgG1_PVA_/S267K Light Chain

SEQ ID NO: 17281 - protein, 107 aa, Artificial Sequence; identical to SEQ ID NO: 17241
  Description of Artificial Sequence: Synthetic polypeptide
  VL of XENP019366

SEQ ID NO: 17282 - protein, 11 aa, Artificial Sequence
  Description of Artificial Sequence: Synthetic peptide
  XENP019366 vlCDR1
RASQDIGNYLN

SEQ ID NO: 17283 - protein, 7 aa, Artificial Sequence
  Description of Artificial Sequence: Synthetic peptide
  XENP019366 vlCDR2
YTSRLHS

SEQ ID NO: 17284 - protein, 9 aa, Artificial Sequence
  Description of Artificial Sequence: Synthetic peptide
  XENP019366 vlCDR3
QQGNTLPYT

SEQ ID NO: 17285 - protein, 447 aa, Artificial Sequence; identical to SEQ ID NO: 17275
  Description of Artificial Sequence: Synthetic polypeptide
  XENP019367 2A11_H3L2_IgG1_PVA_/S267K Heavy Chain

SEQ ID NO: 17286 - protein, 118 aa, Artificial Sequence; identical to SEQ ID NO: 17276
  Description of Artificial Sequence: Synthetic polypeptide
  VH of XENP019367

SEQ ID NO: 17287 - protein, 5 aa, Artificial Sequence
  Description of Artificial Sequence: Synthetic peptide
  XENP019367 vhCDR1
DYYMH

SEQ ID NO: 17288 - protein, 17 aa, Artificial Sequence
  Description of Artificial Sequence: Synthetic peptide
  XENP019367 vhCDR2
WIDPENGDTEYAPSVKG

SEQ ID NO: 17289 - protein, 9 aa, Artificial Sequence
  Description of Artificial Sequence: Synthetic peptide
  XENP019367 vhCDR3
RGVRQALDY

SEQ ID NO: 17290 - protein, 214 aa, Artificial Sequence; identical to SEQ ID NO: 17250
  Description of Artificial Sequence: Synthetic polypeptide
  XENP019367 2A11_H3L2_IgG1_PVA_/S267K Light Chain

SEQ ID NO: 17291 - protein, 107 aa, Artificial Sequence; identical to SEQ ID NO: 17251
  Description of Artificial Sequence: Synthetic polypeptide
  VL of XENP019367

SEQ ID NO: 17292 - protein, 11 aa, Artificial Sequence
  Description of Artificial Sequence: Synthetic peptide
  XENP019367 vlCDR1
QASQDIGNYLN

SEQ ID NO: 17293 - protein, 7 aa, Artificial Sequence
  Description of Artificial Sequence: Synthetic peptide
  XENP019367 vlCDR2
YTSRLHS

SEQ ID NO: 17294 - protein, 9 aa, Artificial Sequence
  Description of Artificial Sequence: Synthetic peptide
  XENP019367 vlCDR3
QQGNTLPYT

SEQ ID NO: 17295 - protein, 446 aa, Artificial Sequence
  Description of Artificial Sequence: Synthetic polypeptide
  XENP019368 2A11_H4L1_IgG1_PVA_/S267K Heavy Chain
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17296 - protein, 117 aa, Artificial Sequence
  Description of Artificial Sequence: Synthetic polypeptide
  VH of XENP019368
EVQLVESGGGVVQPGGSLRLSCAASGFNIKDYYMHWVRQAPGKGLEWVSWIDPENGDTEYAPSVKGRFTISADTSKNSAYLQMNSLRTEDTALYYCARGVRQALDYWGQGTLVTVSS

SEQ ID NO: 17297 - protein, 5 aa, Artificial Sequence
  Description of Artificial Sequence: Synthetic peptide
  XENP019368 vhCDR1
DYYMH

SEQ ID NO: 17298 - protein, 17 aa, Artificial Sequence
  Description of Artificial Sequence: Synthetic peptide
  XENP019368 vhCDR2
WIDPENGDTEYAPSVKG

SEQ ID NO: 17299 - protein, 8 aa, Artificial Sequence
  Description of Artificial Sequence: Synthetic peptide
  XENP019368 vhCDR3
GVRQALDY

SEQ ID NO: 17300 - protein, 214 aa, Artificial Sequence; identical to SEQ ID NO: 17240
  Description of Artificial Sequence: Synthetic polypeptide
  XENP019368 2A11_H4L1_IgG1_PVA_/S267K Light Chain

SEQ ID NO: 17301 - protein, 107 aa, Artificial Sequence; identical to SEQ ID NO: 17241
  Description of Artificial Sequence: Synthetic polypeptide
  VL of XENP019368

SEQ ID NO: 17302 - protein, 11 aa, Artificial Sequence
  Description of Artificial Sequence: Synthetic peptide
  XENP019368 vlCDR1
RASQDIGNYLN

SEQ ID NO: 17303 - protein, 7 aa, Artificial Sequence
  Description of Artificial Sequence: Synthetic peptide
  XENP019368 vlCDR2
YTSRLHS

SEQ ID NO: 17304 - protein, 9 aa, Artificial Sequence
  Description of Artificial Sequence: Synthetic peptide
  XENP019368 vlCDR3
QQGNTLPYT

SEQ ID NO: 17305 - protein, 446 aa, Artificial Sequence; identical to SEQ ID NO: 17295
  Description of Artificial Sequence: Synthetic polypeptide
  XENP019369 2A11_H4L2_IgG1_PVA_/S267K Heavy Chain

SEQ ID NO: 17306 - protein, 117 aa, Artificial Sequence; identical to SEQ ID NO: 17296
  Description of Artificial Sequence: Synthetic polypeptide
  VH of XENP019369

SEQ ID NO: 17307 - protein, 5 aa, Artificial Sequence
  Description of Artificial Sequence: Synthetic peptide
  XENP019369 vhCDR1
DYYMH

SEQ ID NO: 17308 - protein, 17 aa, Artificial Sequence
  Description of Artificial Sequence: Synthetic peptide
  XENP019369 vhCDR2
WIDPENGDTEYAPSVKG

SEQ ID NO: 17309 - protein, 8 aa, Artificial Sequence
  Description of Artificial Sequence: Synthetic peptide
  XENP019369 vhCDR3
GVRQALDY

SEQ ID NO: 17310 - protein, 214 aa, Artificial Sequence; identical to SEQ ID NO: 17250
  Description of Artificial Sequence: Synthetic polypeptide
  XENP019369 2A11_H4L2_IgG1_PVA_/S267K Light Chain

SEQ ID NO: 17311 - protein, 107 aa, Artificial Sequence; identical to SEQ ID NO: 17251
  Description of Artificial Sequence: Synthetic polypeptide
  VL of XENP019369

SEQ ID NO: 17312 - protein, 11 aa, Artificial Sequence
  Description of Artificial Sequence: Synthetic peptide
  XENP019369 vlCDR1
QASQDIGNYLN

SEQ ID NO: 17313 - protein, 7 aa, Artificial Sequence
  Description of Artificial Sequence: Synthetic peptide
  XENP019369 vlCDR2
YTSRLHS

SEQ ID NO: 17314 - protein, 9 aa, Artificial Sequence
  Description of Artificial Sequence: Synthetic peptide
  XENP019369 vlCDR3
QQGNTLPYT

SEQ ID NO: 17315 - protein, 445 aa, Artificial Sequence
  Description of Artificial Sequence: Synthetic polypeptide
  XENP019370 3F9_H1_7A6_L2_IgG1_PVA_/S267K Heavy Chain
QVQLQESGPGLVKPSQTLSLTCTVSDFSITSAYYWNWIRQPPGKKLEWIGYISYDSNYYNPSLKSRVTISRDTSKNQFSLKLSSVTAADTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17316 - protein, 116 aa, Artificial Sequence
  Description of Artificial Sequence: Synthetic polypeptide
  VH of XENP019370
QVQLQESGPGLVKPSQTLSLTCTVSDFSITSAYYWNWIRQPPGKKLEWIGYISYDSNYYNPSLKSRVTISRDTSKNQFSLKLSSVTAADTAVYYCARGGITTFDYWGQGTLVTVSS

SEQ ID NO: 17317 - protein, 6 aa, Artificial Sequence
  Description of Artificial Sequence: Synthetic peptide
  XENP019370 vhCDR1
SAYYWN

SEQ ID NO: 17318 - protein, 15 aa, Artificial Sequence
  Description of Artificial Sequence: Synthetic peptide
  XENP019370 vhCDR2
YISYDSNYYNPSLKS

SEQ ID NO: 17319 - protein, 8 aa, Artificial Sequence
  Description of Artificial Sequence: Synthetic peptide
  XENP019370 vhCDR3
GGITTFDY

SEQ ID NO: 17320 - protein, 218 aa, Artificial Sequence
  Description of Artificial Sequence: Synthetic polypeptide
  XENP019370 3F9_H1_7A6_L2_IgG1_PVA_/S267K Light Chain
DIVLTQSPATLSLSPGERATLSCRASQSVDYDGDSYMNWYQQKPGQPPRLLIYAASNLESGIPARFSGSGSGTDFTLTISSLEPEDFAVYYCQQSNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17321 - protein, 111 aa, Artificial Sequence
  Description of Artificial Sequence: Synthetic polypeptide
  VL of XENP019370
DIVLTQSPATLSLSPGERATLSCRASQSVDYDGDSYMNWYQQKPGQPPRLLIYAASNLESGIPARFSGSGSGTDFTLTISSLEPEDFAVYYCQQSNEDPRTFGGGTKVEIK

SEQ ID NO: 17322 - protein, 15 aa, Artificial Sequence
  Description of Artificial Sequence: Synthetic peptide
  XENP019370 vlCDR1
RASQSVDYDGDSYMN

SEQ ID NO: 17323 - protein, 7 aa, Artificial Sequence
  Description of Artificial Sequence: Synthetic peptide
  XENP019370 vlCDR2
AASNLES

SEQ ID NO: 17324 - protein, 9 aa, Artificial Sequence
  Description of Artificial Sequence: Synthetic peptide
  XENP019370 vlCDR3
QQSNEDPRT

SEQ ID NO: 17325 - protein, 444 aa, Artificial Sequence
  Description of Artificial Sequence: Synthetic polypeptide
  XENP019371 6A6_H1L1_IgG1_PVA_/S267K Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARAAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17326 - protein, 115 aa, Artificial Sequence
  Description of Artificial Sequence: Synthetic polypeptide
  VH of XENP019371
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCARAAAMDYWGQGTLVTVSS

SEQ ID NO: 17327 - protein, 5 aa, Artificial Sequence
  Description of Artificial Sequence: Synthetic peptide
  XENP019371 vhCDR1
DYYMH

SEQ ID NO: 17328 - protein, 17 aa, Artificial Sequence
  Description of Artificial Sequence: Synthetic peptide
  XENP019371 vhCDR2
WIDPENGDTEYAPKFQG

SEQ ID NO: 17329 - protein, 6 aa, Artificial Sequence
  Description of Artificial Sequence: Synthetic peptide
  XENP019371 vhCDR3
AAAMDY

SEQ ID NO: 17330 - protein, 214 aa, Artificial Sequence
  Description of Artificial Sequence: Synthetic polypeptide
  XENP019371 6A6_H1L1_IgG1_PVA_/S267K Light Chain
DIQMTQSPSSLSASVGDRVTITCRASQDISNYLNWFQQKPGKTFKLLIYYTSRLHSGVPSRFSGSGSGTDYTLTISSLQPEDFATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17331 - protein, 107 aa, Artificial Sequence
  Description of Artificial Sequence: Synthetic polypeptide
  VL of XENP019371
DIQMTQSPSSLSASVGDRVTITCRASQDISNYLNWFQQKPGKTFKLLIYYTSRLHSGVPSRFSGSGSGTDYTLTISSLQPEDFATYFCQQGNTLPYTFGGGTKVEIK

SEQ ID NO: 17332 - protein, 11 aa, Artificial Sequence
  Description of Artificial Sequence: Synthetic peptide
  XENP019371 vlCDR1
RASQDISNYLN

SEQ ID NO: 17333 - protein, 7 aa, Artificial Sequence
  Description of Artificial Sequence: Synthetic peptide
  XENP019371 vlCDR2
YTSRLHS

SEQ ID NO: 17334 - protein, 9 aa, Artificial Sequence
  Description of Artificial Sequence: Synthetic peptide
  XENP019371 vlCDR3
QQGNTLPYT

SEQ ID NO: 17335 - protein, 444 aa, Artificial Sequence
  Description of Artificial Sequence: Synthetic polypeptide
  XENP019372 9E7_H0L0_IgG1_PVA_/S267K Heavy Chain
QVQLKQSGPGLVQPSQSLSITCTVSGFSLTRYGIHWVRQSPGKGLEWLGVIWSGVTDYNAAFISRLSISKDNSKSQVFFKLNSLQANDTAIYYCARPYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17336 - protein, 115 aa, Artificial Sequence
  Description of Artificial Sequence: Synthetic polypeptide
  VH of XENP019372
QVQLKQSGPGLVQPSQSLSITCTVSGFSLTRYGIHWVRQSPGKGLEWLGVIWSGVTDYNAAFISRLSISKDNSKSQVFFKLNSLQANDTAIYYCARPYYYAMDYWGQGTSVTVSS

SEQ ID NO: 17337 - protein, 5 aa, Artificial Sequence
  Description of Artificial Sequence: Synthetic peptide
  XENP019372 vhCDR1
RYGIH

SEQ ID NO: 17338 - protein, 15 aa, Artificial Sequence
  Description of Artificial Sequence: Synthetic peptide
  XENP019372 vhCDR2
VIWSGVTDYNAAFIS

SEQ ID NO: 17339 - protein, 8 aa, Artificial Sequence
  Description of Artificial Sequence: Synthetic peptide
  XENP019372 vhCDR3
PYYYAMDY

SEQ ID NO: 17340 - protein, 214 aa, Artificial Sequence
  Description of Artificial Sequence: Synthetic polypeptide
  XENP019372 9E7_H0L0_IgG1_PVA_/S267K Light Chain
DIQMTQSPASLSVSVGETVTITCRASENIYSNLAWYQQKQGKSPQLLVYAATTLADGVPSRFSGSGSGTQYSLKINSLQSEDFGSYYCQHFWGTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17341 - protein, 107 aa, Artificial Sequence
  Description of Artificial Sequence: Synthetic polypeptide
  VL of XENP019372
DIQMTQSPASLSVSVGETVTITCRASENIYSNLAWYQQKQGKSPQLLVYAATTLADGVPSRFSGSGSGTQYSLKINSLQSEDFGSYYCQHFWGTPWTFGGGTKLEIK

SEQ ID NO: 17342 - protein, 11 aa, Artificial Sequence
  Description of Artificial Sequence: Synthetic peptide
  XENP019372 vlCDR1
RASENIYSNLA

SEQ ID NO: 17343 - protein, 7 aa, Artificial Sequence
  Description of Artificial Sequence: Synthetic peptide
  XENP019372 vlCDR2
AATTLAD

SEQ ID NO: 17344 - protein, 9 aa, Artificial Sequence
  Description of Artificial Sequence: Synthetic peptide
  XENP019372 vlCDR3
QHFWGTPWT

SEQ ID NO: 17345 - protein, 444 aa, Artificial Sequence
  Description of Artificial Sequence: Synthetic polypeptide
  XENP019373 9E7_H1L1_IgG1_PVA_/S267K Heavy Chain
QVQLVQSGAEVKKPGASVKVSCKVSGFSLTRYGIHWVRQAPGQGLEWMGVIWSGVTDYNAKFQGRVTMTKDNSKSTVYMELSSLRSEDTAVYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17346 - protein, 115 aa, Artificial Sequence
  Description of Artificial Sequence: Synthetic polypeptide
  VH of XENP019373
QVQLVQSGAEVKKPGASVKVSCKVSGFSLTRYGIHWVRQAPGQGLEWMGVIWSGVTDYNAKFQGRVTMTKDNSKSTVYMELSSLRSEDTAVYYCARPYYYAMDYWGQGTLVTVSS

SEQ ID NO: 17347 - protein, 5 aa, Artificial Sequence
  Description of Artificial Sequence: Synthetic peptide
  XENP019373 vhCDR1
RYGIH

SEQ ID NO: 17348 - protein, 15 aa, Artificial Sequence
  Description of Artificial Sequence: Synthetic peptide
  XENP019373 vhCDR2
VIWSGVTDYNAKFQG

SEQ ID NO: 17349 - protein, 8 aa, Artificial Sequence
  Description of Artificial Sequence: Synthetic peptide
  XENP019373 vhCDR3
PYYYAMDY

SEQ ID NO: 17350 - protein, 214 aa, Artificial Sequence
  Description of Artificial Sequence: Synthetic polypeptide
  XENP019373 9E7_H1L1_IgG1_PVA_/S267K Light Chain
DIQMTQSPSSLSASVGDRVTITCRASENIYSNLAWYQQKPGKSPKLLVYAATTLADGVPSRFSGSGSGTDYTLTISSLQPEDFATYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17351 - protein, 107 aa, Artificial Sequence
  Description of Artificial Sequence: Synthetic polypeptide
  VL of XENP019373
DIQMTQSPSSLSASVGDRVTITCRASENIYSNLAWYQQKPGKSPKLLVYAATTLADGVPSRFSGSGSGTDYTLTISSLQPEDFATYYCQHFWGTPWTFGGGTKVEIK

SEQ ID NO: 17352 - protein, 11 aa, Artificial Sequence
  Description of Artificial Sequence: Synthetic peptide
  XENP019373 vlCDR1
RASENIYSNLA

SEQ ID NO: 17353 - protein, 7 aa, Artificial Sequence
  Description of Artificial Sequence: Synthetic peptide
  XENP019373 vlCDR2
AATTLAD

SEQ ID NO: 17354 - protein, 9 aa, Artificial Sequence
  Description of Artificial Sequence: Synthetic peptide
  XENP019373 vlCDR3
QHFWGTPWT

SEQ ID NO: 17355 - protein, 444 aa, Artificial Sequence; identical to SEQ ID NO: 17345
  Description of Artificial Sequence: Synthetic polypeptide
  XENP019374 9E7_H1L2_IgG1_PVA_/S267K Heavy Chain

SEQ ID NO: 17356 - protein, 115 aa, Artificial Sequence; identical to SEQ ID NO: 17346
  Description of Artificial Sequence: Synthetic polypeptide
  VH of XENP019374

SEQ ID NO: 17357 - protein, 5 aa, Artificial Sequence
  Description of Artificial Sequence: Synthetic peptide
  XENP019374 vhCDR1
RYGIH

SEQ ID NO: 17358 - protein, 15 aa, Artificial Sequence
  Description of Artificial Sequence: Synthetic peptide
  XENP019374 vhCDR2
VIWSGVTDYNAKFQG

SEQ ID NO: 17359 - protein, 8 aa, Artificial Sequence
  Description of Artificial Sequence: Synthetic peptide
  XENP019374 vhCDR3
PYYYAMDY

SEQ ID NO: 17360 - protein, 214 aa, Artificial Sequence
  Description of Artificial Sequence: Synthetic polypeptide
  XENP019374 9E7_H1L2_IgG1_PVA_/S267K Light Chain
DIQMTQSPATLSVSPGERATLSCRASENIYSNLAWYQQKPGQSPRLLVYAATTLADGVPSRFSGSGSGTEYTLTISSLQSEDFAVYYCQHFWGTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17361 - protein, 107 aa, Artificial Sequence
  Description of Artificial Sequence: Synthetic polypeptide
  VL of XENP019374
DIQMTQSPATLSVSPGERATLSCRASENIYSNLAWYQQKPGQSPRLLVYAATTLADGVPSRFSGSGSGTEYTLTISSLQSEDFAVYYCQHFWGTPWTFGGGTKVEIK

SEQ ID NO: 17362 - protein, 11 aa, Artificial Sequence
  Description of Artificial Sequence: Synthetic peptide
  XENP019374 vlCDR1
RASENIYSNLA

SEQ ID NO: 17363 - protein, 7 aa, Artificial Sequence
  Description of Artificial Sequence: Synthetic peptide
  XENP019374 vlCDR2
AATTLAD

SEQ ID NO: 17364 - protein, 9 aa, Artificial Sequence
  Description of Artificial Sequence: Synthetic peptide
  XENP019374 vlCDR3
QHFWGTPWT

SEQ ID NO: 17365 - protein, 444 aa, Artificial Sequence
  Description of Artificial Sequence: Synthetic polypeptide
  XENP019375 9E7_H2L1_IgG1_PVA_/S267K Heavy Chain
QVTLKESGPVLVKPTETLTLTCTVSGFSLTRYGIHWVRQPPGKGLEWLAVIWSGVTDYNPSLKSRLTISKDNSKSQVVLTMTNMDPVDTATYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17366 - protein, 115 aa, Artificial Sequence
  Description of Artificial Sequence: Synthetic polypeptide
  VH of XENP019375
QVTLKESGPVLVKPTETLTLTCTVSGFSLTRYGIHWVRQPPGKGLEWLAVIWSGVTDYNPSLKSRLTISKDNSKSQVVLTMTNMDPVDTATYYCARPYYYAMDYWGQGTLVTVSS

SEQ ID NO: 17367 - protein, 5 aa, Artificial Sequence
  Description of Artificial Sequence: Synthetic peptide
  XENP019375 vhCDR1
RYGIH

SEQ ID NO: 17368 - protein, 15 aa, Artificial Sequence
  Description of Artificial Sequence: Synthetic peptide
  XENP019375 vhCDR2
VIWSGVTDYNPSLKS

SEQ ID NO: 17369 - protein, 8 aa, Artificial Sequence
  Description of Artificial Sequence: Synthetic peptide
  XENP019375 vhCDR3
PYYYAMDY

SEQ ID NO: 17370 - protein, 214 aa, Artificial Sequence; identical to SEQ ID NO: 17350
  Description of Artificial Sequence: Synthetic polypeptide
  XENP019375 9E7_H2L1_IgG1_PVA_/S267K Light Chain

SEQ ID NO: 17371 - protein, 107 aa, Artificial Sequence; identical to SEQ ID NO: 17351
  Description of Artificial Sequence: Synthetic polypeptide
  VL of XENP019375

SEQ ID NO: 17372 - protein, 11 aa, Artificial Sequence
  Description of Artificial Sequence: Synthetic peptide
  XENP019375 vlCDR1
RASENIYSNLA

SEQ ID NO: 17373 - protein, 7 aa, Artificial Sequence
  Description of Artificial Sequence: Synthetic peptide
  XENP019375 vlCDR2
AATTLAD

SEQ ID NO: 17374 - protein, 9 aa, Artificial Sequence
  Description of Artificial Sequence: Synthetic peptide
  XENP019375 vlCDR3
QHFWGTPWT

SEQ ID NO: 17375 - protein, 444 aa, Artificial Sequence; identical to SEQ ID NO: 17365
  Description of Artificial Sequence: Synthetic polypeptide
  XENP019376 9E7_H2L2_IgG1_PVA_/S267K Heavy Chain

SEQ ID NO: 17376 - protein, 115 aa, Artificial Sequence; identical to SEQ ID NO: 17366
  Description of Artificial Sequence: Synthetic polypeptide
  VH of XENP019376

SEQ ID NO: 17377 - protein, 5 aa, Artificial Sequence
  Description of Artificial Sequence: Synthetic peptide
  XENP019376 vhCDR1
RYGIH

SEQ ID NO: 17378 - protein, 15 aa, Artificial Sequence
  Description of Artificial Sequence: Synthetic peptide
  XENP019376 vhCDR2
VIWSGVTDYNPSLKS

SEQ ID NO: 17379 - protein, 8 aa, Artificial Sequence
  Description of Artificial Sequence: Synthetic peptide
  XENP019376 vhCDR3
PYYYAMDY

SEQ ID NO: 17380 - protein, 214 aa, Artificial Sequence; identical to SEQ ID NO: 17360
  Description of Artificial Sequence: Synthetic polypeptide
  XENP019376 9E7_H2L2_IgG1_PVA_/S267K Light Chain

SEQ ID NO: 17381 - protein, 107 aa, Artificial Sequence; identical to SEQ ID NO: 17361
  Description of Artificial Sequence: Synthetic polypeptide
  VL of XENP019376

SEQ ID NO: 17382 - protein, 11 aa, Artificial Sequence
  Description of Artificial Sequence: Synthetic peptide
  XENP019376 vlCDR1
RASENIYSNLA

SEQ ID NO: 17383 - protein, 7 aa, Artificial Sequence
  Description of Artificial Sequence: Synthetic peptide
  XENP019376 vlCDR2
AATTLAD

SEQ ID NO: 17384 - protein, 9 aa, Artificial Sequence
  Description of Artificial Sequence: Synthetic peptide
  XENP019376 vlCDR3
QHFWGTPWT

SEQ ID NO: 17385 - protein, 444 aa, Artificial Sequence
  Description of Artificial Sequence: Synthetic polypeptide
  XENP019377 9E7_H3L1_IgG1_PVA_/S267K Heavy Chain
EVQLVESGGGLVQPGGSLRLSCAVSGFSLTRYGIHWVRQAPGKGLEWVSVIWSGVTDYNPSVKGRFTISKDNSKSTVYLQMNSLRAEDTAVYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17386 - protein, 115 aa, Artificial Sequence
  Description of Artificial Sequence: Synthetic polypeptide
  VH of XENP019377
EVQLVESGGGLVQPGGSLRLSCAVSGFSLTRYGIHWVRQAPGKGLEWVSVIWSGVTDYNPSVKGRFTISKDNSKSTVYLQMNSLRAEDTAVYYCARPYYYAMDYWGQGTLVTVSS

SEQ ID NO: 17387 - protein, 5 aa, Artificial Sequence
  Description of Artificial Sequence: Synthetic peptide
  XENP019377 vhCDR1
RYGIH

SEQ ID NO: 17388 - protein, 15 aa, Artificial Sequence
  Description of Artificial Sequence: Synthetic peptide
  XENP019377 vhCDR2
VIWSGVTDYNPSVKG

SEQ ID NO: 17389 - protein, 8 aa, Artificial Sequence
  Description of Artificial Sequence: Synthetic peptide
  XENP019377 vhCDR3
PYYYAMDY

SEQ ID NO: 17390 - protein, 214 aa, Artificial Sequence; identical to SEQ ID NO: 17350
  Description of Artificial Sequence: Synthetic polypeptide
  XENP019377 9E7_H3L1_IgG1_PVA_/S267K Light Chain

SEQ ID NO: 17391 - protein, 107 aa, Artificial Sequence; identical to SEQ ID NO: 17351
  Description of Artificial Sequence: Synthetic polypeptide
  VL of XENP019377

SEQ ID NO: 17392 - protein, 11 aa, Artificial Sequence
  Description of Artificial Sequence: Synthetic peptide
  XENP019377 vlCDR1
RASENIYSNLA

SEQ ID NO: 17393 - protein, 7 aa, Artificial Sequence
  Description of Artificial Sequence: Synthetic peptide
  XENP019377 vlCDR2
AATTLAD

SEQ ID NO: 17394 - protein, 9 aa, Artificial Sequence
  Description of Artificial Sequence: Synthetic peptide
  XENP019377 vlCDR3
QHFWGTPWT

SEQ ID NO: 17395 - protein, 444 aa, Artificial Sequence; identical to SEQ ID NO: 17385
  Description of Artificial Sequence: Synthetic polypeptide
  XENP019378 9E7_H3L2_IgG1_PVA_/S267K Heavy Chain

SEQ ID NO: 17396 - protein, 115 aa, Artificial Sequence; identical to SEQ ID NO: 17386
  Description of Artificial Sequence: Synthetic polypeptide
  VH of XENP019378

SEQ ID NO: 17397 - protein, 5 aa, Artificial Sequence
  Description of Artificial Sequence: Synthetic peptide
  XENP019378 vhCDR1
RYGIH

SEQ ID NO: 17398 - protein, 15 aa, Artificial Sequence
  Description of Artificial Sequence: Synthetic peptide
  XENP019378 vhCDR2
VIWSGVTDYNPSVKG

SEQ ID NO: 17399 - protein, 8 aa, Artificial Sequence
  Description of Artificial Sequence: Synthetic peptide
  XENP019378 vhCDR3
PYYYAMDY

SEQ ID NO: 17400 - protein, 214 aa, Artificial Sequence; identical to SEQ ID NO: 17360
  Description of Artificial Sequence: Synthetic polypeptide
  XENP019378 9E7_H3L2_IgG1_PVA_/S267K Light Chain

SEQ ID NO: 17401 - protein, 107 aa, Artificial Sequence; identical to SEQ ID NO: 17361
  Description of Artificial Sequence: Synthetic polypeptide
  VL of XENP019378

SEQ ID NO: 17402 - protein, 11 aa, Artificial Sequence
  Description of Artificial Sequence: Synthetic peptide
  XENP019378 vlCDR1
RASENIYSNLA

SEQ ID NO: 17403 - protein, 7 aa, Artificial Sequence
  Description of Artificial Sequence: Synthetic peptide
  XENP019378 vlCDR2
AATTLAD

SEQ ID NO: 17404 - protein, 9 aa, Artificial Sequence
  Description of Artificial Sequence: Synthetic peptide
  XENP019378 vlCDR3
QHFWGTPWT

SEQ ID NO: 17405 - protein, 444 aa, Artificial Sequence
  Description of Artificial Sequence: Synthetic polypeptide
  XENP019379 9E7_H4L1_IgG1_PVA_/S267K Heavy Chain
EVQLVQSGAEVKKPGESLKISCKVSGFSLTRYGIHWVRQMPGKGLEWMGVIWSGVTDYNPSFQGQVTISKDNSISTVYLQWSSLKASDTAMYYCARPYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17406 - protein, 115 aa, Artificial Sequence
  Description of Artificial Sequence: Synthetic polypeptide
  VH of XENP019379
EVQLVQSGAEVKKPGESLKISCKVSGFSLTRYGIHWVRQMPGKGLEWMGVIWSGVTDYNPSFQGQVTISKDNSISTVYLQWSSLKASDTAMYYCARPYYYAMDYWGQGTLVTVSS

SEQ ID NO: 17407 - protein, 5 aa, Artificial Sequence
  Description of Artificial Sequence: Synthetic peptide
  XENP019379 vhCDR1
RYGIH

SEQ ID NO: 17408 - protein, 15 aa, Artificial Sequence
  Description of Artificial Sequence: Synthetic peptide
  XENP019379 vhCDR2
VIWSGVTDYNPSFQG

SEQ ID NO: 17409 - protein, 8 aa, Artificial Sequence
  Description of Artificial Sequence: Synthetic peptide
  XENP019379 vhCDR3
PYYYAMDY

SEQ ID NO: 17410 - protein, 214 aa, Artificial Sequence; identical to SEQ ID NO: 17350
  Description of Artificial Sequence: Synthetic polypeptide
  XENP019379 9E7_H4L1_IgG1_PVA_/S267K Light Chain

SEQ ID NO: 17411 - protein, 107 aa, Artificial Sequence; identical to SEQ ID NO: 17351
  Description of Artificial Sequence: Synthetic polypeptide
  VL of XENP019379

SEQ ID NO: 17412 - protein, 11 aa, Artificial Sequence
  Description of Artificial Sequence: Synthetic peptide
  XENP019379 vlCDR1
RASENIYSNLA

SEQ ID NO: 17413 - protein, 7 aa, Artificial Sequence
  Description of Artificial Sequence: Synthetic peptide
  XENP019379 vlCDR2
AATTLAD

SEQ ID NO: 17414 - protein, 9 aa, Artificial Sequence
  Description of Artificial Sequence: Synthetic peptide
  XENP019379 vlCDR3
QHFWGTPWT

SEQ ID NO: 17415 - protein, 444 aa, Artificial Sequence; identical to SEQ ID NO: 17405
  Description of Artificial Sequence: Synthetic polypeptide
  XENP019380 9E7_H4L2_IgG1_PVA_/S267K Heavy Chain

SEQ ID NO: 17416 - protein, 115 aa, Artificial Sequence; identical to SEQ ID NO: 17406
  Description of Artificial Sequence: Synthetic polypeptide
  VH of XENP019380

SEQ ID NO: 17417 - protein, 5 aa, Artificial Sequence
  Description of Artificial Sequence: Synthetic peptide
  XENP019380 vhCDR1
RYGIH

SEQ ID NO: 17418 - protein, 15 aa, Artificial Sequence
  Description of Artificial Sequence: Synthetic peptide
  XENP019380 vhCDR2
VIWSGVTDYNPSFQG

SEQ ID NO: 17419 - protein, 8 aa, Artificial Sequence
  Description of Artificial Sequence: Synthetic peptide
  XENP019380 vhCDR3
PYYYAMDY

SEQ ID NO: 17420 - protein, 214 aa, Artificial Sequence; identical to SEQ ID NO: 17360
  Description of Artificial Sequence: Synthetic polypeptide
  XENP019380 9E7_H4L2_IgG1_PVA_/S267K Light Chain

SEQ ID NO: 17421 - protein, 107 aa, Artificial Sequence; identical to SEQ ID NO: 17361
  Description of Artificial Sequence: Synthetic polypeptide
  VL of XENP019380

SEQ ID NO: 17422 - protein, 11 aa, Artificial Sequence
  Description of Artificial Sequence: Synthetic peptide
  XENP019380 vlCDR1
RASENIYSNLA

SEQ ID NO: 17423 - protein, 7 aa, Artificial Sequence
  Description of Artificial Sequence: Synthetic peptide
  XENP019380 vlCDR2
AATTLAD

SEQ ID NO: 17424 - protein, 9 aa, Artificial Sequence
  Description of Artificial Sequence: Synthetic peptide
  XENP019380 vlCDR3
QHFWGTPWT

SEQ ID NO: 17425 - protein, 447 aa, Artificial Sequence
  Description of Artificial Sequence: Synthetic polypeptide
  XENP019381 2A12_H1L1_IgG1_PVA_/S267K Heavy Chain
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARLEAIYGSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17426 - protein, 118 aa, Artificial Sequence
  Description of Artificial Sequence: Synthetic polypeptide
  VH of XENP019381
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARLEAIYGSDYWGQGTLVTVSS

SEQ ID NO: 17427 - protein, 5 aa, Artificial Sequence
  Description of Artificial Sequence: Synthetic peptide
  XENP019381 vhCDR1
NYGMN

SEQ ID NO: 17428 - protein, 17 aa, Artificial Sequence
  Description of Artificial Sequence: Synthetic peptide
  XENP019381 vhCDR2
WINTYTGEPTYADGFTG

SEQ ID NO: 17429 - protein, 9 aa, Artificial Sequence
  Description of Artificial Sequence: Synthetic peptide
  XENP019381 vhCDR3
LEAIYGSDY

SEQ ID NO: 17430 - protein, 214 aa, Artificial Sequence
  Description of Artificial Sequence: Synthetic polypeptide
  XENP019381 2A12_H1L1_IgG1_PVA_/S267K Light Chain
DIQMTQSPSSLSASVGDRVTITCRASQEISGYLSWLQQKPGKTIKRLIYAASTLDSGVPKRFSDSRSGSDYTLTISSLQPEDFATYYCLQYTSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17431 - protein, 107 aa, Artificial Sequence
  Description of Artificial Sequence: Synthetic polypeptide
  VL of XENP019381
DIQMTQSPSSLSASVGDRVTITCRASQEISGYLSWLQQKPGKTIKRLIYAASTLDSGVPKRFSDSRSGSDYTLTISSLQPEDFATYYCLQYTSYPFTFGSGTKLEIK

SEQ ID NO: 17432 - protein, 11 aa, Artificial Sequence
  Description of Artificial Sequence: Synthetic peptide
  XENP019381 vlCDR1
RASQEISGYLS

SEQ ID NO: 17433 - protein, 7 aa, Artificial Sequence
  Description of Artificial Sequence: Synthetic peptide
  XENP019381 vlCDR2
AASTLDS

SEQ ID NO: 17434 - protein, 9 aa, Artificial Sequence
  Description of Artificial Sequence: Synthetic peptide
  XENP019381 vlCDR3
LQYTSYPFT

SEQ ID NO: 17435 - protein, 449 aa, Artificial Sequence
  Description of Artificial Sequence: Synthetic polypeptide
  XENP019382 4C8_H1L1_IgG1_PVA_/S267K Heavy Chain
QVQLVQSGAEVKKPGASVKVSCKASGYTFTDYNMHWVRQAPGQSLEWMGYIYPYTGGTGYNQKFQGRVTMTVDNSISTAYMELSRLRSDDTAVYYCARSDDGYSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17436 - protein, 120 aa, Artificial Sequence
  Description of Artificial Sequence: Synthetic polypeptide
  VH of XENP019382
QVQLVQSGAEVKKPGASVKVSCKASGYTFTDYNMHWVRQAPGQSLEWMGYIYPYTGGTGYNQKFQGRVTMTVDNSISTAYMELSRLRSDDTAVYYCARSDDGYSYAMDYWGQGTLVTVSS

SEQ ID NO: 17437 - protein, 5 aa, Artificial Sequence
  Description of Artificial Sequence: Synthetic peptide
  XENP019382 vhCDR1
DYNMH

SEQ ID NO: 17438 - protein, 17 aa, Artificial Sequence
  Description of Artificial Sequence: Synthetic peptide
  XENP019382 vhCDR2
YIYPYTGGTGYNQKFQG

SEQ ID NO: 17439 - protein, 11 aa, Artificial Sequence
  Description of Artificial Sequence: Synthetic peptide
  XENP019382 vhCDR3
SDDGYSYAMDY

SEQ ID NO: 17440 - protein, 213 aa, Artificial Sequence
  Description of Artificial Sequence: Synthetic polypeptide
  XENP019382 4C8_H1L1_IgG1_PVA_/S267K Light Chain
DIQMTQSPSSLSASVGDRVTITCQASQDISNYLNWYQQKPGKTVKLLIYYTSRLHSGVPSRFSGSGSGTDYTFTISSLQPEDIATYFCQQGNTLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17441 - protein, 106 aa, Artificial Sequence
  Description of Artificial Sequence: Synthetic polypeptide
  VL of XENP019382
DIQMTQSPSSLSASVGDRVTITCQASQDISNYLNWYQQKPGKTVKLLIYYTSRLHSGVPSRFSGSGSGTDYTFTISSLQPEDIATYFCQQGNTLWTFGGGTKVEIK

SEQ ID NO: 17442 - protein, 11 aa, Artificial Sequence
  Description of Artificial Sequence: Synthetic peptide
  XENP019382 vlCDR1
QASQDISNYLN

SEQ ID NO: 17443 - protein, 7 aa, Artificial Sequence
  Description of Artificial Sequence: Synthetic peptide
  XENP019382 vlCDR2
YTSRLHS

SEQ ID NO: 17444 - protein, 8 aa, Artificial Sequence
  Description of Artificial Sequence: Synthetic peptide
  XENP019382 vlCDR3
QQGNTLWT

SEQ ID NO: 17445 - protein, 445 aa, Artificial Sequence
  Description of Artificial Sequence: Synthetic polypeptide
  XENP019383 7A6_H0L0_IgG1_PVA_/S267K Heavy Chain
DVQLQESGPGLVKPSQSLSLTCSVTGYSITSGYFWNWIRQFPGNKLEWMGYISYDSNYYNPSLKNRISITRDTSKNQFFLKLNSVTTEDTATYYCARGGITTFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17446 - protein, 116 aa, Artificial Sequence
  Description of Artificial Sequence: Synthetic polypeptide
  VH of XENP019383
DVQLQESGPGLVKPSQSLSLTCSVTGYSITSGYFWNWIRQFPGNKLEWMGYISYDSNYYNPSLKNRISITRDTSKNQFFLKLNSVTTEDTATYYCARGGITTFDYWGQGTTLTVSS

SEQ ID NO: 17447 - protein, 6 aa, Artificial Sequence
  Description of Artificial Sequence: Synthetic peptide
  XENP019383 vhCDR1
SGYFWN

SEQ ID NO: 17448 - protein, 15 aa, Artificial Sequence
  Description of Artificial Sequence: Synthetic peptide
  XENP019383 vhCDR2
YISYDSNYYNPSLKN

SEQ ID NO: 17449 - protein, 8 aa, Artificial Sequence
  Description of Artificial Sequence: Synthetic peptide
  XENP019383 vhCDR3
GGITTFDY

SEQ ID NO: 17450 - protein, 218 aa, Artificial Sequence
  Description of Artificial Sequence: Synthetic polypeptide
  XENP019383 7A6_H0L0_IgG1_PVA_/S267K Light Chain
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17451 - protein, 111 aa, Artificial Sequence
  Description of Artificial Sequence: Synthetic polypeptide
  VL of XENP019383
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPRTFGGGTKLEIK

SEQ ID NO: 17452 - protein, 15 aa, Artificial Sequence
  Description of Artificial Sequence: Synthetic peptide
  XENP019383 vlCDR1
KASQSVDYDGDSYMN

SEQ ID NO: 17453 - protein, 7 aa, Artificial Sequence
  Description of Artificial Sequence: Synthetic peptide
  XENP019383 vlCDR2
AASNLES

SEQ ID NO: 17454 - protein, 9 aa, Artificial Sequence
  Description of Artificial Sequence: Synthetic peptide
  XENP019383 vlCDR3
QQSNEDPRT

SEQ ID NO: 17455 - protein, 445 aa, Artificial Sequence
  Description of Artificial Sequence: Synthetic polypeptide
  XENP019384 7A6_H1L1_IgG1_PVA_/S267K Heavy Chain
QVQLVESGGGVVQPGRSLRLSCAVSGYSITSGYFWNWIRQAPGKKLEWVAYISYDSNYYNPSVKGRFTISRDTSKNTFYLQMNSLRAEDTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17456 - protein, 116 aa, Artificial Sequence
  Description of Artificial Sequence: Synthetic polypeptide
  VH of XENP019384
QVQLVESGGGVVQPGRSLRLSCAVSGYSITSGYFWNWIRQAPGKKLEWVAYISYDSNYYNPSVKGRFTISRDTSKNTFYLQMNSLRAEDTAVYYCARGGITTFDYWGQGTLVTVSS

SEQ ID NO: 17457 - protein, 6 aa, Artificial Sequence
  Description of Artificial Sequence: Synthetic peptide
  XENP019384 vhCDR1
SGYFWN

SEQ ID NO: 17458 - protein, 15 aa, Artificial Sequence
  Description of Artificial Sequence: Synthetic peptide
  XENP019384 vhCDR2
YISYDSNYYNPSVKG

SEQ ID NO: 17459 - protein, 8 aa, Artificial Sequence
  Description of Artificial Sequence: Synthetic peptide
  XENP019384 vhCDR3
GGITTFDY

SEQ ID NO: 17460 - protein, 218 aa, Artificial Sequence
  Description of Artificial Sequence: Synthetic polypeptide
  XENP019384 7A6_H1L1_IgG1_PVA_/S267K Light Chain
DIVLTQSPSSLSASVGDRVTITCRASQSVDYDGDSYMNWYQQKPGKPPKLLIYAASNLESGIPARFSGSGSGTDFTLTISSLQPEDFATYYCQQSNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17461 - protein, 111 aa, Artificial Sequence
  Description of Artificial Sequence: Synthetic polypeptide
  VL of XENP019384
DIVLTQSPSSLSASVGDRVTITCRASQSVDYDGDSYMNWYQQKPGKPPKLLIYAASNLESGIPARFSGSGSGTDFTLTISSLQPEDFATYYCQQSNEDPRTFGGGTKVEIK

SEQ ID NO: 17462 - protein, 15 aa, Artificial Sequence
  Description of Artificial Sequence: Synthetic peptide
  XENP019384 vlCDR1
RASQSVDYDGDSYMN

SEQ ID NO: 17463 - protein, 7 aa, Artificial Sequence
  Description of Artificial Sequence: Synthetic peptide
  XENP019384 vlCDR2
AASNLES

SEQ ID NO: 17464 - protein, 9 aa, Artificial Sequence
  Description of Artificial Sequence: Synthetic peptide
  XENP019384 vlCDR3
QQSNEDPRT

SEQ ID NO: 17465 - protein, 445 aa, Artificial Sequence; identical to SEQ ID NO: 17455
  Description of Artificial Sequence: Synthetic polypeptide
  XENP019385 7A6_H1L2_IgG1_PVA_/S267K Heavy Chain

SEQ ID NO: 17466 - protein, 116 aa, Artificial Sequence; identical to SEQ ID NO: 17456
  Description of Artificial Sequence: Synthetic polypeptide
  VH of XENP019385

SEQ ID NO: 17467 - protein, 6 aa, Artificial Sequence
  Description of Artificial Sequence: Synthetic peptide
  XENP019385 vhCDR1
SGYFWN

SEQ ID NO: 17468 - protein, 15 aa, Artificial Sequence
  Description of Artificial Sequence: Synthetic peptide
  XENP019385 vhCDR2
YISYDSNYYNPSVKG

SEQ ID NO: 17469 - protein, 8 aa, Artificial Sequence
  Description of Artificial Sequence: Synthetic peptide
  XENP019385 vhCDR3
GGITTFDY

SEQ ID NO: 17470 - protein, 218 aa, Artificial Sequence; identical to SEQ ID NO: 17320
  Description of Artificial Sequence: Synthetic polypeptide
  XENP019385 7A6_H1L2_IgG1_PVA_/S267K Light Chain

SEQ ID NO: 17471 - protein, 111 aa, Artificial Sequence; identical to SEQ ID NO: 17321
  Description of Artificial Sequence: Synthetic polypeptide
  VL of XENP019385

SEQ ID NO: 17472 - protein, 15 aa, Artificial Sequence
  Description of Artificial Sequence: Synthetic peptide
  XENP019385 vlCDR1
RASQSVDYDGDSYMN

SEQ ID NO: 17473 - protein, 7 aa, Artificial Sequence
  Description of Artificial Sequence: Synthetic peptide
  XENP019385 vlCDR2
AASNLES

SEQ ID NO: 17474 - protein, 9 aa, Artificial Sequence
  Description of Artificial Sequence: Synthetic peptide
  XENP019385 vlCDR3
QQSNEDPRT

SEQ ID NO: 17475 - protein, 445 aa, Artificial Sequence; identical to SEQ ID NO: 17455
  Description of Artificial Sequence: Synthetic polypeptide
  XENP019386 7A6_H1L3_IgG1_PVA_/S267K Heavy Chain

SEQ ID NO: 17476 - protein, 116 aa, Artificial Sequence; identical to SEQ ID NO: 17456
  Description of Artificial Sequence: Synthetic polypeptide
  VH of XENP019386

SEQ ID NO: 17477 - protein, 6 aa, Artificial Sequence
  Description of Artificial Sequence: Synthetic peptide
  XENP019386 vhCDR1
SGYFWN

SEQ ID NO: 17478 - protein, 15 aa, Artificial Sequence
  Description of Artificial Sequence: Synthetic peptide
  XENP019386 vhCDR2
YISYDSNYYNPSVKG

SEQ ID NO: 17479 - protein, 8 aa, Artificial Sequence
  Description of Artificial Sequence: Synthetic peptide
  XENP019386 vhCDR3
GGITTFDY

SEQ ID NO: 17480 - protein, 218 aa, Artificial Sequence
  Description of Artificial Sequence: Synthetic polypeptide
  XENP019386 7A6_H1L3_IgG1_PVA_/S267K Light Chain
DIVLTQSPDSLAVSLGERATINCKASQSVDYDGDSYMNWYQQKPGQPPKLLIYAASNLESGIPARFSGSGSGTDFTLTISSLQAEDVAVYYCQQSNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17481 - protein, 111 aa, Artificial Sequence
  Description of Artificial Sequence: Synthetic polypeptide
  VL of XENP019386
DIVLTQSPDSLAVSLGERATINCKASQSVDYDGDSYMNWYQQKPGQPPKLLIYAASNLESGIPARFSGSGSGTDFTLTISSLQAEDVAVYYCQQSNEDPRTFGGGTKVEIK

SEQ ID NO: 17482 - protein, 15 aa, Artificial Sequence
  Description of Artificial Sequence: Synthetic peptide
  XENP019386 vlCDR1
KASQSVDYDGDSYMN

SEQ ID NO: 17483 - protein, 7 aa, Artificial Sequence
  Description of Artificial Sequence: Synthetic peptide
  XENP019386 vlCDR2
AASNLES

SEQ ID NO: 17484 - protein, 9 aa, Artificial Sequence
  Description of Artificial Sequence: Synthetic peptide
  XENP019386 vlCDR3
QQSNEDPRT

SEQ ID NO: 17485 - protein, 445 aa, Artificial Sequence
  Description of Artificial Sequence: Synthetic polypeptide
  XENP019387 7A6_H2L1_IgG1_PVA_/S267K Heavy Chain
QVQLQESGPGLVKPSQTLSLTCTVSGYSITSGYFWNWIRQHPGKKLEWIGYISYDSNYYNPSLKSLVTISRDTSKNQFSLKLSSVTAADTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17486 - protein, 116 aa, Artificial Sequence
  Description of Artificial Sequence: Synthetic polypeptide
  VH of XENP019387
QVQLQESGPGLVKPSQTLSLTCTVSGYSITSGYFWNWIRQHPGKKLEWIGYISYDSNYYNPSLKSLVTISRDTSKNQFSLKLSSVTAADTAVYYCARGGITTFDYWGQGTLVTVSS

SEQ ID NO: 17487 - protein, 6 aa, Artificial Sequence
  Description of Artificial Sequence: Synthetic peptide
  XENP019387 vhCDR1
SGYFWN

SEQ ID NO: 17488 - protein, 15 aa, Artificial Sequence
  Description of Artificial Sequence: Synthetic peptide
  XENP019387 vhCDR2
YISYDSNYYNPSLKS

SEQ ID NO: 17489 - protein, 8 aa, Artificial Sequence
  Description of Artificial Sequence: Synthetic peptide
  XENP019387 vhCDR3
GGITTFDY

SEQ ID NO: 17490 - protein, 218 aa, Artificial Sequence; identical to SEQ ID NO: 17460
  Description of Artificial Sequence: Synthetic polypeptide
  XENP019387 7A6_H2L1_IgG1_PVA_/S267K Light Chain

SEQ ID NO: 17491 - protein, 111 aa, Artificial Sequence; identical to SEQ ID NO: 17461
  Description of Artificial Sequence: Synthetic polypeptide
  VL of XENP019387

SEQ ID NO: 17492 - protein, 15 aa, Artificial Sequence
  Description of Artificial Sequence: Synthetic peptide
  XENP019387 vlCDR1
RASQSVDYDGDSYMN

SEQ ID NO: 17493 - protein, 7 aa, Artificial Sequence
  Description of Artificial Sequence: Synthetic peptide
  XENP019387 vlCDR2
AASNLES

SEQ ID NO: 17494 - protein, 9 aa, Artificial Sequence
  Description of Artificial Sequence: Synthetic peptide
  XENP019387 vlCDR3
QQSNEDPRT

SEQ ID NO: 17495 - protein, 445 aa, Artificial Sequence; identical to SEQ ID NO: 17485
  Description of Artificial Sequence: Synthetic polypeptide
  XENP019388 7A6_H2L2_IgG1_PVA_/S267K Heavy Chain

SEQ ID NO: 17496 - protein, 116 aa, Artificial Sequence; identical to SEQ ID NO: 17486
  Description of Artificial Sequence: Synthetic polypeptide
  VH of XENP019388

SEQ ID NO: 17497 - protein, 6 aa, Artificial Sequence
  Description of Artificial Sequence: Synthetic peptide
  XENP019388 vhCDR1
SGYFWN

SEQ ID NO: 17498 - protein, 15 aa, Artificial Sequence
  Description of Artificial Sequence: Synthetic peptide
  XENP019388 vhCDR2
YISYDSNYYNPSLKS

SEQ ID NO: 17499 - protein, 8 aa, Artificial Sequence
  Description of Artificial Sequence: Synthetic peptide
  XENP019388 vhCDR3
GGITTFDY

SEQ ID NO: 17500 - protein, 218 aa, Artificial Sequence; identical to SEQ ID NO: 17320
  Description of Artificial Sequence: Synthetic polypeptide
  XENP019388 7A6_H2L2_IgG1_PVA_/S267K Light Chain

SEQ ID NO: 17501 - protein, 111 aa, Artificial Sequence; identical to SEQ ID NO: 17321
  Description of Artificial Sequence: Synthetic polypeptide
  VL of XENP019388

SEQ ID NO: 17502 - protein, 15 aa, Artificial Sequence
  Description of Artificial Sequence: Synthetic peptide
  XENP019388 vlCDR1
RASQSVDYDGDSYMN

SEQ ID NO: 17503 - protein, 7 aa, Artificial Sequence
  Description of Artificial Sequence: Synthetic peptide
  XENP019388 vlCDR2
AASNLES

SEQ ID NO: 17504 - protein, 9 aa, Artificial Sequence
  Description of Artificial Sequence: Synthetic peptide
  XENP019388 vlCDR3
QQSNEDPRT

SEQ ID NO: 17505 - protein, 445 aa, Artificial Sequence; identical to SEQ ID NO: 17485
  Description of Artificial Sequence: Synthetic polypeptide
  XENP019389 7A6_H2L3_IgG1_PVA_/S267K Heavy Chain

SEQ ID NO: 17506 - protein, 116 aa, Artificial Sequence; identical to SEQ ID NO: 17486
  Description of Artificial Sequence: Synthetic polypeptide
  VH of XENP019389

SEQ ID NO: 17507 - protein, 6 aa, Artificial Sequence
  Description of Artificial Sequence: Synthetic peptide
  XENP019389 vhCDR1
SGYFWN

SEQ ID NO: 17508 - protein, 15 aa, Artificial Sequence
  Description of Artificial Sequence: Synthetic peptide
  XENP019389 vhCDR2
YISYDSNYYNPSLKS

SEQ ID NO: 17509 - protein, 8 aa, Artificial Sequence
  Description of Artificial Sequence: Synthetic peptide
  XENP019389 vhCDR3
GGITTFDY

SEQ ID NO: 17510 - protein, 218 aa, Artificial Sequence; identical to SEQ ID NO: 17480
  Description of Artificial Sequence: Synthetic polypeptide
  XENP019389 7A6_H2L3_IgG1_PVA_/S267K Light Chain

SEQ ID NO: 17511 - protein, 111 aa, Artificial Sequence; identical to SEQ ID NO: 17481
  Description of Artificial Sequence: Synthetic polypeptide
  VL of XENP019389

SEQ ID NO: 17512 - protein, 15 aa, Artificial Sequence
  Description of Artificial Sequence: Synthetic peptide
  XENP019389 vlCDR1
KASQSVDYDGDSYMN

SEQ ID NO: 17513 - protein, 7 aa, Artificial Sequence
  Description of Artificial Sequence: Synthetic peptide
  XENP019389 vlCDR2
AASNLES

SEQ ID NO: 17514 - protein, 9 aa, Artificial Sequence
  Description of Artificial Sequence: Synthetic peptide
  XENP019389 vlCDR3
QQSNEDPRT

SEQ ID NO: 17515 - protein, 445 aa, Artificial Sequence
  Description of Artificial Sequence: Synthetic polypeptide
  XENP019390 7A6_H3L1_IgG1_PVA_/S267K Heavy Chain
QVQLQQSGPGLVKPSQTLSLTCAVSGYSITSGYFWNWIRQSPSRKLEWLGYISYDSNYYNPSVKSRITINRDTSKNQFSLQLNSVTPEDTAVYYCARGGITTFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17516 - protein, 116 aa, Artificial Sequence
  Description of Artificial Sequence: Synthetic polypeptide
  VH of XENP019390
QVQLQQSGPGLVKPSQTLSLTCAVSGYSITSGYFWNWIRQSPSRKLEWLGYISYDSNYYNPSVKSRITINRDTSKNQFSLQLNSVTPEDTAVYYCARGGITTFDYWGQGTLVTVSS

SEQ ID NO: 17517 - protein, 6 aa, Artificial Sequence
  Description of Artificial Sequence: Synthetic peptide
  XENP019390 vhCDR1
SGYFWN

SEQ ID NO: 17518 - protein, 15 aa, Artificial Sequence
  Description of Artificial Sequence: Synthetic peptide
  XENP019390 vhCDR2
YISYDSNYYNPSVKS

SEQ ID NO: 17519 - protein, 8 aa, Artificial Sequence
  Description of Artificial Sequence: Synthetic peptide
  XENP019390 vhCDR3
GGITTFDY

SEQ ID NO: 17520 - protein, 218 aa, Artificial Sequence; identical to SEQ ID NO: 17460
  Description of Artificial Sequence: Synthetic polypeptide
  XENP019390 7A6_H3L1_IgG1_PVA_/S267K Light Chain

SEQ ID NO: 17521 - protein, 111 aa, Artificial Sequence; identical to SEQ ID NO: 17461
  Description of Artificial Sequence: Synthetic polypeptide
  VL of XENP019390

SEQ ID NO: 17522 - protein, 15 aa, Artificial Sequence
  Description of Artificial Sequence: Synthetic peptide
  XENP019390 vlCDR1
RASQSVDYDGDSYMN

SEQ ID NO: 17523 - protein, 7 aa, Artificial Sequence
  Description of Artificial Sequence: Synthetic peptide
  XENP019390 vlCDR2
AASNLES

SEQ ID NO: 17524 - protein, 9 aa, Artificial Sequence
  Description of Artificial Sequence: Synthetic peptide
  XENP019390 vlCDR3
QQSNEDPRT

SEQ ID NO: 17525 - protein, 445 aa, Artificial Sequence; identical to SEQ ID NO: 17515
  Description of Artificial Sequence: Synthetic polypeptide
  XENP019391 7A6_H3L2_IgG1_PVA_/S267K Heavy Chain

SEQ ID NO: 17526 - protein, 116 aa, Artificial Sequence; identical to SEQ ID NO: 17516
  Description of Artificial Sequence: Synthetic polypeptide
  VH of XENP019391

SEQ ID NO: 17527 - protein, 6 aa, Artificial Sequence
  Description of Artificial Sequence: Synthetic peptide
  XENP019391 vhCDR1
SGYFWN

SEQ ID NO: 17528 - protein, 15 aa, Artificial Sequence
  Description of Artificial Sequence: Synthetic peptide
  XENP019391 vhCDR2
YISYDSNYYNPSVKS

SEQ ID NO: 17529 - protein, 8 aa, Artificial Sequence
  Description of Artificial Sequence: Synthetic peptide
  XENP019391 vhCDR3
GGITTFDY

SEQ ID NO: 17530 - protein, 218 aa, Artificial Sequence; identical to SEQ ID NO: 17320
  Description of Artificial Sequence: Synthetic polypeptide
  XENP019391 7A6_H3L2_IgG1_PVA_/S267K Light Chain

SEQ ID NO: 17531 - protein, 111 aa, Artificial Sequence; identical to SEQ ID NO: 17321
  Description of Artificial Sequence: Synthetic polypeptide
  VL of XENP019391

SEQ ID NO: 17532 - protein, 15 aa, Artificial Sequence
  Description of Artificial Sequence: Synthetic peptide
  XENP019391 vlCDR1
RASQSVDYDGDSYMN

SEQ ID NO: 17533 - protein, 7 aa, Artificial Sequence
  Description of Artificial Sequence: Synthetic peptide
  XENP019391 vlCDR2
AASNLES

SEQ ID NO: 17534 - protein, 9 aa, Artificial Sequence
  Description of Artificial Sequence: Synthetic peptide
  XENP019391 vlCDR3
QQSNEDPRT

SEQ ID NO: 17535 - protein, 445 aa, Artificial Sequence; identical to SEQ ID NO: 17515
  Description of Artificial Sequence: Synthetic polypeptide
  XENP019392 7A6_H3L3_IgG1_PVA_/S267K Heavy Chain

SEQ ID NO: 17536 - protein, 116 aa, Artificial Sequence; identical to SEQ ID NO: 17516
  Description of Artificial Sequence: Synthetic polypeptide
  VH of XENP019392

SEQ ID NO: 17537 - protein, 6 aa, Artificial Sequence
  Description of Artificial Sequence: Synthetic peptide
  XENP019392 vhCDR1
SGYFWN

SEQ ID NO: 17538 - protein, 15 aa, Artificial Sequence
  Description of Artificial Sequence: Synthetic peptide
  XENP019392 vhCDR2
YISYDSNYYNPSVKS

SEQ ID NO: 17539 - protein, 8 aa, Artificial Sequence
  Description of Artificial Sequence: Synthetic peptide
  XENP019392 vhCDR3
GGITTFDY

SEQ ID NO: 17540 - protein, 218 aa, Artificial Sequence; identical to SEQ ID NO: 17480
  Description of Artificial Sequence: Synthetic polypeptide
  XENP019392 7A6_H3L3_IgG1_PVA_/S267K Light Chain

SEQ ID NO: 17541 - protein, 111 aa, Artificial Sequence; identical to SEQ ID NO: 17481
  Description of Artificial Sequence: Synthetic polypeptide
  VL of XENP019392

SEQ ID NO: 17542 - protein, 15 aa, Artificial Sequence
  Description of Artificial Sequence: Synthetic peptide
  XENP019392 vlCDR1
KASQSVDYDGDSYMN

SEQ ID NO: 17543 - protein, 7 aa, Artificial Sequence
  Description of Artificial Sequence: Synthetic peptide
  XENP019392 vlCDR2
AASNLES

SEQ ID NO: 17544 - protein, 9 aa, Artificial Sequence
  Description of Artificial Sequence: Synthetic peptide
  XENP019392 vlCDR3
QQSNEDPRT

SEQ ID NO: 17545 - protein, 447 aa, Artificial Sequence
  Description of Artificial Sequence: Synthetic polypeptide
  XENP019393 11B2_H1_1H11_L1_IgG1_PVA_/S267K Heavy Chain
QIQLVQSGSELKKPGASVKVSCKTSGYTFTNYGMNWVRQAPGQGLEWMGWINTYTGEPTYADGFTGRFVFSLDTSVSTAYLQISSLKAEDTAVYFCARGRGMGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17546 - protein, 118 aa, Artificial Sequence
  Description of Artificial Sequence: Synthetic polypeptide
  VH of XENP019393
QIQLVQSGSELKKPGASVKVSCKTSGYTFTNYGMNWVRQAPGQGLEWMGWINTYTGEPTYADGFTGRFVFSLDTSVSTAYLQISSLKAEDTAVYFCARGRGMGYFDYWGQGTLVTVSS

SEQ ID NO: 17547 - protein, 5 aa, Artificial Sequence
  Description of Artificial Sequence: Synthetic peptide
  XENP019393 vhCDR1
NYGMN

SEQ ID NO: 17548 - protein, 17 aa, Artificial Sequence
  Description of Artificial Sequence: Synthetic peptide
  XENP019393 vhCDR2
WINTYTGEPTYADGFTG

SEQ ID NO: 17549 - protein, 9 aa, Artificial Sequence
  Description of Artificial Sequence: Synthetic peptide
  XENP019393 vhCDR3
GRGMGYFDY

SEQ ID NO: 17550 - protein, 214 aa, Artificial Sequence; identical to SEQ ID NO: 17160
  Description of Artificial Sequence: Synthetic polypeptide
  XENP019393 11B2_H1_1H11_L1_IgG1_PVA_/S267K Light Chain

SEQ ID NO: 17551 - protein, 107 aa, Artificial Sequence; identical to SEQ ID NO: 17161
  Description of Artificial Sequence: Synthetic polypeptide
  VL of XENP019393

SEQ ID NO: 17552 - protein, 11 aa, Artificial Sequence
  Description of Artificial Sequence: Synthetic peptide
  XENP019393 vlCDR1
RASENIYSNLA

SEQ ID NO: 17553 - protein, 7 aa, Artificial Sequence
  Description of Artificial Sequence: Synthetic peptide
  XENP019393 vlCDR2
AATNLAD

SEQ ID NO: 17554 - protein, 9 aa, Artificial Sequence
  Description of Artificial Sequence: Synthetic peptide
  XENP019393 vlCDR3
QHFWTTPRT

SEQ ID NO: 17555 - protein, 447 aa, Artificial Sequence
  Description of Artificial Sequence: Synthetic polypeptide
  XENP019394 2D4_H1L1_IgG1_PVA_/S267K Heavy Chain
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGTGYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17556 - protein, 118 aa, Artificial Sequence
  Description of Artificial Sequence: Synthetic polypeptide
  VH of XENP019394
QIQLVQSGSELKKPGASVKVSCKASGYTFTNYGMNWVRQAPGQGLEWMGWINTYTGEPTYADGFTGRFVFSLDTSVSTAYLQISSLKAEDTAVYFCARGRGTGYFDNWGQGTLVTVSS

SEQ ID NO: 17557 - protein, 5 aa, Artificial Sequence
  Description of Artificial Sequence: Synthetic peptide
  XENP019394 vhCDR1
NYGMN

SEQ ID NO: 17558 - protein, 17 aa, Artificial Sequence
  Description of Artificial Sequence: Synthetic peptide
  XENP019394 vhCDR2
WINTYTGEPTYADGFTG

SEQ ID NO: 17559 - protein, 9 aa, Artificial Sequence
  Description of Artificial Sequence: Synthetic peptide
  XENP019394 vhCDR3
GRGTGYFDN

SEQ ID NO: 17560 - protein, 214 aa, Artificial Sequence
  Description of Artificial Sequence: Synthetic polypeptide
  XENP019394 2D4_H1L1_IgG1_PVA_/S267K Light Chain
DIQMTQSPSSLSASVGDRVTITCRASENIYSNLAWYQQKPGKSPKLLVYAATNLADGVPSRFSGSGSGTDYTLTISSLQPEDFATYYCQHFWVTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17561 - protein, 107 aa, Artificial Sequence
  Description of Artificial Sequence: Synthetic polypeptide
  VL of XENP019394
DIQMTQSPSSLSASVGDRVTITCRASENIYSNLAWYQQKPGKSPKLLVYAATNLADGVPSRFSGSGSGTDYTLTISSLQPEDFATYYCQHFWVTPRTFGGGTKVEIK

SEQ ID NO: 17562 - protein, 11 aa, Artificial Sequence
  Description of Artificial Sequence: Synthetic peptide
  XENP019394 vlCDR1
RASENIYSNLA

SEQ ID NO: 17563 - protein, 7 aa, Artificial Sequence
  Description of Artificial Sequence: Synthetic peptide
  XENP019394 vlCDR2
AATNLAD

SEQ ID NO: 17564 - protein, 9 aa, Artificial Sequence
  Description of Artificial Sequence: Synthetic peptide
  XENP019394 vlCDR3
QHFWVTPRT

SEQ ID NO: 17565 - protein, 447 aa, Artificial Sequence
  Description of Artificial Sequence: Synthetic polypeptide
  XENP019395 4H9_H1L1_IgG1_PVA_/S267K Heavy Chain
QIQLVQSGSELKKPGASVKVSCKASEYAFINYGMNWVRQAPGQGLEWMGWINTYTGEPTYADGFTGRFVFSLDTSVSTAYLQISSLKAEDTAVYFCARGRGTGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17566 - protein, 118 aa, Artificial Sequence
  Description of Artificial Sequence: Synthetic polypeptide
  VH of XENP019395
QIQLVQSGSELKKPGASVKVSCKASEYAFINYGMNWVRQAPGQGLEWMGWINTYTGEPTYADGFTGRFVFSLDTSVSTAYLQISSLKAEDTAVYFCARGRGTGYFDYWGQGTLVTVSS

SEQ ID NO: 17567 - protein, 5 aa, Artificial Sequence
  Description of Artificial Sequence: Synthetic peptide
  XENP019395 vhCDR1
NYGMN

SEQ ID NO: 17568 - protein, 17 aa, Artificial Sequence
  Description of Artificial Sequence: Synthetic peptide
  XENP019395 vhCDR2
WINTYTGEPTYADGFTG

SEQ ID NO: 17569 - protein, 9 aa, Artificial Sequence
  Description of Artificial Sequence: Synthetic peptide
  XENP019395 vhCDR3
GRGTGYFDY

SEQ ID NO: 17570 - protein, 214 aa, Artificial Sequence
  Description of Artificial Sequence: Synthetic polypeptide
  XENP019395 4H9_H1L1_IgG1_PVA_/S267K Light Chain
DIVMTQSPSSLSASVGDRVTITCRASQDVSTAVAWYQQKPGKSPKLLIYSASYRYTGVPDRFSGSGSGTDFTLTISSLQPEDFATYSCQQHYSTSRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17571 - protein, 107 aa, Artificial Sequence
  Description of Artificial Sequence: Synthetic polypeptide
  VL of XENP019395
DIVMTQSPSSLSASVGDRVTITCRASQDVSTAVAWYQQKPGKSPKLLIYSASYRYTGVPDRFSGSGSGTDFTLTISSLQPEDFATYSCQQHYSTSRTFGGGTKVEIK

SEQ ID NO: 17572 - protein, 11 aa, Artificial Sequence
  Description of Artificial Sequence: Synthetic peptide
  XENP019395 vlCDR1
RASQDVSTAVA

SEQ ID NO: 17573 - protein, 7 aa, Artificial Sequence
  Description of Artificial Sequence: Synthetic peptide
  XENP019395 vlCDR2
SASYRYT

SEQ ID NO: 17574 - protein, 9 aa, Artificial Sequence
  Description of Artificial Sequence: Synthetic peptide
  XENP019395 vlCDR3
QQHYSTSRT

SEQ ID NO: 17575 - protein, 447 aa, Artificial Sequence; identical to SEQ ID NO: 17565
  Description of Artificial Sequence: Synthetic polypeptide
  XENP019396 4H9_H1L2_IgG1_PVA_/S267K Heavy Chain

SEQ ID NO: 17576 - protein, 118 aa, Artificial Sequence; identical to SEQ ID NO: 17566
  Description of Artificial Sequence: Synthetic polypeptide
  VH of XENP019396

SEQ ID NO: 17577 - protein, 5 aa, Artificial Sequence
  Description of Artificial Sequence: Synthetic peptide
  XENP019396 vhCDR1
NYGMN

SEQ ID NO: 17578 - protein, 17 aa, Artificial Sequence
  Description of Artificial Sequence: Synthetic peptide
  XENP019396 vhCDR2
WINTYTGEPTYADGFTG

SEQ ID NO: 17579 - protein, 9 aa, Artificial Sequence
  Description of Artificial Sequence: Synthetic peptide
  XENP019396 vhCDR3
GRGTGYFDY

SEQ ID NO: 17580 - protein, 214 aa, Artificial Sequence
  Description of Artificial Sequence: Synthetic polypeptide
  XENP019396 4H9_H1L2_IgG1_PVA_/S267K Light Chain
DIVMTQSPDSLAVSLGERATINCKASQDVSTAVAWYQQKPGQSPKLLIYSASYRYTGVPDRFSGSGSGTDFTLTISSLQAEDVAVYSCQQHYSTSRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17581 - protein, 107 aa, Artificial Sequence
  Description of Artificial Sequence: Synthetic polypeptide
  VL of XENP019396
DIVMTQSPDSLAVSLGERATINCKASQDVSTAVAWYQQKPGQSPKLLIYSASYRYTGVPDRFSGSGSGTDFTLTISSLQAEDVAVYSCQQHYSTSRTFGGGTKVEIK

SEQ ID NO: 17582 - protein, 11 aa, Artificial Sequence
  Description of Artificial Sequence: Synthetic peptide
  XENP019396 vlCDR1
KASQDVSTAVA

SEQ ID NO: 17583 - protein, 7 aa, Artificial Sequence
  Description of Artificial Sequence: Synthetic peptide
  XENP019396 vlCDR2
SASYRYT

SEQ ID NO: 17584 - protein, 9 aa, Artificial Sequence
  Description of Artificial Sequence: Synthetic peptide
  XENP019396 vlCDR3
QQHYSTSRT

SEQ ID NO: 17585 - protein, 450 aa, Artificial Sequence
  Description of Artificial Sequence: Synthetic polypeptide
  XENP019401 7G8_H0L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17586 - protein, 121 aa, Artificial Sequence
  Description of Artificial Sequence: Synthetic polypeptide
  VH of XENP019401
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 17587 - protein, 5 aa, Artificial Sequence
  Description of Artificial Sequence: Synthetic peptide
  XENP019401 vhCDR1
DAWMD

SEQ ID NO: 17588 - protein, 19 aa, Artificial Sequence
  Description of Artificial Sequence: Synthetic peptide
  XENP019401 vhCDR2
EIRTKANNHATYYAESVKG

SEQ ID NO: 17589 - protein, 10 aa, Artificial Sequence
  Description of Artificial Sequence: Synthetic peptide
  XENP019401 vhCDR3
LANWDWYFDV

SEQ ID NO: 17590 - protein, 218 aa, Artificial Sequence
  Description of Artificial Sequence: Synthetic polypeptide
  XENP019401 7G8_H0L0_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17591 - protein, 111 aa, Artificial Sequence
  Description of Artificial Sequence: Synthetic polypeptide
  VL of XENP019401
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEDPFTFGSGTKLEVK

SEQ ID NO: 17592 - protein, 15 aa, Artificial Sequence
  Description of Artificial Sequence: Synthetic peptide
  XENP019401 vlCDR1
KASQSVDYDGDSYMN

SEQ ID NO: 17593 - protein, 7 aa, Artificial Sequence
  Description of Artificial Sequence: Synthetic peptide
  XENP019401 vlCDR2
AASNLES

SEQ ID NO: 17594 - protein, 9 aa, Artificial Sequence
  Description of Artificial Sequence: Synthetic peptide
  XENP019401 vlCDR3
QQSNEDPFT

SEQ ID NO: 17595 - protein, 450 aa, Artificial Sequence
  Description of Artificial Sequence: Synthetic polypeptide
  XENP019402 7G8_H1L1_IgG1_PVA_/S267K Heavy Chain
QVQLVQSGAEVKKPGASVKVSCKASGFTFSDAWMDWVRQAPGQGLEWMGEIRTKANNHATYYAEKFQGRVTMTRDDSTSTVYMELSSLRSEDTAVYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17596 - protein, 121 aa, Artificial Sequence
  Description of Artificial Sequence: Synthetic polypeptide
  VH of XENP019402
QVQLVQSGAEVKKPGASVKVSCKASGFTFSDAWMDWVRQAPGQGLEWMGEIRTKANNHATYYAEKFQGRVTMTRDDSTSTVYMELSSLRSEDTAVYYCTRLANWDWYFDVWGAGTTVTVSS

SEQ ID NO: 17597 - protein, 5 aa, Artificial Sequence
  Description of Artificial Sequence: Synthetic peptide
  XENP019402 vhCDR1
DAWMD

SEQ ID NO: 17598 - protein, 19 aa, Artificial Sequence
  Description of Artificial Sequence: Synthetic peptide
  XENP019402 vhCDR2
EIRTKANNHATYYAEKFQG

SEQ ID NO: 17599 - protein, 10 aa, Artificial Sequence
  Description of Artificial Sequence: Synthetic peptide
  XENP019402 vhCDR3
LANWDWYFDV

SEQ ID NO: 17600 - protein, 218 aa, Artificial Sequence
  Description of Artificial Sequence: Synthetic polypeptide
  XENP019402 7G8_H1L1_IgG1_PVA_/S267K Light Chain
DTVLTQSPSSLSASVGDRVTITCRASQSVDYDGDSYMNWYQQKPGKPPKLLIYAASNLESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17601 - protein, 111 aa, Artificial Sequence
  Description of Artificial Sequence: Synthetic polypeptide
  VL of XENP019402
DTVLTQSPSSLSASVGDRVTITCRASQSVDYDGDSYMNWYQQKPGKPPKLLIYAASNLESGIPARLSGSGSGTDFTLTISSLQPEDFATYYCQQSNEDPFTFGSGTKLEIK

SEQ ID NO: 17602 - protein, 15 aa, Artificial Sequence
  Description of Artificial Sequence: Synthetic peptide
  XENP019402 vlCDR1
RASQSVDYDGDSYMN

SEQ ID NO: 17603 - protein, 7 aa, Artificial Sequence
  Description of Artificial Sequence: Synthetic peptide
  XENP019402 vlCDR2
AASNLES

SEQ ID NO: 17604 - protein, 9 aa, Artificial Sequence
  Description of Artificial Sequence: Synthetic peptide
  XENP019402 vlCDR3
QQSNEDPFT

SEQ ID NO: 17605 - protein, 450 aa, Artificial Sequence; identical to SEQ ID NO: 17595
  Description of Artificial Sequence: Synthetic polypeptide
  XENP019403 7G8_H1L2_IgG1_PVA_/S267K Heavy Chain

SEQ ID NO: 17606 - protein, 121 aa, Artificial Sequence; identical to SEQ ID NO: 17596
  Description of Artificial Sequence: Synthetic polypeptide
  VH of XENP019403

SEQ ID NO: 17607 - protein, 5 aa, Artificial Sequence
  Description of Artificial Sequence: Synthetic peptide
  XENP019403 vhCDR1
DAWMD

SEQ ID NO: 17608 - protein, 19 aa, Artificial Sequence
  Description of Artificial Sequence: Synthetic peptide
  XENP019403 vhCDR2
EIRTKANNHATYYAEKFQG

SEQ ID NO: 17609 - protein, 10 aa, Artificial Sequence
  Description of Artificial Sequence: Synthetic peptide
  XENP019403 vhCDR3
LANWDWYFDV

SEQ ID NO: 17610 - protein, 218 aa, Artificial Sequence
  Description of Artificial Sequence: Synthetic polypeptide
  XENP019403 7G8_H1L2_IgG1_PVA_/S267K Light Chain
DTVLTQSPATLSLSPGERATLSCRASQSVDYDGDSYMNWYQQKPGQPPRLLIYAASNLESGIPARLSGSGSGTDFTLTISSLEPEDFAVYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17611 - protein, 111 aa, Artificial Sequence
  Description of Artificial Sequence: Synthetic polypeptide
  VL of XENP019403
DTVLTQSPATLSLSPGERATLSCRASQSVDYDGDSYMNWYQQKPGQPPRLLIYAASNLESGIPARLSGSGSGTDFTLTISSLEPEDFAVYYCQQSNEDPFTFGSGTKLEIK

SEQ ID NO: 17612 - protein, 15 aa, Artificial Sequence
  Description of Artificial Sequence: Synthetic peptide
  XENP019403 vlCDR1
RASQSVDYDGDSYMN

SEQ ID NO: 17613 - protein, 7 aa, Artificial Sequence
  Description of Artificial Sequence: Synthetic peptide
  XENP019403 vlCDR2
AASNLES

SEQ ID NO: 17614 - protein, 9 aa, Artificial Sequence
  Description of Artificial Sequence: Synthetic peptide
  XENP019403 vlCDR3
QQSNEDPFT

SEQ ID NO: 17615 - protein, 450 aa, Artificial Sequence; identical to SEQ ID NO: 17595
  Description of Artificial Sequence: Synthetic polypeptide
  XENP019404 7G8_H1L3_IgG1_PVA_/S267K Heavy Chain

SEQ ID NO: 17616 - protein, 121 aa, Artificial Sequence; identical to SEQ ID NO: 17596
  Description of Artificial Sequence: Synthetic polypeptide
  VH of XENP019404

SEQ ID NO: 17617 - protein, 5 aa, Artificial Sequence
  Description of Artificial Sequence: Synthetic peptide
  XENP019404 vhCDR1
DAWMD

SEQ ID NO: 17618 - protein, 19 aa, Artificial Sequence
  Description of Artificial Sequence: Synthetic peptide
  XENP019404 vhCDR2
EIRTKANNHATYYAEKFQG

SEQ ID NO: 17619 - protein, 10 aa, Artificial Sequence
  Description of Artificial Sequence: Synthetic peptide
  XENP019404 vhCDR3
LANWDWYFDV

SEQ ID NO: 17620 - protein, 218 aa, Artificial Sequence
  Description of Artificial Sequence: Synthetic polypeptide
  XENP019404 7G8_H1L3_IgG1_PVA_/S267K Light Chain
DTVLTQSPDSLAVSLGERATINCKASQSVDYDGDSYMNWYQQKPGQPPKLLIYAASNLESGIPARLSGSGSGTDFTLTISSLQAEDVAVYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17621 - protein, 111 aa, Artificial Sequence
  Description of Artificial Sequence: Synthetic polypeptide
  VL of XENP019404
DTVLTQSPDSLAVSLGERATINCKASQSVDYDGDSYMNWYQQKPGQPPKLLIYAASNLESGIPARLSGSGSGTDFTLTISSLQAEDVAVYYCQQSNEDPFTFGSGTKLEIK

SEQ ID NO: 17622 - protein, 15 aa, Artificial Sequence
  Description of Artificial Sequence: Synthetic peptide
  XENP019404 vlCDR1
KASQSVDYDGDSYMN

SEQ ID NO: 17623 - protein, 7 aa, Artificial Sequence
  Description of Artificial Sequence: Synthetic peptide
  XENP019404 vlCDR2
AASNLES

SEQ ID NO: 17624 - protein, 9 aa, Artificial Sequence
  Description of Artificial Sequence: Synthetic peptide
  XENP019404 vlCDR3
QQSNEDPFT

SEQ ID NO: 17625 - protein, 450 aa, Artificial Sequence
  Description of Artificial Sequence: Synthetic polypeptide
  XENP019405 7G8_H2L1_IgG1_PVA_/S267K Heavy Chain
EVQLVESGGGLVQPGGSLRLSCAASGFTFSDAWMDWVRQAPGKGLEWVGEIRTKANNHATYYAESVKGRFTISRDDSKSSVYLQMNSLKTEDTAVYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17626 - protein, 121 aa, Artificial Sequence
  Description of Artificial Sequence: Synthetic polypeptide
  VH of XENP019405
EVQLVESGGGLVQPGGSLRLSCAASGFTFSDAWMDWVRQAPGKGLEWVGEIRTKANNHATYYAESVKGRFTISRDDSKSSVYLQMNSLKTEDTAVYYCTRLANWDWYFDVWGAGTTVTVSS

SEQ ID NO: 17627 - protein, 5 aa, Artificial Sequence
  Description of Artificial Sequence: Synthetic peptide
  XENP019405 vhCDR1
DAWMD

SEQ ID NO: 17628 - protein, 19 aa, Artificial Sequence
  Description of Artificial Sequence: Synthetic peptide
  XENP019405 vhCDR2
EIRTKANNHATYYAESVKG

SEQ ID NO: 17629 - protein, 10 aa, Artificial Sequence
  Description of Artificial Sequence: Synthetic peptide
  XENP019405 vhCDR3
LANWDWYFDV

SEQ ID NO: 17630 - protein, 218 aa, Artificial Sequence; identical to SEQ ID NO: 17600
  Description of Artificial Sequence: Synthetic polypeptide
  XENP019405 7G8_H2L1_IgG1_PVA_/S267K Light Chain

SEQ ID NO: 17631 - protein, 111 aa, Artificial Sequence; identical to SEQ ID NO: 17601
  Description of Artificial Sequence: Synthetic polypeptide
  VL of XENP019405

SEQ ID NO: 17632 - protein, 15 aa, Artificial Sequence
  Description of Artificial Sequence: Synthetic peptide
  XENP019405 vlCDR1
RASQSVDYDGDSYMN

SEQ ID NO: 17633 - protein, 7 aa, Artificial Sequence
  Description of Artificial Sequence: Synthetic peptide
  XENP019405 vlCDR2
AASNLES

SEQ ID NO: 17634 - protein, 9 aa, Artificial Sequence
  Description of Artificial Sequence: Synthetic peptide
  XENP019405 vlCDR3
QQSNEDPFT

SEQ ID NO: 17635 - protein, 450 aa, Artificial Sequence; identical to SEQ ID NO: 17625
  Description of Artificial Sequence: Synthetic polypeptide
  XENP019406 7G8_H2L2_IgG1_PVA_/S267K Heavy Chain

SEQ ID NO: 17636 - protein, 121 aa, Artificial Sequence; identical to SEQ ID NO: 17626
  Description of Artificial Sequence: Synthetic polypeptide
  VH of XENP019406

SEQ ID NO: 17637 - protein, 5 aa, Artificial Sequence
  Description of Artificial Sequence: Synthetic peptide
  XENP019406 vhCDR1
DAWMD

SEQ ID NO: 17638 - protein, 19 aa, Artificial Sequence
  Description of Artificial Sequence: Synthetic peptide
  XENP019406 vhCDR2
EIRTKANNHATYYAESVKG

SEQ ID NO: 17639 - protein, 10 aa, Artificial Sequence
  Description of Artificial Sequence: Synthetic peptide
  XENP019406 vhCDR3
LANWDWYFDV

SEQ ID NO: 17640 - protein, 218 aa, Artificial Sequence; identical to SEQ ID NO: 17610
  Description of Artificial Sequence: Synthetic polypeptide
  XENP019406 7G8_H2L2_IgG1_PVA_/S267K Light Chain

SEQ ID NO: 17641 - protein, 111 aa, Artificial Sequence; identical to SEQ ID NO: 17611
  Description of Artificial Sequence: Synthetic polypeptide
  VL of XENP019406

SEQ ID NO: 17642 - protein, 15 aa, Artificial Sequence
  Description of Artificial Sequence: Synthetic peptide
  XENP019406 vlCDR1
RASQSVDYDGDSYMN

SEQ ID NO: 17643 - protein, 7 aa, Artificial Sequence
  Description of Artificial Sequence: Synthetic peptide
  XENP019406 vlCDR2
AASNLES

SEQ ID NO: 17644 - protein, 9 aa, Artificial Sequence
  Description of Artificial Sequence: Synthetic peptide
  XENP019406 vlCDR3
QQSNEDPFT

SEQ ID NO: 17645 - protein, 450 aa, Artificial Sequence; identical to SEQ ID NO: 17625
  Description of Artificial Sequence: Synthetic polypeptide
  XENP019407 7G8_H2L3_IgG1_PVA_/S267K Heavy Chain

SEQ ID NO: 17646 - protein, 121 aa, Artificial Sequence; identical to SEQ ID NO: 17626
  Description of Artificial Sequence: Synthetic polypeptide
  VH of XENP019407

SEQ ID NO: 17647 - protein, 5 aa, Artificial Sequence
  Description of Artificial Sequence: Synthetic peptide
  XENP019407 vhCDR1
DAWMD

SEQ ID NO: 17648 - protein, 19 aa, Artificial Sequence
  Description of Artificial Sequence: Synthetic peptide
  XENP019407 vhCDR2
EIRTKANNHATYYAESVKG

SEQ ID NO: 17649 - protein, 10 aa, Artificial Sequence
  Description of Artificial Sequence: Synthetic peptide
  XENP019407 vhCDR3
LANWDWYFDV

SEQ ID NO: 17650 - protein, 218 aa, Artificial Sequence; identical to SEQ ID NO: 17620
  Description of Artificial Sequence: Synthetic polypeptide
  XENP019407 7G8_H2L3_IgG1_PVA_/S267K Light Chain

SEQ ID NO: 17651 - protein, 111 aa, Artificial Sequence; identical to SEQ ID NO: 17621
  Description of Artificial Sequence: Synthetic polypeptide
  VL of XENP019407

SEQ ID NO: 17652 - protein, 15 aa, Artificial Sequence
  Description of Artificial Sequence: Synthetic peptide
  XENP019407 vlCDR1
KASQSVDYDGDSYMN

SEQ ID NO: 17653 - protein, 7 aa, Artificial Sequence
  Description of Artificial Sequence: Synthetic peptide
  XENP019407 vlCDR2
AASNLES

SEQ ID NO: 17654 - protein, 9 aa, Artificial Sequence
  Description of Artificial Sequence: Synthetic peptide
  XENP019407 vlCDR3
QQSNEDPFT

SEQ ID NO: 17655 - protein, 446 aa, Artificial Sequence
  Description of Artificial Sequence: Synthetic polypeptide
  XENP019408 11C12_H1L1_IgG1_PVA_/S267K Heavy Chain
EVQLVESGGGLVQPGGSLRLSCAASGFTFSSFGMHWVRQAPGKGLEWVSYISSDSSTFSYADSVKGRFTISRDNAKNSLYLQMNSLRAEDTAVYYCARYYYGYVDFWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 17656 - protein, 117 aa, Artificial Sequence
  Description of Artificial Sequence: Synthetic polypeptide
  VH of XENP019408
EVQLVESGGGLVQPGGSLRLSCAASGFTFSSFGMHWVRQAPGKGLEWVSYISSDSSTFSYADSVKGRFTISRDNAKNSLYLQMNSLRAEDTAVYYCARYYYGYVDFWGQGTTVTVSS

SEQ ID NO: 17657 - protein, 5 aa, Artificial Sequence
  Description of Artificial Sequence: Synthetic peptide
  XENP019408 vhCDR1
SFGMH

SEQ ID NO: 17658 - protein, 17 aa, Artificial Sequence
  Description of Artificial Sequence: Synthetic peptide
  XENP019408 vhCDR2
YISSDSSTFSYADSVKG

SEQ ID NO: 17659 - protein, 8 aa, Artificial Sequence
  Description of Artificial Sequence: Synthetic peptide
  XENP019408 vhCDR3
YYYGYVDF

SEQ ID NO: 17660 - protein, 214 aa, Artificial Sequence
  Description of Artificial Sequence: Synthetic polypeptide
  XENP019408 11C12_H1L1_IgG1_PVA_/S267K Light Chain
DIQMTQSPSSLSASVGDRVTITCRASEDIYNRLAWYQQKPGKAPKLLISGATSFETGVPSRFSGSGSGKDYTLTISSLQPEDFATYYCQQYWSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17661 - protein, 107 aa, Artificial Sequence
  Description of Artificial Sequence: Synthetic polypeptide
  VL of XENP019408
DIQMTQSPSSLSASVGDRVTITCRASEDIYNRLAWYQQKPGKAPKLLISGATSFETGVPSRFSGSGSGKDYTLTISSLQPEDFATYYCQQYWSTPWTFGGGTKVEIK

SEQ ID NO: 17662 - protein, 11 aa, Artificial Sequence
  Description of Artificial Sequence: Synthetic peptide
  XENP019408 vlCDR1
RASEDIYNRLA

SEQ ID NO: 17663 - protein, 7 aa, Artificial Sequence
  Description of Artificial Sequence: Synthetic peptide
  XENP019408 vlCDR2
GATSFET

SEQ ID NO: 17664 - protein, 9 aa, Artificial Sequence
  Description of Artificial Sequence: Synthetic peptide
  XENP019408 vlCDR3
QQYWSTPWT

SEQ ID NO: 17665 - protein, 447 aa, Artificial Sequence; identical to SEQ ID NO: 17235
  Description of Artificial Sequence: Synthetic polypeptide
  XENP020023 2A11_H1L0_IgG1_PVA_/S267K Heavy Chain

SEQ ID NO: 17666 - protein, 118 aa, Artificial Sequence; identical to SEQ ID NO: 17236
  Description of Artificial Sequence: Synthetic polypeptide
  VH of XENP020023

SEQ ID NO: 17667 - protein, 5 aa, Artificial Sequence
  Description of Artificial Sequence: Synthetic peptide
  XENP020023 vhCDR1
DYYMH

SEQ ID NO: 17668 - protein, 17 aa, Artificial Sequence
  Description of Artificial Sequence: Synthetic peptide
  XENP020023 vhCDR2
WIDPENGDTEYAPKFQG

SEQ ID NO: 17669 - protein, 9 aa, Artificial Sequence
  Description of Artificial Sequence: Synthetic peptide
  XENP020023 vhCDR3
RGVRQALDY

SEQ ID NO: 17670 - protein, 214 aa, Artificial Sequence; identical to SEQ ID NO: 17230
  Description of Artificial Sequence: Synthetic polypeptide
  XENP020023 2A11_H1L0_IgG1_PVA_/S267K Light Chain

SEQ ID NO: 17671 - protein, 107 aa, Artificial Sequence; identical to SEQ ID NO: 17231
  Description of Artificial Sequence: Synthetic polypeptide
  VL of XENP020023

SEQ ID NO: 17672 - protein, 11 aa, Artificial Sequence
  Description of Artificial Sequence: Synthetic peptide
  XENP020023 vlCDR1
RASQDIGNYLN

SEQ ID NO: 17673 - protein, 7 aa, Artificial Sequence
  Description of Artificial Sequence: Synthetic peptide
  XENP020023 vlCDR2
YTSRLHS

SEQ ID NO: 17674 - protein, 9 aa, Artificial Sequence
  Description of Artificial Sequence: Synthetic peptide
  XENP020023 vlCDR3
QQGNTLPYT

SEQ ID NO: 17675 - protein, 447 aa, Artificial Sequence; identical to SEQ ID NO: 17225
  Description of Artificial Sequence: Synthetic polypeptide
  XENP020024 2A11_H0L1_IgG1_PVA_/S267K Heavy Chain

SEQ ID NO: 17676 - protein, 118 aa, Artificial Sequence; identical to SEQ ID NO: 17226
  Description of Artificial Sequence: Synthetic polypeptide
  VH of XENP020024

SEQ ID NO: 17677 - protein, 5 aa, Artificial Sequence
  Description of Artificial Sequence: Synthetic peptide
  XENP020024 vhCDR1
DYYMH

SEQ ID NO: 17678 - protein, 17 aa, Artificial Sequence
  Description of Artificial Sequence: Synthetic peptide
  XENP020024 vhCDR2
WIDPENGDTEYAPKFQG

SEQ ID NO: 17679 - protein, 9 aa, Artificial Sequence
  Description of Artificial Sequence: Synthetic peptide
  XENP020024 vhCDR3
RGVRQALDY

SEQ ID NO: 17680 - protein, 214 aa, Artificial Sequence; identical to SEQ ID NO: 17240
  Description of Artificial Sequence: Synthetic polypeptide
  XENP020024 2A11_H0L1_IgG1_PVA_/S267K Light Chain

SEQ ID NO: 17681 - protein, 107 aa, Artificial Sequence; identical to SEQ ID NO: 17241
  Description of Artificial Sequence: Synthetic polypeptide
  VL of XENP020024

SEQ ID NO: 17682 - protein, 11 aa, Artificial Sequence
  Description of Artificial Sequence: Synthetic peptide
  XENP020024 vlCDR1
RASQDIGNYLN

SEQ ID NO: 17683 - protein, 7 aa, Artificial Sequence
  Description of Artificial Sequence: Synthetic peptide
  XENP020024 vlCDR2
YTSRLHS

SEQ ID NO: 17684 - protein, 9 aa, Artificial Sequence
  Description of Artificial Sequence: Synthetic peptide
  XENP020024 vlCDR3
QQGNTLPYT

SEQ ID NO: 17685 - protein, 445 aa, Artificial Sequence; identical to SEQ ID NO: 17455
  Description of Artificial Sequence: Synthetic polypeptide
  XENP020025 7A6_H1L0_IgG1_PVA_/S267K Heavy Chain

SEQ ID NO: 17686 - protein, 116 aa, Artificial Sequence; identical to SEQ ID NO: 17456
  Description of Artificial Sequence: Synthetic polypeptide
  VH of XENP020025

SEQ ID NO: 17687 - protein, 6 aa, Artificial Sequence
  Description of Artificial Sequence: Synthetic peptide
  XENP020025 vhCDR1
SGYFWN

SEQ ID NO: 17688 - protein, 15 aa, Artificial Sequence
  Description of Artificial Sequence: Synthetic peptide
  XENP020025 vhCDR2
YISYDSNYYNPSVKG

SEQ ID NO: 17689 - protein, 8 aa, Artificial Sequence
  Description of Artificial Sequence: Synthetic peptide
  XENP020025 vhCDR3
GGITTFDY

SEQ ID NO: 17690 - protein, 218 aa, Artificial Sequence; identical to SEQ ID NO: 17450
  Description of Artificial Sequence: Synthetic polypeptide
  XENP020025 7A6_H1L0_IgG1_PVA_/S267K Light Chain

SEQ ID NO: 17691 - protein, 111 aa, Artificial Sequence; identical to SEQ ID NO: 17451
  Description of Artificial Sequence: Synthetic polypeptide
  VL of XENP020025

SEQ ID NO: 17692 - protein, 15 aa, Artificial Sequence
  Description of Artificial Sequence: Synthetic peptide
  XENP020025 vlCDR1
KASQSVDYDGDSYMN

SEQ ID NO: 17693 - protein, 7 aa, Artificial Sequence
  Description of Artificial Sequence: Synthetic peptide
  XENP020025 vlCDR2
AASNLES

SEQ ID NO: 17694 - protein, 9 aa, Artificial Sequence
  Description of Artificial Sequence: Synthetic peptide
  XENP020025 vlCDR3
QQSNEDPRT

SEQ ID NO: 17695 - protein, 445 aa, Artificial Sequence; identical to SEQ ID NO: 17445
  Description of Artificial Sequence: Synthetic polypeptide
  XENP020026 7A6_H0L1_IgG1_PVA_/S267K Heavy Chain

SEQ ID NO: 17696 - protein, 116 aa, Artificial Sequence; identical to SEQ ID NO: 17446
  Description of Artificial Sequence: Synthetic polypeptide
  VH of XENP020026

SEQ ID NO: 17697 - protein, 6 aa, Artificial Sequence
  Description of Artificial Sequence: Synthetic peptide
  XENP020026 vhCDR1
SGYFWN

SEQ ID NO: 17698 - protein, 15 aa, Artificial Sequence
  Description of Artificial Sequence: Synthetic peptide
  XENP020026 vhCDR2
YISYDSNYYNPSLKN

SEQ ID NO: 17699 - protein, 8 aa, Artificial Sequence
  Description of Artificial Sequence: Synthetic peptide
  XENP020026 vhCDR3
GGITTFDY

SEQ ID NO: 17700 - protein, 218 aa, Artificial Sequence; identical to SEQ ID NO: 17460
  Description of Artificial Sequence: Synthetic polypeptide
  XENP020026 7A6_H0L1_IgG1_PVA_/S267K Light Chain

SEQ ID NO: 17701 - protein, 111 aa, Artificial Sequence; identical to SEQ ID NO: 17461
  Description of Artificial Sequence: Synthetic polypeptide
  VL of XENP020026

SEQ ID NO: 17702 - protein, 15 aa, Artificial Sequence
  Description of Artificial Sequence: Synthetic peptide
  XENP020026 vlCDR1
RASQSVDYDGDSYMN

SEQ ID NO: 17703 - protein, 7 aa, Artificial Sequence
  Description of Artificial Sequence: Synthetic peptide
  XENP020026 vlCDR2
AASNLES

SEQ ID NO: 17704 - protein, 9 aa, Artificial Sequence
  Description of Artificial Sequence: Synthetic peptide
  XENP020026 vlCDR3
QQSNEDPRT

SEQ ID NO: 17705 - protein, 445 aa, Artificial Sequence; identical to SEQ ID NO: 17445
  Description of Artificial Sequence: Synthetic polypeptide
  XENP020027 7A6_H0L3_IgG1_PVA_/S267K Heavy Chain

SEQ ID NO: 17706 - protein, 116 aa, Artificial Sequence; identical to SEQ ID NO: 17446
  Description of Artificial Sequence: Synthetic polypeptide
  VH of XENP020027

SEQ ID NO: 17707 - protein, 6 aa, Artificial Sequence
  Description of Artificial Sequence: Synthetic peptide
  XENP020027 vhCDR1
SGYFWN

SEQ ID NO: 17708 - protein, 15 aa, Artificial Sequence
  Description of Artificial Sequence: Synthetic peptide
  XENP020027 vhCDR2
YISYDSNYYNPSLKN

SEQ ID NO: 17709 - protein, 8 aa, Artificial Sequence
  Description of Artificial Sequence: Synthetic peptide
  XENP020027 vhCDR3
GGITTFDY

SEQ ID NO: 17710 - protein, 218 aa, Artificial Sequence; identical to SEQ ID NO: 17480
  Description of Artificial Sequence: Synthetic polypeptide
  XENP020027 7A6_H0L3_IgG1_PVA_/S267K Light Chain

SEQ ID NO: 17711 - protein, 111 aa, Artificial Sequence; identical to SEQ ID NO: 17481
  Description of Artificial Sequence: Synthetic polypeptide
  VL of XENP020027

SEQ ID NO: 17712 - protein, 15 aa, Artificial Sequence
  Description of Artificial Sequence: Synthetic peptide
  XENP020027 vlCDR1
KASQSVDYDGDSYMN

SEQ ID NO: 17713 - protein, 7 aa, Artificial Sequence
  Description of Artificial Sequence: Synthetic peptide
  XENP020027 vlCDR2
AASNLES

SEQ ID NO: 17714 - protein, 9 aa, Artificial Sequence
  Description of Artificial Sequence: Synthetic peptide
  XENP020027 vlCDR3
QQSNEDPRT

SEQ ID NO: 17715 - protein, 450 aa, Artificial Sequence; identical to SEQ ID NO: 17595
  Description of Artificial Sequence: Synthetic polypeptide
  XENP020028 7G8_H1L0_IgG1_PVA_/S267K Heavy Chain

SEQ ID NO: 17716 - protein, 121 aa, Artificial Sequence; identical to SEQ ID NO: 17596
  Description of Artificial Sequence: Synthetic polypeptide
  VH of XENP020028

SEQ ID NO: 17717 - protein, 5 aa, Artificial Sequence
  Description of Artificial Sequence: Synthetic peptide
  XENP020028 vhCDR1
DAWMD

SEQ ID NO: 17718 - protein, 19 aa, Artificial Sequence
  Description of Artificial Sequence: Synthetic peptide
  XENP020028 vhCDR2
EIRTKANNHATYYAEKFQG

SEQ ID NO: 17719 - protein, 10 aa, Artificial Sequence
  Description of Artificial Sequence: Synthetic peptide
  XENP020028 vhCDR3
LANWDWYFDV

SEQ ID NO: 17720 - protein, 218 aa, Artificial Sequence; identical to SEQ ID NO: 17590
  Description of Artificial Sequence: Synthetic polypeptide
  XENP020028 7G8_H1L0_IgG1_PVA_/S267K Light Chain

SEQ ID NO: 17721 - protein, 111 aa, Artificial Sequence; identical to SEQ ID NO: 17591
  Description of Artificial Sequence: Synthetic polypeptide
  VL of XENP020028

SEQ ID NO: 17722 - protein, 15 aa, Artificial Sequence
  Description of Artificial Sequence: Synthetic peptide
  XENP020028 vlCDR1
KASQSVDYDGDSYMN

SEQ ID NO: 17723 - protein, 7 aa, Artificial Sequence
  Description of Artificial Sequence: Synthetic peptide
  XENP020028 vlCDR2
AASNLES

SEQ ID NO: 17724 - protein, 9 aa, Artificial Sequence
  Description of Artificial Sequence: Synthetic peptide
  XENP020028 vlCDR3
QQSNEDPFT

SEQ ID NO: 17725 - protein, 450 aa, Artificial Sequence; identical to SEQ ID NO: 17585
  Description of Artificial Sequence: Synthetic polypeptide
  XENP020029 7G8_H0L1_IgG1_PVA_/S267K Heavy Chain

SEQ ID NO: 17726 - protein, 121 aa, Artificial Sequence; identical to SEQ ID NO: 17586
  Description of Artificial Sequence: Synthetic polypeptide
  VH of XENP020029

SEQ ID NO: 17727 - protein, 5 aa, Artificial Sequence
  Description of Artificial Sequence: Synthetic peptide
  XENP020029 vhCDR1
DAWMD

SEQ ID NO: 17728 - protein, 19 aa, Artificial Sequence
  Description of Artificial Sequence: Synthetic peptide
  XENP020029 vhCDR2
EIRTKANNHATYYAESVKG

SEQ ID NO: 17729 - protein, 10 aa, Artificial Sequence
  Description of Artificial Sequence: Synthetic peptide
  XENP020029 vhCDR3
LANWDWYFDV

SEQ ID NO: 17730 - protein, 218 aa, Artificial Sequence; identical to SEQ ID NO: 17600
  Description of Artificial Sequence: Synthetic polypeptide
  XENP020029 7G8_H0L1_IgG1_PVA_/S267K Light Chain

SEQ ID NO: 17731 - protein, 111 aa, Artificial Sequence; identical to SEQ ID NO: 17601
  Description of Artificial Sequence: Synthetic polypeptide
  VL of XENP020029

SEQ ID NO: 17732 - protein, 15 aa, Artificial Sequence
  Description of Artificial Sequence: Synthetic peptide
  XENP020029 vlCDR1
RASQSVDYDGDSYMN

SEQ ID NO: 17733 - protein, 7 aa, Artificial Sequence
  Description of Artificial Sequence: Synthetic peptide
  XENP020029 vlCDR2
AASNLES

SEQ ID NO: 17734 - protein, 9 aa, Artificial Sequence
  Description of Artificial Sequence: Synthetic peptide
  XENP020029 vlCDR3
QQSNEDPFT

SEQ ID NO: 17735 - protein, 450 aa, Artificial Sequence; identical to SEQ ID NO: 17625
  Description of Artificial Sequence: Synthetic polypeptide
  XENP020262 7G8_H2L0_IgG1_PVA_/S267K Heavy Chain

SEQ ID NO: 17736 - protein, 121 aa, Artificial Sequence; identical to SEQ ID NO: 17626
  Description of Artificial Sequence: Synthetic polypeptide
  VH of XENP020262

SEQ ID NO: 17737 - protein, 5 aa, Artificial Sequence
  Description of Artificial Sequence: Synthetic peptide
  XENP020262 vhCDR1
DAWMD

SEQ ID NO: 17738 - protein, 19 aa, Artificial Sequence
  Description of Artificial Sequence: Synthetic peptide
  XENP020262 vhCDR2
EIRTKANNHATYYAESVKG

SEQ ID NO: 17739 - protein, 10 aa, Artificial Sequence
  Description of Artificial Sequence: Synthetic peptide
  XENP020262 vhCDR3
LANWDWYFDV

SEQ ID NO: 17740 - protein, 218 aa, Artificial Sequence; identical to SEQ ID NO: 17590
  Description of Artificial Sequence: Synthetic polypeptide
  XENP020262 7G8_H2L0_IgG1_PVA_/S267K Light Chain

SEQ ID NO: 17741 - protein, 111 aa, Artificial Sequence; identical to SEQ ID NO: 17591
  Description of Artificial Sequence: Synthetic polypeptide
  VL of XENP020262

SEQ ID NO: 17742 - protein, 15 aa, Artificial Sequence
  Description of Artificial Sequence: Synthetic peptide
  XENP020262 vlCDR1
KASQSVDYDGDSYMN

SEQ ID NO: 17743 - protein, 7 aa, Artificial Sequence
  Description of Artificial Sequence: Synthetic peptide
  XENP020262 vlCDR2
AASNLES

SEQ ID NO: 17744 - protein, 9 aa, Artificial Sequence
  Description of Artificial Sequence: Synthetic peptide
  XENP020262 vlCDR3
QQSNEDPFT

SEQ ID NO: 17745 - protein, 450 aa, Artificial Sequence; identical to SEQ ID NO: 17585
  Description of Artificial Sequence: Synthetic polypeptide
  XENP020263 7G8_H0L2_IgG1_PVA_/S267K Heavy Chain

SEQ ID NO: 17746 - protein, 121 aa, Artificial Sequence; identical to SEQ ID NO: 17586
  Description of Artificial Sequence: Synthetic polypeptide
  VH of XENP020263

SEQ ID NO: 17747 - protein, 5 aa, Artificial Sequence
  Description of Artificial Sequence: Synthetic peptide
  XENP020263 vhCDR1
DAWMD

SEQ ID NO: 17748 - protein, 19 aa, Artificial Sequence
  Description of Artificial Sequence: Synthetic peptide
  XENP020263 vhCDR2
EIRTKANNHATYYAESVKG

SEQ ID NO: 17749 - protein, 10 aa, Artificial Sequence
  Description of Artificial Sequence: Synthetic peptide
  XENP020263 vhCDR3
LANWDWYFDV

SEQ ID NO: 17750 - protein, 218 aa, Artificial Sequence; identical to SEQ ID NO: 17610
  Description of Artificial Sequence: Synthetic polypeptide
  XENP020263 7G8_H0L2_IgG1_PVA_/S267K Light Chain

SEQ ID NO: 17751 - protein, 111 aa, Artificial Sequence; identical to SEQ ID NO: 17611
  Description of Artificial Sequence: Synthetic polypeptide
  VL of XENP020263

SEQ ID NO: 17752 - protein, 15 aa, Artificial Sequence
  Description of Artificial Sequence: Synthetic peptide
  XENP020263 vlCDR1
RASQSVDYDGDSYMN

SEQ ID NO: 17753 - protein, 7 aa, Artificial Sequence
  Description of Artificial Sequence: Synthetic peptide
  XENP020263 vlCDR2
AASNLES

SEQ ID NO: 17754 - protein, 9 aa, Artificial Sequence
  Description of Artificial Sequence: Synthetic peptide
  XENP020263 vlCDR3
QQSNEDPFT

SEQ ID NO: 17755 - protein, 444 aa, Artificial Sequence
  Description of Artificial Sequence: Synthetic polypeptide
  XENP020412 8D7_H0L0_IgG1_PVA_/S267K Heavy Chain
QVQLKQSGPGLVQPSQSLSITCTVSGFSLSSYGVHWVRQSPGKGLEWLGVIWSGSTDYNAAFISRLSISKDNSKSQVFFKMNSLQPNDTAIYYCARTYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17756 - protein, 115 aa, Artificial Sequence
  Description of Artificial Sequence: Synthetic polypeptide
  VH of XENP020412
QVQLKQSGPGLVQPSQSLSITCTVSGFSLSSYGVHWVRQSPGKGLEWLGVIWSGSTDYNAAFISRLSISKDNSKSQVFFKMNSLQPNDTAIYYCARTYYYAMDYWGQGTSVTVSS

SEQ ID NO: 17757 - protein, 5 aa, Artificial Sequence
  Description of Artificial Sequence: Synthetic peptide
  XENP020412 vhCDR1
SYGVH

SEQ ID NO: 17758 - protein, 15 aa, Artificial Sequence
  Description of Artificial Sequence: Synthetic peptide
  XENP020412 vhCDR2
VIWSGSTDYNAAFIS

SEQ ID NO: 17759 - protein, 8 aa, Artificial Sequence
  Description of Artificial Sequence: Synthetic peptide
  XENP020412 vhCDR3
TYYYAMDY

SEQ ID NO: 17760 - protein, 214 aa, Artificial Sequence
  Description of Artificial Sequence: Synthetic polypeptide
  XENP020412 8D7_H0L0_IgG1_PVA_/S267K Light Chain
DIQMTQSPASLSVSVGETVTITCRASENIYSNLAWYQQKQGKSPQFLIYAATNLADGVPSRFSGSGSGTQYSLKINSLQSEDFGSYYCQHFWGTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17761 - protein, 107 aa, Artificial Sequence
  Description of Artificial Sequence: Synthetic polypeptide
  VL of XENP020412
DIQMTQSPASLSVSVGETVTITCRASENIYSNLAWYQQKQGKSPQFLIYAATNLADGVPSRFSGSGSGTQYSLKINSLQSEDFGSYYCQHFWGTPWTFGGGTKLEIK

SEQ ID NO: 17762 - protein, 11 aa, Artificial Sequence
  Description of Artificial Sequence: Synthetic peptide
  XENP020412 vlCDR1
RASENIYSNLA

SEQ ID NO: 17763 - protein, 7 aa, Artificial Sequence
  Description of Artificial Sequence: Synthetic peptide
  XENP020412 vlCDR2
AATNLAD

SEQ ID NO: 17764 - protein, 9 aa, Artificial Sequence
  Description of Artificial Sequence: Synthetic peptide
  XENP020412 vlCDR3
QHFWGTPWT

SEQ ID NO: 17765 - protein, 444 aa, Artificial Sequence
  Description of Artificial Sequence: Synthetic polypeptide
  XENP020413 8D7_H2L1_IgG1_PVA_/S267K Heavy Chain
QVQLVQSGAEVKKPGASVKVSCKVSGFSLSSYGVHWVRQAPGQGLEWLGVIWSGSTDYNAKFQGRVTITKDNSKSTVYFELSSLRSEDTAVYYCARTYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17766 - protein, 115 aa, Artificial Sequence
  Description of Artificial Sequence: Synthetic polypeptide
  VH of XENP020413
QVQLVQSGAEVKKPGASVKVSCKVSGFSLSSYGVHWVRQAPGQGLEWLGVIWSGSTDYNAKFQGRVTITKDNSKSTVYFELSSLRSEDTAVYYCARTYYYAMDYWGQGTLVTVSS

SEQ ID NO: 17767 - protein, 5 aa, Artificial Sequence
  Description of Artificial Sequence: Synthetic peptide
  XENP020413 vhCDR1
SYGVH

SEQ ID NO: 17768 - protein, 15 aa, Artificial Sequence
  Description of Artificial Sequence: Synthetic peptide
  XENP020413 vhCDR2
VIWSGSTDYNAKFQG

SEQ ID NO: 17769 - protein, 8 aa, Artificial Sequence
  Description of Artificial Sequence: Synthetic peptide
  XENP020413 vhCDR3
TYYYAMDY

SEQ ID NO: 17770 - protein, 214 aa, Artificial Sequence; identical to SEQ ID NO: 17220
  Description of Artificial Sequence: Synthetic polypeptide
  XENP020413 8D7_H2L1_IgG1_PVA_/S267K Light Chain

SEQ ID NO: 17771 - protein, 107 aa, Artificial Sequence; identical to SEQ ID NO: 17221
  Description of Artificial Sequence: Synthetic polypeptide
  VL of XENP020413

SEQ ID NO: 17772 - protein, 11 aa, Artificial Sequence
  Description of Artificial Sequence: Synthetic peptide
  XENP020413 vlCDR1
RASENIYSNLA

SEQ ID NO: 17773 - protein, 7 aa, Artificial Sequence
  Description of Artificial Sequence: Synthetic peptide
  XENP020413 vlCDR2
AATNLAD

SEQ ID NO: 17774 - protein, 9 aa, Artificial Sequence
  Description of Artificial Sequence: Synthetic peptide
  XENP020413 vlCDR3
QHFWGTPWT

SEQ ID NO: 17775 - protein, 444 aa, Artificial Sequence
  Description of Artificial Sequence: Synthetic polypeptide
  XENP020414 8D7_H3L1_IgG1_PVA_/S267K Heavy Chain
QVQLVESGGGVVQPGRSLRLSCAVSGFSLSSYGVHWVRQAPGKGLEWVAVIWSGSTDYNAAVKGRFTISKDNSKSTVYLQMNSLRAEDTAVYYCARTYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17776 - protein, 115 aa, Artificial Sequence
  Description of Artificial Sequence: Synthetic polypeptide
  VH of XENP020414
QVQLVESGGGVVQPGRSLRLSCAVSGFSLSSYGVHWVRQAPGKGLEWVAVIWSGSTDYNAAVKGRFTISKDNSKSTVYLQMNSLRAEDTAVYYCARTYYYAMDYWGQGTLVTVSS

SEQ ID NO: 17777 - protein, 5 aa, Artificial Sequence
  Description of Artificial Sequence: Synthetic peptide
  XENP020414 vhCDR1
SYGVH

SEQ ID NO: 17778 - protein, 15 aa, Artificial Sequence
  Description of Artificial Sequence: Synthetic peptide
  XENP020414 vhCDR2
VIWSGSTDYNAAVKG

SEQ ID NO: 17779 - protein, 8 aa, Artificial Sequence
  Description of Artificial Sequence: Synthetic peptide
  XENP020414 vhCDR3
TYYYAMDY

SEQ ID NO: 17780 - protein, 214 aa, Artificial Sequence; identical to SEQ ID NO: 17220
  Description of Artificial Sequence: Synthetic polypeptide
  XENP020414 8D7_H3L1_IgG1_PVA_/S267K Light Chain

SEQ ID NO: 17781 - protein, 107 aa, Artificial Sequence; identical to SEQ ID NO: 17221
  Description of Artificial Sequence: Synthetic polypeptide
  VL of XENP020414

SEQ ID NO: 17782 - protein, 11 aa, Artificial Sequence
  Description of Artificial Sequence: Synthetic peptide
  XENP020414 vlCDR1
RASENIYSNLA

SEQ ID NO: 17783 - protein, 7 aa, Artificial Sequence
  Description of Artificial Sequence: Synthetic peptide
  XENP020414 vlCDR2
AATNLAD

SEQ ID NO: 17784 - protein, 9 aa, Artificial Sequence
  Description of Artificial Sequence: Synthetic peptide
  XENP020414 vlCDR3
QHFWGTPWT

SEQ ID NO: 17785 - protein, 449 aa, Artificial Sequence
  Description of Artificial Sequence: Synthetic polypeptide
  XENP020415 4C8_H0L0_IgG1_PVA_/S267K Heavy Chain
EVQLQQSGPELVKPGASVKISCKASGYTFTDYNVHWVKQSHGKSLEWIGYIYPYTGGTGYNQKFKSKATLTVDNSSSTAYMELRSLTSEDSAVYYCARSDDGYSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17786 - protein, 120 aa, Artificial Sequence
  Description of Artificial Sequence: Synthetic polypeptide
  VH of XENP020415
EVQLQQSGPELVKPGASVKISCKASGYTFTDYNVHWVKQSHGKSLEWIGYIYPYTGGTGYNQKFKSKATLTVDNSSSTAYMELRSLTSEDSAVYYCARSDDGYSYAMDYWGQGTSVTVSS

SEQ ID NO: 17787 - protein, 5 aa, Artificial Sequence
  Description of Artificial Sequence: Synthetic peptide
  XENP020415 vhCDR1
DYNVH

SEQ ID NO: 17788 - protein, 17 aa, Artificial Sequence
  Description of Artificial Sequence: Synthetic peptide
  XENP020415 vhCDR2
YIYPYTGGTGYNQKFKS

SEQ ID NO: 17789 - protein, 11 aa, Artificial Sequence
  Description of Artificial Sequence: Synthetic peptide
  XENP020415 vhCDR3
SDDGYSYAMDY

SEQ ID NO: 17790 - protein, 213 aa, Artificial Sequence
  Description of Artificial Sequence: Synthetic polypeptide
  XENP020415 4C8_H0L0_IgG1_PVA_/S267K Light Chain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17791 - protein, 106 aa, Artificial Sequence
  Description of Artificial Sequence: Synthetic polypeptide
  VL of XENP020415
DIQMTQTTSSLSASLGDRVTISCRASQDISNYLNWYQQKPDGTVKLLIYYTSRLHSGVPSRFSGSGSGTDYSLTISNLEQEDIATYFCQQGNTLWTFGGGTKLEIK

SEQ ID NO: 17792 - protein, 11 aa, Artificial Sequence
  Description of Artificial Sequence: Synthetic peptide
  XENP020415 vlCDR1
RASQDISNYLN

SEQ ID NO: 17793 - protein, 7 aa, Artificial Sequence
  Description of Artificial Sequence: Synthetic peptide
  XENP020415 vlCDR2
YTSRLHS

SEQ ID NO: 17794 - protein, 8 aa, Artificial Sequence
  Description of Artificial Sequence: Synthetic peptide
  XENP020415 vlCDR3
QQGNTLWT

SEQ ID NO: 17795 - protein, 449 aa, Artificial Sequence
  Description of Artificial Sequence: Synthetic polypeptide
  XENP020416 4C8_H2L1_IgG1_PVA_/S267K Heavy Chain
QVQLVQSGAEVKKPGASVKVSCKASGYTFTDYNVHWVRQAPGQGLEWIGYIYPYTGGTGYNQKFQGRVTLTVDNSISTAYMELSSLRSEDTAVYYCARSDDGYSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17796 - protein, 120 aa, Artificial Sequence
  Description of Artificial Sequence: Synthetic polypeptide
  VH of XENP020416
QVQLVQSGAEVKKPGASVKVSCKASGYTFTDYNVHWVRQAPGQGLEWIGYIYPYTGGTGYNQKFQGRVTLTVDNSISTAYMELSSLRSEDTAVYYCARSDDGYSYAMDYWGQGTLVTVSS

SEQ ID NO: 17797 - protein, 5 aa, Artificial Sequence
  Description of Artificial Sequence: Synthetic peptide
  XENP020416 vhCDR1
DYNVH

SEQ ID NO: 17798 - protein, 17 aa, Artificial Sequence
  Description of Artificial Sequence: Synthetic peptide
  XENP020416 vhCDR2
YIYPYTGGTGYNQKFQG

SEQ ID NO: 17799 - protein, 11 aa, Artificial Sequence
  Description of Artificial Sequence: Synthetic peptide
  XENP020416 vhCDR3
SDDGYSYAMDY

SEQ ID NO: 17800 - protein, 213 aa, Artificial Sequence; identical to SEQ ID NO: 17440
  Description of Artificial Sequence: Synthetic polypeptide
  XENP020416 4C8_H2L1_IgG1_PVA_/S267K Light Chain

SEQ ID NO: 17801 - protein, 106 aa, Artificial Sequence; identical to SEQ ID NO: 17441
  Description of Artificial Sequence: Synthetic polypeptide
  VL of XENP020416

SEQ ID NO: 17802 - protein, 11 aa, Artificial Sequence
  Description of Artificial Sequence: Synthetic peptide
  XENP020416 vlCDR1
QASQDISNYLN

SEQ ID NO: 17803 - protein, 7 aa, Artificial Sequence
  Description of Artificial Sequence: Synthetic peptide
  XENP020416 vlCDR2
YTSRLHS

SEQ ID NO: 17804 - protein, 8 aa, Artificial Sequence
  Description of Artificial Sequence: Synthetic peptide
  XENP020416 vlCDR3
QQGNTLWT

SEQ ID NO: 17805 - protein, 450 aa, Artificial Sequence
  Description of Artificial Sequence: Synthetic polypeptide
  XENP020417 7G8_H3L1_IgG1_PVA_/S267K Heavy Chain
EVQLVESGGGLVQPGGSLRLSCAASGFTFSDAWMDWVRQAPGKGLEWVAEIRTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17806 - protein, 121 aa, Artificial Sequence
  Description of Artificial Sequence: Synthetic polypeptide
  VH of XENP020417
EVQLVESGGGLVQPGGSLRLSCAASGFTFSDAWMDWVRQAPGKGLEWVAEIRTKANNHATYYAESVKGRFTISRDDSKSSVYLQMNSLRAEDTAVYYCTRLANWDWYFDVWGQGTTVTVSS

SEQ ID NO: 17807 - protein, 5 aa, Artificial Sequence
  Description of Artificial Sequence: Synthetic peptide
  XENP020417 vhCDR1
DAWMD

SEQ ID NO: 17808 - protein, 19 aa, Artificial Sequence
  Description of Artificial Sequence: Synthetic peptide
  XENP020417 vhCDR2
EIRTKANNHATYYAESVKG

SEQ ID NO: 17809 - protein, 10 aa, Artificial Sequence
  Description of Artificial Sequence: Synthetic peptide
  XENP020417 vhCDR3
LANWDWYFDV

SEQ ID NO: 17810 - protein, 218 aa, Artificial Sequence; identical to SEQ ID NO: 17600
  Description of Artificial Sequence: Synthetic polypeptide
  XENP020417 7G8_H3L1_IgG1_PVA_/S267K Light Chain

SEQ ID NO: 17811 - protein, 111 aa, Artificial Sequence; identical to SEQ ID NO: 17601
  Description of Artificial Sequence: Synthetic polypeptide
  VL of XENP020417

SEQ ID NO: 17812 - protein, 15 aa, Artificial Sequence
  Description of Artificial Sequence: Synthetic peptide
  XENP020417 vlCDR1
RASQSVDYDGDSYMN

SEQ ID NO: 17813 - protein, 7 aa, Artificial Sequence
  Description of Artificial Sequence: Synthetic peptide
  XENP020417 vlCDR2
AASNLES

SEQ ID NO: 17814 - protein, 9 aa, Artificial Sequence
  Description of Artificial Sequence: Synthetic peptide
  XENP020417 vlCDR3
QQSNEDPFT

SEQ ID NO: 17815 - protein, 450 aa, Artificial Sequence; identical to SEQ ID NO: 17805
  Description of Artificial Sequence: Synthetic polypeptide
  XENP020418 7G8_H3L2_IgG1_PVA_/S267K Heavy Chain

SEQ ID NO: 17816 - protein, 121 aa, Artificial Sequence; identical to SEQ ID NO: 17806
  Description of Artificial Sequence: Synthetic polypeptide
  VH of XENP020418

SEQ ID NO: 17817 - protein, 5 aa, Artificial Sequence
  Description of Artificial Sequence: Synthetic peptide
  XENP020418 vhCDR1
DAWMD

SEQ ID NO: 17818 - protein, 19 aa, Artificial Sequence
  Description of Artificial Sequence: Synthetic peptide
  XENP020418 vhCDR2
EIRTKANNHATYYAESVKG

SEQ ID NO: 17819 - protein, 10 aa, Artificial Sequence
  Description of Artificial Sequence: Synthetic peptide
  XENP020418 vhCDR3
LANWDWYFDV

SEQ ID NO: 17820 - protein, 218 aa, Artificial Sequence; identical to SEQ ID NO: 17610
  Description of Artificial Sequence: Synthetic polypeptide
  XENP020418 7G8_H3L2_IgG1_PVA_/S267K Light Chain

SEQ ID NO: 17821 - protein, 111 aa, Artificial Sequence; identical to SEQ ID NO: 17611
  Description of Artificial Sequence: Synthetic polypeptide
  VL of XENP020418

SEQ ID NO: 17822 - protein, 15 aa, Artificial Sequence
  Description of Artificial Sequence: Synthetic peptide
  XENP020418 vlCDR1
RASQSVDYDGDSYMN

SEQ ID NO: 17823 - protein, 7 aa, Artificial Sequence
  Description of Artificial Sequence: Synthetic peptide
  XENP020418 vlCDR2
AASNLES

SEQ ID NO: 17824 - protein, 9 aa, Artificial Sequence
  Description of Artificial Sequence: Synthetic peptide
  XENP020418 vlCDR3
QQSNEDPFT

SEQ ID NO: 17825 - protein, 450 aa, Artificial Sequence; identical to SEQ ID NO: 17805
  Description of Artificial Sequence: Synthetic polypeptide
  XENP020419 7G8_H3L3_IgG1_PVA_/S267K Heavy Chain

SEQ ID NO: 17826 - protein, 121 aa, Artificial Sequence; identical to SEQ ID NO: 17806
  Description of Artificial Sequence: Synthetic polypeptide
  VH of XENP020419

SEQ ID NO: 17827 - protein, 5 aa, Artificial Sequence
  Description of Artificial Sequence: Synthetic peptide
  XENP020419 vhCDR1
DAWMD

SEQ ID NO: 17828 - protein, 19 aa, Artificial Sequence
  Description of Artificial Sequence: Synthetic peptide
  XENP020419 vhCDR2
EIRTKANNHATYYAESVKG

SEQ ID NO: 17829 - protein, 10 aa, Artificial Sequence
  Description of Artificial Sequence: Synthetic peptide
  XENP020419 vhCDR3
LANWDWYFDV

SEQ ID NO: 17830 - protein, 218 aa, Artificial Sequence; identical to SEQ ID NO: 17620
  Description of Artificial Sequence: Synthetic polypeptide
  XENP020419 7G8_H3L3_IgG1_PVA_/S267K Light Chain

SEQ ID NO: 17831 - protein, 111 aa, Artificial Sequence; identical to SEQ ID NO: 17621
  Description of Artificial Sequence: Synthetic polypeptide
  VL of XENP020419

SEQ ID NO: 17832 - protein, 15 aa, Artificial Sequence
  Description of Artificial Sequence: Synthetic peptide
  XENP020419 vlCDR1
KASQSVDYDGDSYMN

SEQ ID NO: 17833 - protein, 7 aa, Artificial Sequence
  Description of Artificial Sequence: Synthetic peptide
  XENP020419 vlCDR2
AASNLES

SEQ ID NO: 17834 - protein, 9 aa, Artificial Sequence
  Description of Artificial Sequence: Synthetic peptide
  XENP020419 vlCDR3
QQSNEDPFT

SEQ ID NO: 17835 - protein, 444 aa, Artificial Sequence; identical to SEQ ID NO: 17755
  Description of Artificial Sequence: Synthetic polypeptide
  XENP020412 8D7_H0L0_IgG1_PVA_/S267K Heavy Chain

SEQ ID NO: 17836 - protein, 115 aa, Artificial Sequence; identical to SEQ ID NO: 17756
  Description of Artificial Sequence: Synthetic polypeptide
  VH of XENP020412

SEQ ID NO: 17837 - protein, 5 aa, Artificial Sequence
  Description of Artificial Sequence: Synthetic peptide
  XENP020412 vhCDR1
SYGVH

SEQ ID NO: 17838 - protein, 15 aa, Artificial Sequence
  Description of Artificial Sequence: Synthetic peptide
  XENP020412 vhCDR2
VIWSGSTDYNAAFIS

SEQ ID NO: 17839 - protein, 8 aa, Artificial Sequence
  Description of Artificial Sequence: Synthetic peptide
  XENP020412 vhCDR3
TYYYAMDY

SEQ ID NO: 17840 - protein, 214 aa, Artificial Sequence; identical to SEQ ID NO: 17760
  Description of Artificial Sequence: Synthetic polypeptide
  XENP020412 8D7_H0L0_IgG1_PVA_/S267K Light Chain

SEQ ID NO: 17841 - protein, 107 aa, Artificial Sequence; identical to SEQ ID NO: 17761
  Description of Artificial Sequence: Synthetic polypeptide
  VL of XENP020412

SEQ ID NO: 17842 - protein, 11 aa, Artificial Sequence
  Description of Artificial Sequence: Synthetic peptide
  XENP020412 vlCDR1
RASENIYSNLA

SEQ ID NO: 17843 - protein, 7 aa, Artificial Sequence
  Description of Artificial Sequence: Synthetic peptide
  XENP020412 vlCDR2
AATNLAD

SEQ ID NO: 17844 - protein, 9 aa, Artificial Sequence
  Description of Artificial Sequence: Synthetic peptide
  XENP020412 vlCDR3
QHFWGTPWT

SEQ ID NO: 17845 - protein, 444 aa, Artificial Sequence; identical to SEQ ID NO: 17765
  Description of Artificial Sequence: Synthetic polypeptide
  XENP020413 8D7_H2L1_IgG1_PVA_/S267K Heavy Chain

SEQ ID NO: 17846 - protein, 115 aa, Artificial Sequence; identical to SEQ ID NO: 17766
  Description of Artificial Sequence: Synthetic polypeptide
  VH of XENP020413

SEQ ID NO: 17847 - protein, 5 aa, Artificial Sequence
  Description of Artificial Sequence: Synthetic peptide
  XENP020413 vhCDR1
SYGVH

SEQ ID NO: 17848 - protein, 15 aa, Artificial Sequence
  Description of Artificial Sequence: Synthetic peptide
  XENP020413 vhCDR2
VIWSGSTDYNAKFQG

SEQ ID NO: 17849 - protein, 8 aa, Artificial Sequence
  Description of Artificial Sequence: Synthetic peptide
  XENP020413 vhCDR3
TYYYAMDY

SEQ ID NO: 17850 - protein, 214 aa, Artificial Sequence; identical to SEQ ID NO: 17220
  Description of Artificial Sequence: Synthetic polypeptide
  XENP020413 8D7_H2L1_IgG1_PVA_/S267K Light Chain

SEQ ID NO: 17851 - protein, 107 aa, Artificial Sequence; identical to SEQ ID NO: 17221
  Description of Artificial Sequence: Synthetic polypeptide
  VL of XENP020413

SEQ ID NO: 17852 - protein, 11 aa, Artificial Sequence
  Description of Artificial Sequence: Synthetic peptide
  XENP020413 vlCDR1
RASENIYSNLA

SEQ ID NO: 17853 - protein, 7 aa, Artificial Sequence
  Description of Artificial Sequence: Synthetic peptide
  XENP020413 vlCDR2
AATNLAD

SEQ ID NO: 17854 - protein, 9 aa, Artificial Sequence
  Description of Artificial Sequence: Synthetic peptide
  XENP020413 vlCDR3
QHFWGTPWT

SEQ ID NO: 17855 - protein, 444 aa, Artificial Sequence; identical to SEQ ID NO: 17775
  Description of Artificial Sequence: Synthetic polypeptide
  XENP020414 8D7_H3L1_IgG1_PVA_/S267K Heavy Chain

SEQ ID NO: 17856 - protein, 115 aa, Artificial Sequence; identical to SEQ ID NO: 17776
  Description of Artificial Sequence: Synthetic polypeptide
  VH of XENP020414

SEQ ID NO: 17857 - protein, 5 aa, Artificial Sequence
  Description of Artificial Sequence: Synthetic peptide
  XENP020414 vhCDR1
SYGVH

SEQ ID NO: 17858 - protein, 15 aa, Artificial Sequence
  Description of Artificial Sequence: Synthetic peptide
  XENP020414 vhCDR2
VIWSGSTDYNAAVKG

SEQ ID NO: 17859 - protein, 8 aa, Artificial Sequence
  Description of Artificial Sequence: Synthetic peptide
  XENP020414 vhCDR3
TYYYAMDY

SEQ ID NO: 17860 - protein, 214 aa, Artificial Sequence; identical to SEQ ID NO: 17220
  Description of Artificial Sequence: Synthetic polypeptide
  XENP020414 8D7_H3L1_IgG1_PVA_/S267K Light Chain

SEQ ID NO: 17861 - protein, 107 aa, Artificial Sequence; identical to SEQ ID NO: 17221
  Description of Artificial Sequence: Synthetic polypeptide
  VL of XENP020414

SEQ ID NO: 17862 - protein, 11 aa, Artificial Sequence
  Description of Artificial Sequence: Synthetic peptide
  XENP020414 vlCDR1
RASENIYSNLA

SEQ ID NO: 17863 - protein, 7 aa, Artificial Sequence
  Description of Artificial Sequence: Synthetic peptide
  XENP020414 vlCDR2
AATNLAD

SEQ ID NO: 17864 - protein, 9 aa, Artificial Sequence
  Description of Artificial Sequence: Synthetic peptide
  XENP020414 vlCDR3
QHFWGTPWT

SEQ ID NO: 17865 - protein, 449 aa, Artificial Sequence; identical to SEQ ID NO: 17785
  Description of Artificial Sequence: Synthetic polypeptide
  XENP020415 4C8_H0L0_IgG1_PVA_/S267K Heavy Chain

SEQ ID NO: 17866 - protein, 120 aa, Artificial Sequence; identical to SEQ ID NO: 17786
  Description of Artificial Sequence: Synthetic polypeptide
  VH of XENP020415

SEQ ID NO: 17867 - protein, 5 aa, Artificial Sequence
  Description of Artificial Sequence: Synthetic peptide
  XENP020415 vhCDR1
DYNVH

SEQ ID NO: 17868 - protein, 17 aa, Artificial Sequence
  Description of Artificial Sequence: Synthetic peptide
  XENP020415 vhCDR2
YIYPYTGGTGYNQKFKS

SEQ ID NO: 17869 - protein, 11 aa, Artificial Sequence
  Description of Artificial Sequence: Synthetic peptide
  XENP020415 vhCDR3
SDDGYSYAMDY

SEQ ID NO: 17870 - protein, 213 aa, Artificial Sequence; identical to SEQ ID NO: 17790
  Description of Artificial Sequence: Synthetic polypeptide
  XENP020415 4C8_H0L0_IgG1_PVA_/S267K Light Chain

SEQ ID NO: 17871 - protein, 106 aa, Artificial Sequence; identical to SEQ ID NO: 17791
  Description of Artificial Sequence: Synthetic polypeptide
  VL of XENP020415

SEQ ID NO: 17872 - protein, 11 aa, Artificial Sequence
  Description of Artificial Sequence: Synthetic peptide
  XENP020415 vlCDR1
RASQDISNYLN

SEQ ID NO: 17873 - protein, 7 aa, Artificial Sequence
  Description of Artificial Sequence: Synthetic peptide
  XENP020415 vlCDR2
YTSRLHS

SEQ ID NO: 17874 - protein, 8 aa, Artificial Sequence
  Description of Artificial Sequence: Synthetic peptide
  XENP020415 vlCDR3
QQGNTLWT

SEQ ID NO: 17875 - protein, 449 aa, Artificial Sequence; identical to SEQ ID NO: 17795
  Description of Artificial Sequence: Synthetic polypeptide
  XENP020416 4C8_H2L1_IgG1_PVA_/S267K Heavy Chain

SEQ ID NO: 17876 - protein, 120 aa, Artificial Sequence; identical to SEQ ID NO: 17796
  Description of Artificial Sequence: Synthetic polypeptide
  VH of XENP020416

SEQ ID NO: 17877 - protein, 5 aa, Artificial Sequence
  Description of Artificial Sequence: Synthetic peptide
  XENP020416 vhCDR1
DYNVH

SEQ ID NO: 17878 - protein, 17 aa, Artificial Sequence
  Description of Artificial Sequence: Synthetic peptide
  XENP020416 vhCDR2
YIYPYTGGTGYNQKFQG

SEQ ID NO: 17879 - protein, 11 aa, Artificial Sequence
  Description of Artificial Sequence: Synthetic peptide
  XENP020416 vhCDR3
SDDGYSYAMDY

SEQ ID NO: 17880 - protein, 213 aa, Artificial Sequence; identical to SEQ ID NO: 17440
  Description of Artificial Sequence: Synthetic polypeptide
  XENP020416 4C8_H2L1_IgG1_PVA_/S267K Light Chain

SEQ ID NO: 17881 - protein, 106 aa, Artificial Sequence; identical to SEQ ID NO: 17441
  Description of Artificial Sequence: Synthetic polypeptide
  VL of XENP020416

SEQ ID NO: 17882 - protein, 11 aa, Artificial Sequence
  Description of Artificial Sequence: Synthetic peptide
  XENP020416 vlCDR1
QASQDISNYLN

SEQ ID NO: 17883 - protein, 7 aa, Artificial Sequence
  Description of Artificial Sequence: Synthetic peptide
  XENP020416 vlCDR2
YTSRLHS

SEQ ID NO: 17884 - protein, 8 aa, Artificial Sequence
  Description of Artificial Sequence: Synthetic peptide
  XENP020416 vlCDR3
QQGNTLWT

SEQ ID NO: 17885 - protein, 450 aa, Artificial Sequence; identical to SEQ ID NO: 17805
  Description of Artificial Sequence: Synthetic polypeptide
  XENP020417 7G8_H3L1_IgG1_PVA_/S267K Heavy Chain

SEQ ID NO: 17886 - protein, 121 aa, Artificial Sequence; identical to SEQ ID NO: 17806
  Description of Artificial Sequence: Synthetic polypeptide
  VH of XENP020417

SEQ ID NO: 17887 - protein, 5 aa, Artificial Sequence
  Description of Artificial Sequence: Synthetic peptide
  XENP020417 vhCDR1
DAWMD

SEQ ID NO: 17888 - protein, 19 aa, Artificial Sequence
  Description of Artificial Sequence: Synthetic peptide
  XENP020417 vhCDR2
EIRTKANNHATYYAESVKG

SEQ ID NO: 17889 - protein, 10 aa, Artificial Sequence
  Description of Artificial Sequence: Synthetic peptide
  XENP020417 vhCDR3
LANWDWYFDV

SEQ ID NO: 17890 - protein, 218 aa, Artificial Sequence; identical to SEQ ID NO: 17600
  Description of Artificial Sequence: Synthetic polypeptide
  XENP020417 7G8_H3L1_IgG1_PVA_/S267K Light Chain

SEQ ID NO: 17891 - protein, 111 aa, Artificial Sequence; identical to SEQ ID NO: 17601
  Description of Artificial Sequence: Synthetic polypeptide
  VL of XENP020417

SEQ ID NO: 17892 - protein, 15 aa, Artificial Sequence
  Description of Artificial Sequence: Synthetic peptide
  XENP020417 vlCDR1
RASQSVDYDGDSYMN

SEQ ID NO: 17893 - protein, 7 aa, Artificial Sequence
  Description of Artificial Sequence: Synthetic peptide
  XENP020417 vlCDR2
AASNLES

SEQ ID NO: 17894 - protein, 9 aa, Artificial Sequence
  Description of Artificial Sequence: Synthetic peptide
  XENP020417 vlCDR3
QQSNEDPFT

SEQ ID NO: 17895 - protein, 450 aa, Artificial Sequence; identical to SEQ ID NO: 17805
  Description of Artificial Sequence: Synthetic polypeptide
  XENP020418 7G8_H3L2_IgG1_PVA_/S267K Heavy Chain

SEQ ID NO: 17896 - protein, 121 aa, Artificial Sequence; identical to SEQ ID NO: 17806
  Description of Artificial Sequence: Synthetic polypeptide
  VH of XENP020418

SEQ ID NO: 17897 - protein, 5 aa, Artificial Sequence
  Description of Artificial Sequence: Synthetic peptide
  XENP020418 vhCDR1
DAWMD

SEQ ID NO: 17898 - protein, 19 aa, Artificial Sequence
  Description of Artificial Sequence: Synthetic peptide
  XENP020418 vhCDR2
EIRTKANNHATYYAESVKG

SEQ ID NO: 17899 - protein, 10 aa, Artificial Sequence
  Description of Artificial Sequence: Synthetic peptide
  XENP020418 vhCDR3
LANWDWYFDV

SEQ ID NO: 17900 - protein, 218 aa, Artificial Sequence; identical to SEQ ID NO: 17610
  Description of Artificial Sequence: Synthetic polypeptide
  XENP020418 7G8_H3L2_IgG1_PVA_/S267K Light Chain

SEQ ID NO: 17901 - protein, 111 aa, Artificial Sequence; identical to SEQ ID NO: 17611
  Description of Artificial Sequence: Synthetic polypeptide
  VL of XENP020418

SEQ ID NO: 17902 - protein, 15 aa, Artificial Sequence
  Description of Artificial Sequence: Synthetic peptide
  XENP020418 vlCDR1
RASQSVDYDGDSYMN

SEQ ID NO: 17903 - protein, 7 aa, Artificial Sequence
  Description of Artificial Sequence: Synthetic peptide
  XENP020418 vlCDR2
AASNLES

SEQ ID NO: 17904 - protein, 9 aa, Artificial Sequence
  Description of Artificial Sequence: Synthetic peptide
  XENP020418 vlCDR3
QQSNEDPFT

SEQ ID NO: 17905 - protein, 450 aa, Artificial Sequence; identical to SEQ ID NO: 17805
  Description of Artificial Sequence: Synthetic polypeptide
  XENP020419 7G8_H3L3_IgG1_PVA_/S267K Heavy Chain

SEQ ID NO: 17906 - protein, 121 aa, Artificial Sequence; identical to SEQ ID NO: 17806
  Description of Artificial Sequence: Synthetic polypeptide
  VH of XENP020419

SEQ ID NO: 17907 - protein, 5 aa, Artificial Sequence
  Description of Artificial Sequence: Synthetic peptide
  XENP020419 vhCDR1
DAWMD

SEQ ID NO: 17908 - protein, 19 aa, Artificial Sequence
  Description of Artificial Sequence: Synthetic peptide
  XENP020419 vhCDR2
EIRTKANNHATYYAESVKG

SEQ ID NO: 17909 - protein, 10 aa, Artificial Sequence
  Description of Artificial Sequence: Synthetic peptide
  XENP020419 vhCDR3
LANWDWYFDV

SEQ ID NO: 17910 - protein, 218 aa, Artificial Sequence; identical to SEQ ID NO: 17620
  Description of Artificial Sequence: Synthetic polypeptide
  XENP020419 7G8_H3L3_IgG1_PVA_/S267K Light Chain

SEQ ID NO: 17911 - protein, 111 aa, Artificial Sequence; identical to SEQ ID NO: 17621
  Description of Artificial Sequence: Synthetic polypeptide
  VL of XENP020419

SEQ ID NO: 17912 - protein, 15 aa, Artificial Sequence
  Description of Artificial Sequence: Synthetic peptide
  XENP020419 vlCDR1
KASQSVDYDGDSYMN

SEQ ID NO: 17913 - protein, 7 aa, Artificial Sequence
  Description of Artificial Sequence: Synthetic peptide
  XENP020419 vlCDR2
AASNLES

SEQ ID NO: 17914 - protein, 9 aa, Artificial Sequence
  Description of Artificial Sequence: Synthetic peptide
  XENP020419 vlCDR3
QQSNEDPFT

SEQ ID NO: 17915 - protein, 449 aa, Artificial Sequence; identical to SEQ ID NO: 17435
  Description of Artificial Sequence: Synthetic polypeptide
  XENP020420 4C8_H1L2_IgG1_PVA_/S267K Heavy Chain

SEQ ID NO: 17916 - protein, 120 aa, Artificial Sequence; identical to SEQ ID NO: 17436
  Description of Artificial Sequence: Synthetic polypeptide
  VH of XENP020420

SEQ ID NO: 17917 - protein, 5 aa, Artificial Sequence
  Description of Artificial Sequence: Synthetic peptide
  XENP020420 vhCDR1
DYNMH

SEQ ID NO: 17918 - protein, 17 aa, Artificial Sequence
  Description of Artificial Sequence: Synthetic peptide
  XENP020420 vhCDR2
YIYPYTGGTGYNQKFQG

SEQ ID NO: 17919 - protein, 11 aa, Artificial Sequence
  Description of Artificial Sequence: Synthetic peptide
  XENP020420 vhCDR3
SDDGYSYAMDY

SEQ ID NO: 17920 - protein, 213 aa, Artificial Sequence
  Description of Artificial Sequence: Synthetic polypeptide
  XENP020420 4C8_H1L2_IgG1_PVA_/S267K Light Chain
DIQMTQSPSSLSASVGDRVTITCRASQDISNYLNWYQQKPGKAPKLLIYYTSRLHSGVPSRFSGSGSGTDYTLTISSLQPEDFATYFCQQGNTLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17921 - protein, 106 aa, Artificial Sequence
  Description of Artificial Sequence: Synthetic polypeptide
  VL of XENP020420
DIQMTQSPSSLSASVGDRVTITCRASQDISNYLNWYQQKPGKAPKLLIYYTSRLHSGVPSRFSGSGSGTDYTLTISSLQPEDFATYFCQQGNTLWTFGGGTKVEIK

SEQ ID NO: 17922 - protein, 11 aa, Artificial Sequence
  Description of Artificial Sequence: Synthetic peptide
  XENP020420 vlCDR1
RASQDISNYLN

SEQ ID NO: 17923 - protein, 7 aa, Artificial Sequence
  Description of Artificial Sequence: Synthetic peptide
  XENP020420 vlCDR2
YTSRLHS

SEQ ID NO: 17924 - protein, 8 aa, Artificial Sequence
  Description of Artificial Sequence: Synthetic peptide
  XENP020420 vlCDR3
QQGNTLWT

SEQ ID NO: 17925 - protein, 449 aa, Artificial Sequence; identical to SEQ ID NO: 17795
  Description of Artificial Sequence: Synthetic polypeptide
  XENP020421 4C8_H2L2_IgG1_PVA_/S267K Heavy Chain

SEQ ID NO: 17926 - protein, 120 aa, Artificial Sequence; identical to SEQ ID NO: 17796
  Description of Artificial Sequence: Synthetic polypeptide
  VH of XENP020421

SEQ ID NO: 17927 - protein, 5 aa, Artificial Sequence
  Description of Artificial Sequence: Synthetic peptide
  XENP020421 vhCDR1
DYNVH

SEQ ID NO: 17928 - protein, 17 aa, Artificial Sequence
  Description of Artificial Sequence: Synthetic peptide
  XENP020421 vhCDR2
YIYPYTGGTGYNQKFQG

SEQ ID NO: 17929 - protein, 11 aa, Artificial Sequence
  Description of Artificial Sequence: Synthetic peptide
  XENP020421 vhCDR3
SDDGYSYAMDY

SEQ ID NO: 17930 - protein, 213 aa, Artificial Sequence; identical to SEQ ID NO: 17920
  Description of Artificial Sequence: Synthetic polypeptide
  XENP020421 4C8_H2L2_IgG1_PVA_/S267K Light Chain

SEQ ID NO: 17931 - protein, 106 aa, Artificial Sequence; identical to SEQ ID NO: 17921
  Description of Artificial Sequence: Synthetic polypeptide
  VL of XENP020421

SEQ ID NO: 17932 - protein, 11 aa, Artificial Sequence
  Description of Artificial Sequence: Synthetic peptide
  XENP020421 vlCDR1
RASQDISNYLN

SEQ ID NO: 17933 - protein, 7 aa, Artificial Sequence
  Description of Artificial Sequence: Synthetic peptide
  XENP020421 vlCDR2
YTSRLHS

SEQ ID NO: 17934 - protein, 8 aa, Artificial Sequence
  Description of Artificial Sequence: Synthetic peptide
  XENP020421 vlCDR3
QQGNTLWT

SEQ ID NO: 17935 - protein, 447 aa, Artificial Sequence; identical to SEQ ID NO: 17225
  Description of Artificial Sequence: Synthetic polypeptide
  XENP019361 2A11_H0L0_IgG1_PVA_/S267K Heavy Chain

SEQ ID NO: 17936 - protein, 118 aa, Artificial Sequence; identical to SEQ ID NO: 17226
  Description of Artificial Sequence: Synthetic polypeptide
  VH of XENP019361

SEQ ID NO: 17937 - protein, 5 aa, Artificial Sequence
  Description of Artificial Sequence: Synthetic peptide
  XENP019361 vhCDR1
DYYMH

SEQ ID NO: 17938 - protein, 17 aa, Artificial Sequence
  Description of Artificial Sequence: Synthetic peptide
  XENP019361 vhCDR2
WIDPENGDTEYAPKFQG

SEQ ID NO: 17939 - protein, 9 aa, Artificial Sequence
  Description of Artificial Sequence: Synthetic peptide
  XENP019361 vhCDR3
RGVRQALDY

SEQ ID NO: 17940 - protein, 214 aa, Artificial Sequence; identical to SEQ ID NO: 17230
  Description of Artificial Sequence: Synthetic polypeptide
  XENP019361 2A11_H0L0_IgG1_PVA_/S267K Light Chain

SEQ ID NO: 17941 - protein, 107 aa, Artificial Sequence; identical to SEQ ID NO: 17231
  Description of Artificial Sequence: Synthetic polypeptide
  VL of XENP019361

SEQ ID NO: 17942 - protein, 11 aa, Artificial Sequence
  Description of Artificial Sequence: Synthetic peptide
  XENP019361 vlCDR1
RASQDIGNYLN

SEQ ID NO: 17943 - protein, 7 aa, Artificial Sequence
  Description of Artificial Sequence: Synthetic peptide
  XENP019361 vlCDR2
YTSRLHS

SEQ ID NO: 17944 - protein, 9 aa, Artificial Sequence
  Description of Artificial Sequence: Synthetic peptide
  XENP019361 vlCDR3
QQGNTLPYT

SEQ ID NO: 17945 - protein, 447 aa, Artificial Sequence; identical to SEQ ID NO: 17235
  Description of Artificial Sequence: Synthetic polypeptide
  XENP019362 2A11_H1L1_IgG1_PVA_/S267K Heavy Chain

SEQ ID NO: 17946 - protein, 118 aa, Artificial Sequence; identical to SEQ ID NO: 17236
  Description of Artificial Sequence: Synthetic polypeptide
  VH of XENP019362

SEQ ID NO: 17947 - protein, 5 aa, Artificial Sequence
  Description of Artificial Sequence: Synthetic peptide
  XENP019362 vhCDR1
DYYMH

SEQ ID NO: 17948 - protein, 17 aa, Artificial Sequence
  Description of Artificial Sequence: Synthetic peptide
  XENP019362 vhCDR2
WIDPENGDTEYAPKFQG

SEQ ID NO: 17949 - protein, 9 aa, Artificial Sequence
  Description of Artificial Sequence: Synthetic peptide
  XENP019362 vhCDR3
RGVRQALDY

SEQ ID NO: 17950 - protein, 214 aa, Artificial Sequence; identical to SEQ ID NO: 17240
  Description of Artificial Sequence: Synthetic polypeptide
  XENP019362 2A11_H1L1_IgG1_PVA_/S267K Light Chain

SEQ ID NO: 17951 - protein, 107 aa, Artificial Sequence; identical to SEQ ID NO: 17241
  Description of Artificial Sequence: Synthetic polypeptide
  VL of XENP019362

SEQ ID NO: 17952 - protein, 11 aa, Artificial Sequence
  Description of Artificial Sequence: Synthetic peptide
  XENP019362 vlCDR1
RASQDIGNYLN

SEQ ID NO: 17953 - protein, 7 aa, Artificial Sequence
  Description of Artificial Sequence: Synthetic peptide
  XENP019362 vlCDR2
YTSRLHS

SEQ ID NO: 17954 - protein, 9 aa, Artificial Sequence
  Description of Artificial Sequence: Synthetic peptide
  XENP019362 vlCDR3
QQGNTLPYT

SEQ ID NO: 17955 - protein, 447 aa, Artificial Sequence; identical to SEQ ID NO: 17235
  Description of Artificial Sequence: Synthetic polypeptide
  XENP019363 2A11_H1L2_IgG1_PVA_/S267K Heavy Chain

SEQ ID NO: 17956 - protein, 118 aa, Artificial Sequence; identical to SEQ ID NO: 17236
  Description of Artificial Sequence: Synthetic polypeptide
  VH of XENP019363

SEQ ID NO: 17957 - protein, 5 aa, Artificial Sequence
  Description of Artificial Sequence: Synthetic peptide
  XENP019363 vhCDR1
DYYMH

SEQ ID NO: 17958 - protein, 17 aa, Artificial Sequence
  Description of Artificial Sequence: Synthetic peptide
  XENP019363 vhCDR2
WIDPENGDTEYAPKFQG

SEQ ID NO: 17959 - protein, 9 aa, Artificial Sequence
  Description of Artificial Sequence: Synthetic peptide
  XENP019363 vhCDR3
RGVRQALDY

SEQ ID NO: 17960 - protein, 214 aa, Artificial Sequence; identical to SEQ ID NO: 17250
  Description of Artificial Sequence: Synthetic polypeptide
  XENP019363 2A11_H1L2_IgG1_PVA_/S267K Light Chain

SEQ ID NO: 17961 - protein, 107 aa, Artificial Sequence; identical to SEQ ID NO: 17251
  Description of Artificial Sequence: Synthetic polypeptide
  VL of XENP019363

SEQ ID NO: 17962 - protein, 11 aa, Artificial Sequence
  Description of Artificial Sequence: Synthetic peptide
  XENP019363 vlCDR1
QASQDIGNYLN

SEQ ID NO: 17963 - protein, 7 aa, Artificial Sequence
  Description of Artificial Sequence: Synthetic peptide
  XENP019363 vlCDR2
YTSRLHS

SEQ ID NO: 17964 - protein, 9 aa, Artificial Sequence
  Description of Artificial Sequence: Synthetic peptide
  XENP019363 vlCDR3
QQGNTLPYT

SEQ ID NO: 17965 - protein, 446 aa, Artificial Sequence; identical to SEQ ID NO: 17255
  Description of Artificial Sequence: Synthetic polypeptide
  XENP019364 2A11_H2L1_IgG1_PVA_/S267K Heavy Chain

SEQ ID NO: 17966 - protein, 117 aa, Artificial Sequence; identical to SEQ ID NO: 17256
  Description of Artificial Sequence: Synthetic polypeptide
  VH of XENP019364

SEQ ID NO: 17967 - protein, 5 aa, Artificial Sequence
  Description of Artificial Sequence: Synthetic peptide
  XENP019364 vhCDR1
DYYMH

SEQ ID NO: 17968 - protein, 17 aa, Artificial Sequence
  Description of Artificial Sequence: Synthetic peptide
  XENP019364 vhCDR2
WIDPENGDTEYAPKFQG

SEQ ID NO: 17969 - protein, 8 aa, Artificial Sequence
  Description of Artificial Sequence: Synthetic peptide
  XENP019364 vhCDR3
GVRQALDY

SEQ ID NO: 17970 - protein, 214 aa, Artificial Sequence; identical to SEQ ID NO: 17240
  Description of Artificial Sequence: Synthetic polypeptide
  XENP019364 2A11_H2L1_IgG1_PVA_/S267K Light Chain

SEQ ID NO: 17971 - protein, 107 aa, Artificial Sequence; identical to SEQ ID NO: 17241
  Description of Artificial Sequence: Synthetic polypeptide
  VL of XENP019364

SEQ ID NO: 17972 - protein, 11 aa, Artificial Sequence
  Description of Artificial Sequence: Synthetic peptide
  XENP019364 vlCDR1
RASQDIGNYLN

SEQ ID NO: 17973 - protein, 7 aa, Artificial Sequence
  Description of Artificial Sequence: Synthetic peptide
  XENP019364 vlCDR2
YTSRLHS

SEQ ID NO: 17974 - protein, 9 aa, Artificial Sequence
  Description of Artificial Sequence: Synthetic peptide
  XENP019364 vlCDR3
QQGNTLPYT

SEQ ID NO: 17975 - protein, 446 aa, Artificial Sequence; identical to SEQ ID NO: 17255
  Description of Artificial Sequence: Synthetic polypeptide
  XENP019365 2A11_H2L2_IgG1_PVA_/S267K Heavy Chain

SEQ ID NO: 17976 - protein, 117 aa, Artificial Sequence; identical to SEQ ID NO: 17256
  Description of Artificial Sequence: Synthetic polypeptide
  VH of XENP019365

SEQ ID NO: 17977 - protein, 5 aa, Artificial Sequence
  Description of Artificial Sequence: Synthetic peptide
  XENP019365 vhCDR1
DYYMH

SEQ ID NO: 17978 - protein, 17 aa, Artificial Sequence
  Description of Artificial Sequence: Synthetic peptide
  XENP019365 vhCDR2
WIDPENGDTEYAPKFQG

SEQ ID NO: 17979 - protein, 8 aa, Artificial Sequence
  Description of Artificial Sequence: Synthetic peptide
  XENP019365 vhCDR3
GVRQALDY

SEQ ID NO: 17980 - protein, 214 aa, Artificial Sequence; identical to SEQ ID NO: 17250
  Description of Artificial Sequence: Synthetic polypeptide
  XENP019365 2A11_H2L2_IgG1_PVA_/S267K Light Chain

SEQ ID NO: 17981 - protein, 107 aa, Artificial Sequence; identical to SEQ ID NO: 17251
  Description of Artificial Sequence: Synthetic polypeptide
  VL of XENP019365

SEQ ID NO: 17982 - protein, 11 aa, Artificial Sequence
  Description of Artificial Sequence: Synthetic peptide
  XENP019365 vlCDR1
QASQDIGNYLN

SEQ ID NO: 17983 - protein, 7 aa, Artificial Sequence
  Description of Artificial Sequence: Synthetic peptide
  XENP019365 vlCDR2
YTSRLHS

SEQ ID NO: 17984 - protein, 9 aa, Artificial Sequence
  Description of Artificial Sequence: Synthetic peptide
  XENP019365 vlCDR3
QQGNTLPYT

SEQ ID NO: 17985 - protein, 447 aa, Artificial Sequence; identical to SEQ ID NO: 17275
  Description of Artificial Sequence: Synthetic polypeptide
  XENP019366 2A11_H3L1_IgG1_PVA_/S267K Heavy Chain

SEQ ID NO: 17986 - protein, 118 aa, Artificial Sequence; identical to SEQ ID NO: 17276
  Description of Artificial Sequence: Synthetic polypeptide
  VH of XENP019366

SEQ ID NO: 17987 - protein, 5 aa, Artificial Sequence
  Description of Artificial Sequence: Synthetic peptide
  XENP019366 vhCDR1
DYYMH

SEQ ID NO: 17988 - protein, 17 aa, Artificial Sequence
  Description of Artificial Sequence: Synthetic peptide
  XENP019366 vhCDR2
WIDPENGDTEYAPSVKG

SEQ ID NO: 17989 - protein, 9 aa, Artificial Sequence
  Description of Artificial Sequence: Synthetic peptide
  XENP019366 vhCDR3
RGVRQALDY

SEQ ID NO: 17990 - protein, 214 aa, Artificial Sequence; identical to SEQ ID NO: 17240
  Description of Artificial Sequence: Synthetic polypeptide
  XENP019366 2A11_H3L1_IgG1_PVA_/S267K Light Chain

SEQ ID NO: 17991 - protein, 107 aa, Artificial Sequence; identical to SEQ ID NO: 17241
  Description of Artificial Sequence: Synthetic polypeptide
  VL of XENP019366

SEQ ID NO: 17992 - protein, 11 aa, Artificial Sequence
  Description of Artificial Sequence: Synthetic peptide
  XENP019366 vlCDR1
RASQDIGNYLN

SEQ ID NO: 17993 - protein, 7 aa, Artificial Sequence
  Description of Artificial Sequence: Synthetic peptide
  XENP019366 vlCDR2
YTSRLHS

SEQ ID NO: 17994 - protein, 9 aa, Artificial Sequence
  Description of Artificial Sequence: Synthetic peptide
  XENP019366 vlCDR3
QQGNTLPYT

SEQ ID NO: 17995 - protein, 447 aa, Artificial Sequence; identical to SEQ ID NO: 17275
  Description of Artificial Sequence: Synthetic polypeptide
  XENP019367 2A11_H3L2_IgG1_PVA_/S267K Heavy Chain

SEQ ID NO: 17996 - protein, 118 aa, Artificial Sequence; identical to SEQ ID NO: 17276
  Description of Artificial Sequence: Synthetic polypeptide
  VH of XENP019367

SEQ ID NO: 17997 - protein, 5 aa, Artificial Sequence
  Description of Artificial Sequence: Synthetic peptide
  XENP019367 vhCDR1
DYYMH

SEQ ID NO: 17998 - protein, 17 aa, Artificial Sequence
  Description of Artificial Sequence: Synthetic peptide
  XENP019367 vhCDR2
WIDPENGDTEYAPSVKG

SEQ ID NO: 17999 - protein, 9 aa, Artificial Sequence
  Description of Artificial Sequence: Synthetic peptide
  XENP019367 vhCDR3
RGVRQALDY

SEQ ID NO: 18000 - protein, 214 aa, Artificial Sequence; identical to SEQ ID NO: 17250
  Description of Artificial Sequence: Synthetic polypeptide
  XENP019367 2A11_H3L2_IgG1_PVA_/S267K Light Chain

SEQ ID NO: 18001 - protein, 107 aa, Artificial Sequence; identical to SEQ ID NO: 17251
  Description of Artificial Sequence: Synthetic polypeptide
  VL of XENP019367

SEQ ID NO: 18002 - protein, 11 aa, Artificial Sequence
  Description of Artificial Sequence: Synthetic peptide
  XENP019367 vlCDR1
QASQDIGNYLN

SEQ ID NO: 18003 - protein, 7 aa, Artificial Sequence
  Description of Artificial Sequence: Synthetic peptide
  XENP019367 vlCDR2
YTSRLHS

SEQ ID NO: 18004 - protein, 9 aa, Artificial Sequence
  Description of Artificial Sequence: Synthetic peptide
  XENP019367 vlCDR3
QQGNTLPYT

SEQ ID NO: 18005 - protein, 446 aa, Artificial Sequence; identical to SEQ ID NO: 17295
  Description of Artificial Sequence: Synthetic polypeptide
  XENP019368 2A11_H4L1_IgG1_PVA_/S267K Heavy Chain

SEQ ID NO: 18006 - protein, 117 aa, Artificial Sequence; identical to SEQ ID NO: 17296
  Description of Artificial Sequence: Synthetic polypeptide
  VH of XENP019368

SEQ ID NO: 18007 - protein, 5 aa, Artificial Sequence
  Description of Artificial Sequence: Synthetic peptide
  XENP019368 vhCDR1
DYYMH

SEQ ID NO: 18008 - protein, 17 aa, Artificial Sequence
  Description of Artificial Sequence: Synthetic peptide
  XENP019368 vhCDR2
WIDPENGDTEYAPSVKG

SEQ ID NO: 18009 - protein, 8 aa, Artificial Sequence
  Description of Artificial Sequence: Synthetic peptide
  XENP019368 vhCDR3
GVRQALDY

SEQ ID NO: 18010 - protein, 214 aa, Artificial Sequence; identical to SEQ ID NO: 17240
  Description of Artificial Sequence: Synthetic polypeptide
  XENP019368 2A11_H4L1_IgG1_PVA_/S267K Light Chain

SEQ ID NO: 18011 - protein, 107 aa, Artificial Sequence; identical to SEQ ID NO: 17241
  Description of Artificial Sequence: Synthetic polypeptide
  VL of XENP019368

SEQ ID NO: 18012 - protein, 11 aa, Artificial Sequence
  Description of Artificial Sequence: Synthetic peptide
  XENP019368 vlCDR1
RASQDIGNYLN

SEQ ID NO: 18013 - protein, 7 aa, Artificial Sequence
  Description of Artificial Sequence: Synthetic peptide
  XENP019368 vlCDR2
YTSRLHS

SEQ ID NO: 18014 - protein, 9 aa, Artificial Sequence
  Description of Artificial Sequence: Synthetic peptide
  XENP019368 vlCDR3
QQGNTLPYT

SEQ ID NO: 18015 - protein, 446 aa, Artificial Sequence; identical to SEQ ID NO: 17295
  Description of Artificial Sequence: Synthetic polypeptide
  XENP019369 2A11_H4L2_IgG1_PVA_/S267K Heavy Chain

SEQ ID NO: 18016 - protein, 117 aa, Artificial Sequence; identical to SEQ ID NO: 17296
  Description of Artificial Sequence: Synthetic polypeptide
  VH of XENP019369

SEQ ID NO: 18017 - protein, 5 aa, Artificial Sequence
  Description of Artificial Sequence: Synthetic peptide
  XENP019369 vhCDR1
DYYMH

SEQ ID NO: 18018 - protein, 17 aa, Artificial Sequence
  Description of Artificial Sequence: Synthetic peptide
  XENP019369 vhCDR2
WIDPENGDTEYAPSVKG

SEQ ID NO: 18019 - protein, 8 aa, Artificial Sequence
  Description of Artificial Sequence: Synthetic peptide
  XENP019369 vhCDR3
GVRQALDY

SEQ ID NO: 18020 - protein, 214 aa, Artificial Sequence; identical to SEQ ID NO: 17250
  Description of Artificial Sequence: Synthetic polypeptide
  XENP019369 2A11_H4L2_IgG1_PVA_/S267K Light Chain

SEQ ID NO: 18021 - protein, 107 aa, Artificial Sequence; identical to SEQ ID NO: 17251
  Description of Artificial Sequence: Synthetic polypeptide
  VL of XENP019369

SEQ ID NO: 18022 - protein, 11 aa, Artificial Sequence
  Description of Artificial Sequence: Synthetic peptide
  XENP019369 vlCDR1
QASQDIGNYLN

SEQ ID NO: 18023 - protein, 7 aa, Artificial Sequence
  Description of Artificial Sequence: Synthetic peptide
  XENP019369 vlCDR2
YTSRLHS

SEQ ID NO: 18024 - protein, 9 aa, Artificial Sequence
  Description of Artificial Sequence: Synthetic peptide
  XENP019369 vlCDR3
QQGNTLPYT

SEQ ID NO: 18025 - protein, 447 aa, Artificial Sequence; identical to SEQ ID NO: 17235
  Description of Artificial Sequence: Synthetic polypeptide
  XENP020023 2A11_H1L0_IgG1_PVA_/S267K Heavy Chain

SEQ ID NO: 18026 - protein, 118 aa, Artificial Sequence; identical to SEQ ID NO: 17236
  Description of Artificial Sequence: Synthetic polypeptide
  VH of XENP020023

SEQ ID NO: 18027 - protein, 5 aa, Artificial Sequence
  Description of Artificial Sequence: Synthetic peptide
  XENP020023 vhCDR1
DYYMH

SEQ ID NO: 18028 - protein, 17 aa, Artificial Sequence
  Description of Artificial Sequence: Synthetic peptide
  XENP020023 vhCDR2
WIDPENGDTEYAPKFQG

SEQ ID NO: 18029 - protein, 9 aa, Artificial Sequence
  Description of Artificial Sequence: Synthetic peptide
  XENP020023 vhCDR3
RGVRQALDY

SEQ ID NO: 18030 - protein, 214 aa, Artificial Sequence; identical to SEQ ID NO: 17230
  Description of Artificial Sequence: Synthetic polypeptide
  XENP020023 2A11_H1L0_IgG1_PVA_/S267K Light Chain

SEQ ID NO: 18031 - protein, 107 aa, Artificial Sequence; identical to SEQ ID NO: 17231
  Description of Artificial Sequence: Synthetic polypeptide
  VL of XENP020023

SEQ ID NO: 18032 - protein, 11 aa, Artificial Sequence
  Description of Artificial Sequence: Synthetic peptide
  XENP020023 vlCDR1
RASQDIGNYLN

SEQ ID NO: 18033 - protein, 7 aa, Artificial Sequence
  Description of Artificial Sequence: Synthetic peptide
  XENP020023 vlCDR2
YTSRLHS

SEQ ID NO: 18034 - protein, 9 aa, Artificial Sequence
  Description of Artificial Sequence: Synthetic peptide
  XENP020023 vlCDR3
QQGNTLPYT

SEQ ID NO: 18035 - protein, 447 aa, Artificial Sequence; identical to SEQ ID NO: 17225
  Description of Artificial Sequence: Synthetic polypeptide
  XENP020024 2A11_H0L1_IgG1_PVA_/S267K Heavy Chain

SEQ ID NO: 18036 - protein, 118 aa, Artificial Sequence; identical to SEQ ID NO: 17226
  Description of Artificial Sequence: Synthetic polypeptide
  VH of XENP020024

SEQ ID NO: 18037 - protein, 5 aa, Artificial Sequence
  Description of Artificial Sequence: Synthetic peptide
  XENP020024 vhCDR1
DYYMH

SEQ ID NO: 18038 - protein, 17 aa, Artificial Sequence
  Description of Artificial Sequence: Synthetic peptide
  XENP020024 vhCDR2
WIDPENGDTEYAPKFQG

SEQ ID NO: 18039 - protein, 9 aa, Artificial Sequence
  Description of Artificial Sequence: Synthetic peptide
  XENP020024 vhCDR3
RGVRQALDY

SEQ ID NO: 18040 - protein, 214 aa, Artificial Sequence; identical to SEQ ID NO: 17240
  Description of Artificial Sequence: Synthetic polypeptide
  XENP020024 2A11_H0L1_IgG1_PVA_/S267K Light Chain

SEQ ID NO: 18041 - protein, 107 aa, Artificial Sequence; identical to SEQ ID NO: 17241
  Description of Artificial Sequence: Synthetic polypeptide
  VL of XENP020024

SEQ ID NO: 18042 - protein, 11 aa, Artificial Sequence
  Description of Artificial Sequence: Synthetic peptide
  XENP020024 vlCDR1
RASQDIGNYLN

SEQ ID NO: 18043 - protein, 7 aa, Artificial Sequence
  Description of Artificial Sequence: Synthetic peptide
  XENP020024 vlCDR2
YTSRLHS

SEQ ID NO: 18044 - protein, 9 aa, Artificial Sequence
  Description of Artificial Sequence: Synthetic peptide
  XENP020024 vlCDR3
QQGNTLPYT

SEQ ID NO: 18045 - protein, 450 aa, Artificial Sequence; identical to SEQ ID NO: 17585
  Description of Artificial Sequence: Synthetic polypeptide
  XENP019401 7G8_H0L0_IgG1_PVA_/S267K Heavy Chain

SEQ ID NO: 18046 - protein, 121 aa, Artificial Sequence; identical to SEQ ID NO: 17586
  Description of Artificial Sequence: Synthetic polypeptide
  VH of XENP019401

SEQ ID NO: 18047 - protein, 5 aa, Artificial Sequence
  Description of Artificial Sequence: Synthetic peptide
  XENP019401 vhCDR1
DAWMD

SEQ ID NO: 18048 - protein, 19 aa, Artificial Sequence
  Description of Artificial Sequence: Synthetic peptide
  XENP019401 vhCDR2
EIRTKANNHATYYAESVKG

SEQ ID NO: 18049 - protein, 10 aa, Artificial Sequence
  Description of Artificial Sequence: Synthetic peptide
  XENP019401 vhCDR3
LANWDWYFDV

SEQ ID NO: 18050 - protein, 218 aa, Artificial Sequence; identical to SEQ ID NO: 17590
  Description of Artificial Sequence: Synthetic polypeptide
  XENP019401 7G8_H0L0_IgG1_PVA_/S267K Light Chain

SEQ ID NO: 18051 - protein, 111 aa, Artificial Sequence; identical to SEQ ID NO: 17591
  Description of Artificial Sequence: Synthetic polypeptide
  VL of XENP019401

SEQ ID NO: 18052 - protein, 15 aa, Artificial Sequence
  Description of Artificial Sequence: Synthetic peptide
  XENP019401 vlCDR1
KASQSVDYDGDSYMN

SEQ ID NO: 18053 - protein, 7 aa, Artificial Sequence
  Description of Artificial Sequence: Synthetic peptide
  XENP019401 vlCDR2
AASNLES

SEQ ID NO: 18054 - protein, 9 aa, Artificial Sequence
  Description of Artificial Sequence: Synthetic peptide
  XENP019401 vlCDR3
QQSNEDPFT

SEQ ID NO: 18055 - protein, 450 aa, Artificial Sequence; identical to SEQ ID NO: 17595
  Description of Artificial Sequence: Synthetic polypeptide
  XENP019402 7G8_H1L1_IgG1_PVA_/S267K Heavy Chain

SEQ ID NO: 18056 - protein, 121 aa, Artificial Sequence; identical to SEQ ID NO: 17596
  Description of Artificial Sequence: Synthetic polypeptide
  VH of XENP019402

SEQ ID NO: 18057 - protein, 5 aa, Artificial Sequence
  Description of Artificial Sequence: Synthetic peptide
  XENP019402 vhCDR1
DAWMD

SEQ ID NO: 18058 - protein, 19 aa, Artificial Sequence
  Description of Artificial Sequence: Synthetic peptide
  XENP019402 vhCDR2
EIRTKANNHATYYAEKFQG

SEQ ID NO: 18059 - protein, 10 aa, Artificial Sequence
  Description of Artificial Sequence: Synthetic peptide
  XENP019402 vhCDR3
LANWDWYFDV

SEQ ID NO: 18060 - protein, 218 aa, Artificial Sequence; identical to SEQ ID NO: 17600
  Description of Artificial Sequence: Synthetic polypeptide
  XENP019402 7G8_H1L1_IgG1_PVA_/S267K Light Chain

SEQ ID NO: 18061 - protein, 111 aa, Artificial Sequence; identical to SEQ ID NO: 17601
  Description of Artificial Sequence: Synthetic polypeptide
  VL of XENP019402

SEQ ID NO: 18062 - protein, 15 aa, Artificial Sequence
  Description of Artificial Sequence: Synthetic peptide
  XENP019402 vlCDR1
RASQSVDYDGDSYMN

SEQ ID NO: 18063 - protein, 7 aa, Artificial Sequence
  Description of Artificial Sequence: Synthetic peptide
  XENP019402 vlCDR2
AASNLES

SEQ ID NO: 18064 - protein, 9 aa, Artificial Sequence
  Description of Artificial Sequence: Synthetic peptide
  XENP019402 vlCDR3
QQSNEDPFT

SEQ ID NO: 18065 - protein, 450 aa, Artificial Sequence; identical to SEQ ID NO: 17595
  Description of Artificial Sequence: Synthetic polypeptide
  XENP019403 7G8_H1L2_IgG1_PVA_/S267K Heavy Chain

SEQ ID NO: 18066 - protein, 121 aa, Artificial Sequence; identical to SEQ ID NO: 17596
  Description of Artificial Sequence: Synthetic polypeptide
  VH of XENP019403

SEQ ID NO: 18067 - protein, 5 aa, Artificial Sequence
  Description of Artificial Sequence: Synthetic peptide
  XENP019403 vhCDR1
DAWMD

SEQ ID NO: 18068 - protein, 19 aa, Artificial Sequence
  Description of Artificial Sequence: Synthetic peptide
  XENP019403 vhCDR2
EIRTKANNHATYYAEKFQG

SEQ ID NO: 18069 - protein, 10 aa, Artificial Sequence
  Description of Artificial Sequence: Synthetic peptide
  XENP019403 vhCDR3
LANWDWYFDV

SEQ ID NO: 18070 - protein, 218 aa, Artificial Sequence; identical to SEQ ID NO: 17610
  Description of Artificial Sequence: Synthetic polypeptide
  XENP019403 7G8_H1L2_IgG1_PVA_/S267K Light Chain

SEQ ID NO: 18071 - protein, 111 aa, Artificial Sequence; identical to SEQ ID NO: 17611
  Description of Artificial Sequence: Synthetic polypeptide
  VL of XENP019403

SEQ ID NO: 18072 - protein, 15 aa, Artificial Sequence
  Description of Artificial Sequence: Synthetic peptide
  XENP019403 vlCDR1
RASQSVDYDGDSYMN

SEQ ID NO: 18073 - protein, 7 aa, Artificial Sequence
  Description of Artificial Sequence: Synthetic peptide
  XENP019403 vlCDR2
AASNLES

SEQ ID NO: 18074 - protein, 9 aa, Artificial Sequence
  Description of Artificial Sequence: Synthetic peptide
  XENP019403 vlCDR3
QQSNEDPFT

SEQ ID NO: 18075 - protein, 450 aa, Artificial Sequence; identical to SEQ ID NO: 17595
  Description of Artificial Sequence: Synthetic polypeptide
  XENP019404 7G8_H1L3_IgG1_PVA_/S267K Heavy Chain

SEQ ID NO: 18076 - protein, 121 aa, Artificial Sequence; identical to SEQ ID NO: 17596
  Description of Artificial Sequence: Synthetic polypeptide
  VH of XENP019404

SEQ ID NO: 18077 - protein, 5 aa, Artificial Sequence
  Description of Artificial Sequence: Synthetic peptide
  XENP019404 vhCDR1
DAWMD

SEQ ID NO: 18078 - protein, 19 aa, Artificial Sequence
  Description of Artificial Sequence: Synthetic peptide
  XENP019404 vhCDR2
EIRTKANNHATYYAEKFQG

SEQ ID NO: 18079 - protein, 10 aa, Artificial Sequence
  Description of Artificial Sequence: Synthetic peptide
  XENP019404 vhCDR3
LANWDWYFDV

SEQ ID NO: 18080 - protein, 218 aa, Artificial Sequence; identical to SEQ ID NO: 17620
  Description of Artificial Sequence: Synthetic polypeptide
  XENP019404 7G8_H1L3_IgG1_PVA_/S267K Light Chain

SEQ ID NO: 18081 - protein, 111 aa, Artificial Sequence; identical to SEQ ID NO: 17621
  Description of Artificial Sequence: Synthetic polypeptide
  VL of XENP019404

SEQ ID NO: 18082 - protein, 15 aa, Artificial Sequence
  Description of Artificial Sequence: Synthetic peptide
  XENP019404 vlCDR1
KASQSVDYDGDSYMN

SEQ ID NO: 18083 - protein, 7 aa, Artificial Sequence
  Description of Artificial Sequence: Synthetic peptide
  XENP019404 vlCDR2
AASNLES

SEQ ID NO: 18084 - protein, 9 aa, Artificial Sequence
  Description of Artificial Sequence: Synthetic peptide
  XENP019404 vlCDR3
QQSNEDPFT

SEQ ID NO: 18085 - protein, 450 aa, Artificial Sequence; identical to SEQ ID NO: 17625
  Description of Artificial Sequence: Synthetic polypeptide
  XENP019405 7G8_H2L1_IgG1_PVA_/S267K Heavy Chain

SEQ ID NO: 18086 - protein, 121 aa, Artificial Sequence; identical to SEQ ID NO: 17626
  Description of Artificial Sequence: Synthetic polypeptide
  VH of XENP019405

SEQ ID NO: 18087 - protein, 5 aa, Artificial Sequence
  Description of Artificial Sequence: Synthetic peptide
  XENP019405 vhCDR1
DAWMD

SEQ ID NO: 18088 - protein, 19 aa, Artificial Sequence
  Description of Artificial Sequence: Synthetic peptide
  XENP019405 vhCDR2
EIRTKANNHATYYAESVKG

SEQ ID NO: 18089 - protein, 10 aa, Artificial Sequence
  Description of Artificial Sequence: Synthetic peptide
  XENP019405 vhCDR3
LANWDWYFDV

SEQ ID NO: 18090 - protein, 218 aa, Artificial Sequence; identical to SEQ ID NO: 17600
  Description of Artificial Sequence: Synthetic polypeptide
  XENP019405 7G8_H2L1_IgG1_PVA_/S267K Light Chain

SEQ ID NO: 18091 - protein, 111 aa, Artificial Sequence; identical to SEQ ID NO: 17601
  Description of Artificial Sequence: Synthetic polypeptide
  VL of XENP019405

SEQ ID NO: 18092 - protein, 15 aa, Artificial Sequence
  Description of Artificial Sequence: Synthetic peptide
  XENP019405 vlCDR1
RASQSVDYDGDSYMN

SEQ ID NO: 18093 - protein, 7 aa, Artificial Sequence
  Description of Artificial Sequence: Synthetic peptide
  XENP019405 vlCDR2
AASNLES

SEQ ID NO: 18094 - protein, 9 aa, Artificial Sequence
  Description of Artificial Sequence: Synthetic peptide
  XENP019405 vlCDR3
QQSNEDPFT

SEQ ID NO: 18095 - protein, 450 aa, Artificial Sequence; identical to SEQ ID NO: 17625
  Description of Artificial Sequence: Synthetic polypeptide
  XENP019406 7G8_H2L2_IgG1_PVA_/S267K Heavy Chain

SEQ ID NO: 18096 - protein, 121 aa, Artificial Sequence; identical to SEQ ID NO: 17626
  Description of Artificial Sequence: Synthetic polypeptide
  VH of XENP019406

SEQ ID NO: 18097 - protein, 5 aa, Artificial Sequence
  Description of Artificial Sequence: Synthetic peptide
  XENP019406 vhCDR1
DAWMD

SEQ ID NO: 18098 - protein, 19 aa, Artificial Sequence
  Description of Artificial Sequence: Synthetic peptide
  XENP019406 vhCDR2
EIRTKANNHATYYAESVKG

SEQ ID NO: 18099 - protein, 10 aa, Artificial Sequence
  Description of Artificial Sequence: Synthetic peptide
  XENP019406 vhCDR3
LANWDWYFDV

SEQ ID NO: 18100 - protein, 218 aa, Artificial Sequence; identical to SEQ ID NO: 17610
  Description of Artificial Sequence: Synthetic polypeptide
  XENP019406 7G8_H2L2_IgG1_PVA_/S267K Light Chain

SEQ ID NO: 18101 - protein, 111 aa, Artificial Sequence; identical to SEQ ID NO: 17611
  Description of Artificial Sequence: Synthetic polypeptide
  VL of XENP019406

SEQ ID NO: 18102 - protein, 15 aa, Artificial Sequence
  Description of Artificial Sequence: Synthetic peptide
  XENP019406 vlCDR1
RASQSVDYDGDSYMN

SEQ ID NO: 18103 - protein, 7 aa, Artificial Sequence
  Description of Artificial Sequence: Synthetic peptide
  XENP019406 vlCDR2
AASNLES

SEQ ID NO: 18104 - protein, 9 aa, Artificial Sequence
  Description of Artificial Sequence: Synthetic peptide
  XENP019406 vlCDR3
QQSNEDPFT

SEQ ID NO: 18105 - protein, 450 aa, Artificial Sequence; identical to SEQ ID NO: 17625
  Description of Artificial Sequence: Synthetic polypeptide
  XENP019407 7G8_H2L3_IgG1_PVA_/S267K Heavy Chain

SEQ ID NO: 18106 - protein, 121 aa, Artificial Sequence; identical to SEQ ID NO: 17626
  Description of Artificial Sequence: Synthetic polypeptide
  VH of XENP019407

SEQ ID NO: 18107 - protein, 5 aa, Artificial Sequence
  Description of Artificial Sequence: Synthetic peptide
  XENP019407 vhCDR1
DAWMD

SEQ ID NO: 18108 - protein, 19 aa, Artificial Sequence
  Description of Artificial Sequence: Synthetic peptide
  XENP019407 vhCDR2
EIRTKANNHATYYAESVKG

SEQ ID NO: 18109 - protein, 10 aa, Artificial Sequence
  Description of Artificial Sequence: Synthetic peptide
  XENP019407 vhCDR3
LANWDWYFDV

SEQ ID NO: 18110 - protein, 218 aa, Artificial Sequence; identical to SEQ ID NO: 17620
  Description of Artificial Sequence: Synthetic polypeptide
  XENP019407 7G8_H2L3_IgG1_PVA_/S267K Light Chain

SEQ ID NO: 18111 - protein, 111 aa, Artificial Sequence; identical to SEQ ID NO: 17621
  Description of Artificial Sequence: Synthetic polypeptide
  VL of XENP019407

SEQ ID NO: 18112 - protein, 15 aa, Artificial Sequence
  Description of Artificial Sequence: Synthetic peptide
  XENP019407 vlCDR1
KASQSVDYDGDSYMN

SEQ ID NO: 18113 - protein, 7 aa, Artificial Sequence
  Description of Artificial Sequence: Synthetic peptide
  XENP019407 vlCDR2
AASNLES

SEQ ID NO: 18114 - protein, 9 aa, Artificial Sequence
  Description of Artificial Sequence: Synthetic peptide
  XENP019407 vlCDR3
QQSNEDPFT

SEQ ID NO: 18115 - protein, 450 aa, Artificial Sequence; identical to SEQ ID NO: 17595
  Description of Artificial Sequence: Synthetic polypeptide
  XENP020028 7G8_H1L0_IgG1_PVA_/S267K Heavy Chain

SEQ ID NO: 18116 - protein, 121 aa, Artificial Sequence; identical to SEQ ID NO: 17596
  Description of Artificial Sequence: Synthetic polypeptide
  VH of XENP020028

SEQ ID NO: 18117 - protein, 5 aa, Artificial Sequence
  Description of Artificial Sequence: Synthetic peptide
  XENP020028 vhCDR1
DAWMD

SEQ ID NO: 18118 - protein, 19 aa, Artificial Sequence
  Description of Artificial Sequence: Synthetic peptide
  XENP020028 vhCDR2
EIRTKANNHATYYAEKFQG

SEQ ID NO: 18119 - protein, 10 aa, Artificial Sequence
  Description of Artificial Sequence: Synthetic peptide
  XENP020028 vhCDR3
LANWDWYFDV

SEQ ID NO: 18120 - protein, 218 aa, Artificial Sequence; identical to SEQ ID NO: 17590
  Description of Artificial Sequence: Synthetic polypeptide
  XENP020028 7G8_H1L0_IgG1_PVA_/S267K Light Chain

SEQ ID NO: 18121 - protein, 111 aa, Artificial Sequence; identical to SEQ ID NO: 17591
  Description of Artificial Sequence: Synthetic polypeptide
  VL of XENP020028

SEQ ID NO: 18122 - protein, 15 aa, Artificial Sequence
  Description of Artificial Sequence: Synthetic peptide
  XENP020028 vlCDR1
KASQSVDYDGDSYMN

SEQ ID NO: 18123 - protein, 7 aa, Artificial Sequence
  Description of Artificial Sequence: Synthetic peptide
  XENP020028 vlCDR2
AASNLES

SEQ ID NO: 18124 - protein, 9 aa, Artificial Sequence
  Description of Artificial Sequence: Synthetic peptide
  XENP020028 vlCDR3
QQSNEDPFT

SEQ ID NO: 18125 - protein, 450 aa, Artificial Sequence; identical to SEQ ID NO: 17585
  Description of Artificial Sequence: Synthetic polypeptide
  XENP020029 7G8_H0L1_IgG1_PVA_/S267K Heavy Chain

SEQ ID NO: 18126 - protein, 121 aa, Artificial Sequence; identical to SEQ ID NO: 17586
  Description of Artificial Sequence: Synthetic polypeptide
  VH of XENP020029

SEQ ID NO: 18127 - protein, 5 aa, Artificial Sequence
  Description of Artificial Sequence: Synthetic peptide
  XENP020029 vhCDR1
DAWMD

SEQ ID NO: 18128 - protein, 19 aa, Artificial Sequence
  Description of Artificial Sequence: Synthetic peptide
  XENP020029 vhCDR2
EIRTKANNHATYYAESVKG

SEQ ID NO: 18129 - protein, 10 aa, Artificial Sequence
  Description of Artificial Sequence: Synthetic peptide
  XENP020029 vhCDR3
LANWDWYFDV

SEQ ID NO: 18130 - protein, 218 aa, Artificial Sequence; identical to SEQ ID NO: 17600
  Description of Artificial Sequence: Synthetic polypeptide
  XENP020029 7G8_H0L1_IgG1_PVA_/S267K Light Chain

SEQ ID NO: 18131 - protein, 111 aa, Artificial Sequence; identical to SEQ ID NO: 17601
  Description of Artificial Sequence: Synthetic polypeptide
  VL of XENP020029

SEQ ID NO: 18132 - protein, 15 aa, Artificial Sequence
  Description of Artificial Sequence: Synthetic peptide
  XENP020029 vlCDR1
RASQSVDYDGDSYMN

SEQ ID NO: 18133 - protein, 7 aa, Artificial Sequence
  Description of Artificial Sequence: Synthetic peptide
  XENP020029 vlCDR2
AASNLES

SEQ ID NO: 18134 - protein, 9 aa, Artificial Sequence
  Description of Artificial Sequence: Synthetic peptide
  XENP020029 vlCDR3
QQSNEDPFT

SEQ ID NO: 18135 - protein, 450 aa, Artificial Sequence; identical to SEQ ID NO: 17625
  Description of Artificial Sequence: Synthetic polypeptide
  XENP020262 7G8_H2L0_IgG1_PVA_/S267K Heavy Chain

SEQ ID NO: 18136 - protein, 121 aa, Artificial Sequence; identical to SEQ ID NO: 17626
  Description of Artificial Sequence: Synthetic polypeptide
  VH of XENP020262

SEQ ID NO: 18137 - protein, 5 aa, Artificial Sequence
  Description of Artificial Sequence: Synthetic peptide
  XENP020262 vhCDR1
DAWMD

SEQ ID NO: 18138 - protein, 19 aa, Artificial Sequence
  Description of Artificial Sequence: Synthetic peptide
  XENP020262 vhCDR2
EIRTKANNHATYYAESVKG

SEQ ID NO: 18139 - protein, 10 aa, Artificial Sequence
  Description of Artificial Sequence: Synthetic peptide
  XENP020262 vhCDR3
LANWDWYFDV

SEQ ID NO: 18140 - protein, 218 aa, Artificial Sequence; identical to SEQ ID NO: 17590
  Description of Artificial Sequence: Synthetic polypeptide
  XENP020262 7G8_H2L0_IgG1_PVA_/S267K Light Chain

SEQ ID NO: 18141 - protein, 111 aa, Artificial Sequence; identical to SEQ ID NO: 17591
  Description of Artificial Sequence: Synthetic polypeptide
  VL of XENP020262

SEQ ID NO: 18142 - protein, 15 aa, Artificial Sequence
  Description of Artificial Sequence: Synthetic peptide
  XENP020262 vlCDR1
KASQSVDYDGDSYMN

SEQ ID NO: 18143 - protein, 7 aa, Artificial Sequence
  Description of Artificial Sequence: Synthetic peptide
  XENP020262 vlCDR2
AASNLES

SEQ ID NO: 18144 - protein, 9 aa, Artificial Sequence
  Description of Artificial Sequence: Synthetic peptide
  XENP020262 vlCDR3
QQSNEDPFT

SEQ ID NO: 18145 - protein, 450 aa, Artificial Sequence; identical to SEQ ID NO: 17585
  Description of Artificial Sequence: Synthetic polypeptide
  XENP020263 7G8_H0L2_IgG1_PVA_/S267K Heavy Chain

SEQ ID NO: 18146 - protein, 121 aa, Artificial Sequence; identical to SEQ ID NO: 17586
  Description of Artificial Sequence: Synthetic polypeptide
  VH of XENP020263

SEQ ID NO: 18147 - protein, 5 aa, Artificial Sequence
  Description of Artificial Sequence: Synthetic peptide
  XENP020263 vhCDR1
DAWMD

SEQ ID NO: 18148 - protein, 19 aa, Artificial Sequence
  Description of Artificial Sequence: Synthetic peptide
  XENP020263 vhCDR2
EIRTKANNHATYYAESVKG

SEQ ID NO: 18149 - protein, 10 aa, Artificial Sequence
  Description of Artificial Sequence: Synthetic peptide
  XENP020263 vhCDR3
LANWDWYFDV

SEQ ID NO: 18150 - protein, 218 aa, Artificial Sequence; identical to SEQ ID NO: 17610
  Description of Artificial Sequence: Synthetic polypeptide
  XENP020263 7G8_H0L2_IgG1_PVA_/S267K Light Chain

SEQ ID NO: 18151 - protein, 111 aa, Artificial Sequence; identical to SEQ ID NO: 17611
  Description of Artificial Sequence: Synthetic polypeptide
  VL of XENP020263

SEQ ID NO: 18152 - protein, 15 aa, Artificial Sequence
  Description of Artificial Sequence: Synthetic peptide
  XENP020263 vlCDR1
RASQSVDYDGDSYMN

SEQ ID NO: 18153 - protein, 7 aa, Artificial Sequence
  Description of Artificial Sequence: Synthetic peptide
  XENP020263 vlCDR2
AASNLES

SEQ ID NO: 18154 - protein, 9 aa, Artificial Sequence
  Description of Artificial Sequence: Synthetic peptide
  XENP020263 vlCDR3
QQSNEDPFT

SEQ ID NO: 18155 - protein, 450 aa, Artificial Sequence; identical to SEQ ID NO: 17805
  Description of Artificial Sequence: Synthetic polypeptide
  XENP020417 7G8_H3L1_IgG1_PVA_/S267K Heavy Chain

SEQ ID NO: 18156 - protein, 121 aa, Artificial Sequence; identical to SEQ ID NO: 17806
  Description of Artificial Sequence: Synthetic polypeptide
  VH of XENP020417

SEQ ID NO: 18157 - protein, 5 aa, Artificial Sequence
  Description of Artificial Sequence: Synthetic peptide
  XENP020417 vhCDR1
DAWMD

SEQ ID NO: 18158 - protein, 19 aa, Artificial Sequence
  Description of Artificial Sequence: Synthetic peptide
  XENP020417 vhCDR2
EIRTKANNHATYYAESVKG

SEQ ID NO: 18159 - protein, 10 aa, Artificial Sequence
  Description of Artificial Sequence: Synthetic peptide
  XENP020417 vhCDR3
LANWDWYFDV

SEQ ID NO: 18160 - protein, 218 aa, Artificial Sequence; identical to SEQ ID NO: 17600
  Description of Artificial Sequence: Synthetic polypeptide
  XENP020417 7G8_H3L1_IgG1_PVA_/S267K Light Chain

SEQ ID NO: 18161 - protein, 111 aa, Artificial Sequence; identical to SEQ ID NO: 17601
  Description of Artificial Sequence: Synthetic polypeptide
  VL of XENP020417

SEQ ID NO: 18162 - protein, 15 aa, Artificial Sequence
  Description of Artificial Sequence: Synthetic peptide
  XENP020417 vlCDR1
RASQSVDYDGDSYMN

SEQ ID NO: 18163 - protein, 7 aa, Artificial Sequence
  Description of Artificial Sequence: Synthetic peptide
  XENP020417 vlCDR2
AASNLES

SEQ ID NO: 18164 - protein, 9 aa, Artificial Sequence
  Description of Artificial Sequence: Synthetic peptide
  XENP020417 vlCDR3
QQSNEDPFT

SEQ ID NO: 18165 - protein, 450 aa, Artificial Sequence; identical to SEQ ID NO: 17805
  Description of Artificial Sequence: Synthetic polypeptide
  XENP020418 7G8_H3L2_IgG1_PVA_/S267K Heavy Chain

SEQ ID NO: 18166 - protein, 121 aa, Artificial Sequence; identical to SEQ ID NO: 17806
  Description of Artificial Sequence: Synthetic polypeptide
  VH of XENP020418

SEQ ID NO: 18167 - protein, 5 aa, Artificial Sequence
  Description of Artificial Sequence: Synthetic peptide
  XENP020418 vhCDR1
DAWMD

SEQ ID NO: 18168 - protein, 19 aa, Artificial Sequence
  Description of Artificial Sequence: Synthetic peptide
  XENP020418 vhCDR2
EIRTKANNHATYYAESVKG

SEQ ID NO: 18169 - protein, 10 aa, Artificial Sequence
  Description of Artificial Sequence: Synthetic peptide
  XENP020418 vhCDR3
LANWDWYFDV

SEQ ID NO: 18170 - protein, 218 aa, Artificial Sequence; identical to SEQ ID NO: 17610
  Description of Artificial Sequence: Synthetic polypeptide
  XENP020418 7G8_H3L2_IgG1_PVA_/S267K Light Chain

SEQ ID NO: 18171 - protein, 111 aa, Artificial Sequence; identical to SEQ ID NO: 17611
  Description of Artificial Sequence: Synthetic polypeptide
  VL of XENP020418

SEQ ID NO: 18172 - protein, 15 aa, Artificial Sequence
  Description of Artificial Sequence: Synthetic peptide
  XENP020418 vlCDR1
RASQSVDYDGDSYMN

SEQ ID NO: 18173 - protein, 7 aa, Artificial Sequence
  Description of Artificial Sequence: Synthetic peptide
  XENP020418 vlCDR2
AASNLES

SEQ ID NO: 18174 - protein, 9 aa, Artificial Sequence
  Description of Artificial Sequence: Synthetic peptide
  XENP020418 vlCDR3
QQSNEDPFT

SEQ ID NO: 18175 - protein, 450 aa, Artificial Sequence; identical to SEQ ID NO: 17805
  Description of Artificial Sequence: Synthetic polypeptide
  XENP020419 7G8_H3L3_IgG1_PVA_/S267K Heavy Chain

SEQ ID NO: 18176 - protein, 121 aa, Artificial Sequence; identical to SEQ ID NO: 17806
  Description of Artificial Sequence: Synthetic polypeptide
  VH of XENP020419

SEQ ID NO: 18177 - protein, 5 aa, Artificial Sequence
  Description of Artificial Sequence: Synthetic peptide
  XENP020419 vhCDR1
DAWMD

SEQ ID NO: 18178 - protein, 19 aa, Artificial Sequence
  Description of Artificial Sequence: Synthetic peptide
  XENP020419 vhCDR2
EIRTKANNHATYYAESVKG

SEQ ID NO: 18179 - protein, 10 aa, Artificial Sequence
  Description of Artificial Sequence: Synthetic peptide
  XENP020419 vhCDR3
LANWDWYFDV

SEQ ID NO: 18180 - protein, 218 aa, Artificial Sequence; identical to SEQ ID NO: 17620
  Description of Artificial Sequence: Synthetic polypeptide
  XENP020419 7G8_H3L3_IgG1_PVA_/S267K Light Chain

SEQ ID NO: 18181 - protein, 111 aa, Artificial Sequence; identical to SEQ ID NO: 17621
  Description of Artificial Sequence: Synthetic polypeptide
  VL of XENP020419

SEQ ID NO: 18182 - protein, 15 aa, Artificial Sequence
  Description of Artificial Sequence: Synthetic peptide
  XENP020419 vlCDR1
KASQSVDYDGDSYMN

SEQ ID NO: 18183 - protein, 7 aa, Artificial Sequence
  Description of Artificial Sequence: Synthetic peptide
  XENP020419 vlCDR2
AASNLES

SEQ ID NO: 18184 - protein, 9 aa, Artificial Sequence
  Description of Artificial Sequence: Synthetic peptide
  XENP020419 vlCDR3
QQSNEDPFT

SEQ ID NO: 18185 - protein, 450 aa, Artificial Sequence; identical to SEQ ID NO: 17805
  Description of Artificial Sequence: Synthetic polypeptide
  XENP020417 7G8_H3L1_IgG1_PVA_/S267K Heavy Chain

SEQ ID NO: 18186 - protein, 121 aa, Artificial Sequence; identical to SEQ ID NO: 17806
  Description of Artificial Sequence: Synthetic polypeptide
  VH of XENP020417

SEQ ID NO: 18187 - protein, 5 aa, Artificial Sequence
  Description of Artificial Sequence: Synthetic peptide
  XENP020417 vhCDR1
DAWMD

SEQ ID NO: 18188 - protein, 19 aa, Artificial Sequence
  Description of Artificial Sequence: Synthetic peptide
  XENP020417 vhCDR2
EIRTKANNHATYYAESVKG

SEQ ID NO: 18189 - protein, 10 aa, Artificial Sequence
  Description of Artificial Sequence: Synthetic peptide
  XENP020417 vhCDR3
LANWDWYFDV

SEQ ID NO: 18190 - protein, 218 aa, Artificial Sequence; identical to SEQ ID NO: 17600
  Description of Artificial Sequence: Synthetic polypeptide
  XENP020417 7G8_H3L1_IgG1_PVA_/S267K Light Chain

SEQ ID NO: 18191 - protein, 111 aa, Artificial Sequence; identical to SEQ ID NO: 17601
  Description of Artificial Sequence: Synthetic polypeptide
  VL of XENP020417

SEQ ID NO: 18192 - protein, 15 aa, Artificial Sequence
  Description of Artificial Sequence: Synthetic peptide
  XENP020417 vlCDR1
RASQSVDYDGDSYMN

SEQ ID NO: 18193 - protein, 7 aa, Artificial Sequence
  Description of Artificial Sequence: Synthetic peptide
  XENP020417 vlCDR2
AASNLES

SEQ ID NO: 18194 - protein, 9 aa, Artificial Sequence
  Description of Artificial Sequence: Synthetic peptide
  XENP020417 vlCDR3
QQSNEDPFT

SEQ ID NO: 18195 - protein, 450 aa, Artificial Sequence; identical to SEQ ID NO: 17805
  Description of Artificial Sequence: Synthetic polypeptide
  XENP020418 7G8_H3L2_IgG1_PVA_/S267K Heavy Chain

SEQ ID NO: 18196 - protein, 121 aa, Artificial Sequence; identical to SEQ ID NO: 17806
  Description of Artificial Sequence: Synthetic polypeptide
  VH of XENP020418

SEQ ID NO: 18197 - protein, 5 aa, Artificial Sequence
  Description of Artificial Sequence: Synthetic peptide
  XENP020418 vhCDR1
DAWMD

SEQ ID NO: 18198 - protein, 19 aa, Artificial Sequence
  Description of Artificial Sequence: Synthetic peptide
  XENP020418 vhCDR2
EIRTKANNHATYYAESVKG

SEQ ID NO: 18199 - protein, 10 aa, Artificial Sequence
  Description of Artificial Sequence: Synthetic peptide
  XENP020418 vhCDR3
LANWDWYFDV

SEQ ID NO: 18200 - protein, 218 aa, Artificial Sequence; identical to SEQ ID NO: 17610
  Description of Artificial Sequence: Synthetic polypeptide
  XENP020418 7G8_H3L2_IgG1_PVA_/S267K Light Chain

SEQ ID NO: 18201 - protein, 111 aa, Artificial Sequence; identical to SEQ ID NO: 17611
  Description of Artificial Sequence: Synthetic polypeptide
  VL of XENP020418

SEQ ID NO: 18202 - protein, 15 aa, Artificial Sequence
  Description of Artificial Sequence: Synthetic peptide
  XENP020418 vlCDR1
RASQSVDYDGDSYMN

SEQ ID NO: 18203 - protein, 7 aa, Artificial Sequence
  Description of Artificial Sequence: Synthetic peptide
  XENP020418 vlCDR2
AASNLES

SEQ ID NO: 18204 - protein, 9 aa, Artificial Sequence
  Description of Artificial Sequence: Synthetic peptide
  XENP020418 vlCDR3
QQSNEDPFT

SEQ ID NO: 18205 - protein, 450 aa, Artificial Sequence; identical to SEQ ID NO: 17805
  Description of Artificial Sequence: Synthetic polypeptide
  XENP020419 7G8_H3L3_IgG1_PVA_/S267K Heavy Chain

SEQ ID NO: 18206 - protein, 121 aa, Artificial Sequence; identical to SEQ ID NO: 17806
  Description of Artificial Sequence: Synthetic polypeptide
  VH of XENP020419

SEQ ID NO: 18207 - protein, 5 aa, Artificial Sequence
  Description of Artificial Sequence: Synthetic peptide
  XENP020419 vhCDR1
DAWMD

SEQ ID NO: 18208 - protein, 19 aa, Artificial Sequence
  Description of Artificial Sequence: Synthetic peptide
  XENP020419 vhCDR2
EIRTKANNHATYYAESVKG

SEQ ID NO: 18209 - protein, 10 aa, Artificial Sequence
  Description of Artificial Sequence: Synthetic peptide
  XENP020419 vhCDR3
LANWDWYFDV

SEQ ID NO: 18210 - protein, 218 aa, Artificial Sequence; identical to SEQ ID NO: 17620
  Description of Artificial Sequence: Synthetic polypeptide
  XENP020419 7G8_H3L3_IgG1_PVA_/S267K Light Chain

SEQ ID NO: 18211 - protein, 111 aa, Artificial Sequence; identical to SEQ ID NO: 17621
  Description of Artificial Sequence: Synthetic polypeptide
  VL of XENP020419

SEQ ID NO: 18212 - protein, 15 aa, Artificial Sequence
  Description of Artificial Sequence: Synthetic peptide
  XENP020419 vlCDR1
KASQSVDYDGDSYMN

SEQ ID NO: 18213 - protein, 7 aa, Artificial Sequence
  Description of Artificial Sequence: Synthetic peptide
  XENP020419 vlCDR2
AASNLES

SEQ ID NO: 18214 - protein, 9 aa, Artificial Sequence
  Description of Artificial Sequence: Synthetic peptide
  XENP020419 vlCDR3
QQSNEDPFT

SEQ ID NO: 18215 - protein, 450 aa, Artificial Sequence
  Description of Artificial Sequence: Synthetic polypeptide
  XENP020449 7G8_H0.1_L0_IgG1_PVA_/S267K Heavy Chain
EVKLEESGGGLVQPGGSMKLSCAASGYTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18216 - protein, 121 aa, Artificial Sequence
  Description of Artificial Sequence: Synthetic polypeptide
  VH of XENP020449
EVKLEESGGGLVQPGGSMKLSCAASGYTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18217 - protein, 5 aa, Artificial Sequence
  Description of Artificial Sequence: Synthetic peptide
  XENP020449 vhCDR1
DAWMD

SEQ ID NO: 18218 - protein, 19 aa, Artificial Sequence
  Description of Artificial Sequence: Synthetic peptide
  XENP020449 vhCDR2
EIRTKANNHATYYAESVKG

SEQ ID NO: 18219 - protein, 10 aa, Artificial Sequence
  Description of Artificial Sequence: Synthetic peptide
  XENP020449 vhCDR3
LANWDWYFDV

SEQ ID NO: 18220 - protein, 218 aa, Artificial Sequence; identical to SEQ ID NO: 17590
  Description of Artificial Sequence: Synthetic polypeptide
  XENP020449 7G8_H0.1_L0_IgG1_PVA_/S267K Light Chain

SEQ ID NO: 18221 - protein, 111 aa, Artificial Sequence; identical to SEQ ID NO: 17591
  Description of Artificial Sequence: Synthetic polypeptide
  VL of XENP020449

SEQ ID NO: 18222 - protein, 15 aa, Artificial Sequence
  Description of Artificial Sequence: Synthetic peptide
  XENP020449 vlCDR1
KASQSVDYDGDSYMN

SEQ ID NO: 18223 - protein, 7 aa, Artificial Sequence
  Description of Artificial Sequence: Synthetic peptide
  XENP020449 vlCDR2
AASNLES

SEQ ID NO: 18224 - protein, 9 aa, Artificial Sequence
  Description of Artificial Sequence: Synthetic peptide
  XENP020449 vlCDR3
QQSNEDPFT

SEQ ID NO: 18225 - protein, 450 aa, Artificial Sequence
  Description of Artificial Sequence: Synthetic polypeptide
  XENP020450 7G8_H0.2_L0_IgG1_PVA_/S267K Heavy Chain
EVKLEESGGGLVQPGGSMKLSCAASGGTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18226 - protein, 121 aa, Artificial Sequence
  Description of Artificial Sequence: Synthetic polypeptide
  VH of XENP020450
EVKLEESGGGLVQPGGSMKLSCAASGGTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18227 - protein, 5 aa, Artificial Sequence
  Description of Artificial Sequence: Synthetic peptide
  XENP020450 vhCDR1
DAWMD

SEQ ID NO: 18228 - protein, 19 aa, Artificial Sequence
  Description of Artificial Sequence: Synthetic peptide
  XENP020450 vhCDR2
EIRTKANNHATYYAESVKG

SEQ ID NO: 18229 - protein, 10 aa, Artificial Sequence
  Description of Artificial Sequence: Synthetic peptide
  XENP020450 vhCDR3
LANWDWYFDV

SEQ ID NO: 18230 - protein, 218 aa, Artificial Sequence; identical to SEQ ID NO: 17590
  Description of Artificial Sequence: Synthetic polypeptide
  XENP020450 7G8_H0.2_L0_IgG1_PVA_/S267K Light Chain

SEQ ID NO: 18231 - protein, 111 aa, Artificial Sequence; identical to SEQ ID NO: 17591
  Description of Artificial Sequence: Synthetic polypeptide
  VL of XENP020450

SEQ ID NO: 18232 - protein, 15 aa, Artificial Sequence
  Description of Artificial Sequence: Synthetic peptide
  XENP020450 vlCDR1
KASQSVDYDGDSYMN

SEQ ID NO: 18233 - protein, 7 aa, Artificial Sequence
  Description of Artificial Sequence: Synthetic peptide
  XENP020450 vlCDR2
AASNLES

SEQ ID NO: 18234 - protein, 9 aa, Artificial Sequence
  Description of Artificial Sequence: Synthetic peptide
  XENP020450 vlCDR3
QQSNEDPFT

SEQ ID NO: 18235 - protein, 450 aa, Artificial Sequence
  Description of Artificial Sequence: Synthetic polypeptide
  XENP020451 7G8_H0.3_L0_IgG1_PVA_/S267K Heavy Chain
EVKLEESGGGLVQPGGSMKLSCAASGDTFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18236 - protein, 121 aa, Artificial Sequence
  Description of Artificial Sequence: Synthetic polypeptide
  VH of XENP020451
EVKLEESGGGLVQPGGSMKLSCAASGDTFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18237 - protein, 5 aa, Artificial Sequence
  Description of Artificial Sequence: Synthetic peptide
  XENP020451 vhCDR1
DAWMD

SEQ ID NO: 18238 - protein, 19 aa, Artificial Sequence
  Description of Artificial Sequence: Synthetic peptide
  XENP020451 vhCDR2
EIRTKANNHATYYAESVKG

SEQ ID NO: 18239 - protein, 10 aa, Artificial Sequence
  Description of Artificial Sequence: Synthetic peptide
  XENP020451 vhCDR3
LANWDWYFDV

SEQ ID NO: 18240 - protein, 218 aa, Artificial Sequence; identical to SEQ ID NO: 17590
  Description of Artificial Sequence: Synthetic polypeptide
  XENP020451 7G8_H0.3_L0_IgG1_PVA_/S267K Light Chain

SEQ ID NO: 18241 - protein, 111 aa, Artificial Sequence; identical to SEQ ID NO: 17591
  Description of Artificial Sequence: Synthetic polypeptide
  VL of XENP020451

SEQ ID NO: 18242 - protein, 15 aa, Artificial Sequence
  Description of Artificial Sequence: Synthetic peptide
  XENP020451 vlCDR1
KASQSVDYDGDSYMN

SEQ ID NO: 18243 - protein, 7 aa, Artificial Sequence
  Description of Artificial Sequence: Synthetic peptide
  XENP020451 vlCDR2
AASNLES

SEQ ID NO: 18244 - protein, 9 aa, Artificial Sequence
  Description of Artificial Sequence: Synthetic peptide
  XENP020451 vlCDR3
QQSNEDPFT

SEQ ID NO: 18245 - protein, 450 aa, Artificial Sequence
  Description of Artificial Sequence: Synthetic polypeptide
  XENP020452 7G8_H0.4_L0_IgG1_PVA_/S267K Heavy Chain
EVKLEESGGGLVQPGGSMKLSCAASGFSFSDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18246 - protein, 121 aa, Artificial Sequence
  Description of Artificial Sequence: Synthetic polypeptide
  VH of XENP020452
EVKLEESGGGLVQPGGSMKLSCAASGFSFSDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18247 - protein, 5 aa, Artificial Sequence
  Description of Artificial Sequence: Synthetic peptide
  XENP020452 vhCDR1
DAWMD

SEQ ID NO: 18248 - protein, 19 aa, Artificial Sequence
  Description of Artificial Sequence: Synthetic peptide
  XENP020452 vhCDR2
EIRTKANNHATYYAESVKG

SEQ ID NO: 18249 - protein, 10 aa, Artificial Sequence
  Description of Artificial Sequence: Synthetic peptide
  XENP020452 vhCDR3
LANWDWYFDV

SEQ ID NO: 18250 - protein, 218 aa, Artificial Sequence; identical to SEQ ID NO: 17590
  Description of Artificial Sequence: Synthetic polypeptide
  XENP020452 7G8_H0.4_L0_IgG1_PVA_/S267K Light Chain

SEQ ID NO: 18251 - protein, 111 aa, Artificial Sequence; identical to SEQ ID NO: 17591
  Description of Artificial Sequence: Synthetic polypeptide
  VL of XENP020452

SEQ ID NO: 18252 - protein, 15 aa, Artificial Sequence
  Description of Artificial Sequence: Synthetic peptide
  XENP020452 vlCDR1
KASQSVDYDGDSYMN

SEQ ID NO: 18253 - protein, 7 aa, Artificial Sequence
  Description of Artificial Sequence: Synthetic peptide
  XENP020452 vlCDR2
AASNLES

SEQ ID NO: 18254 - protein, 9 aa, Artificial Sequence
  Description of Artificial Sequence: Synthetic peptide
  XENP020452 vlCDR3
QQSNEDPFT

SEQ ID NO: 18255 - protein, 450 aa, Artificial Sequence
  Description of Artificial Sequence: Synthetic polypeptide
  XENP020453 7G8_H0.5_L0_IgG1_PVA_/S267K Heavy Chain
EVKLEESGGGLVQPGGSMKLSCAASGFTFTDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18256 - protein, 121 aa, Artificial Sequence
  Description of Artificial Sequence: Synthetic polypeptide
  VH of XENP020453
EVKLEESGGGLVQPGGSMKLSCAASGFTFTDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18257 - protein, 5 aa, Artificial Sequence
  Description of Artificial Sequence: Synthetic peptide
  XENP020453 vhCDR1
DAWMD

SEQ ID NO: 18258 - protein, 19 aa, Artificial Sequence
  Description of Artificial Sequence: Synthetic peptide
  XENP020453 vhCDR2
EIRTKANNHATYYAESVKG

SEQ ID NO: 18259 - protein, 10 aa, Artificial Sequence
  Description of Artificial Sequence: Synthetic peptide
  XENP020453 vhCDR3
LANWDWYFDV

SEQ ID NO: 18260 - protein, 218 aa, Artificial Sequence; identical to SEQ ID NO: 17590
  Description of Artificial Sequence: Synthetic polypeptide
  XENP020453 7G8_H0.5_L0_IgG1_PVA_/S267K Light Chain

SEQ ID NO: 18261 - protein, 111 aa, Artificial Sequence; identical to SEQ ID NO: 17591
  Description of Artificial Sequence: Synthetic polypeptide
  VL of XENP020453

SEQ ID NO: 18262 - protein, 15 aa, Artificial Sequence
  Description of Artificial Sequence: Synthetic peptide
  XENP020453 vlCDR1
KASQSVDYDGDSYMN

SEQ ID NO: 18263 - protein, 7 aa, Artificial Sequence
  Description of Artificial Sequence: Synthetic peptide
  XENP020453 vlCDR2
AASNLES

SEQ ID NO: 18264 - protein, 9 aa, Artificial Sequence
  Description of Artificial Sequence: Synthetic peptide
  XENP020453 vlCDR3
QQSNEDPFT

SEQ ID NO: 18265 - protein, 450 aa, Artificial Sequence
  Description of Artificial Sequence: Synthetic polypeptide
  XENP020454 7G8_H0.6_L0_IgG1_PVA_/S267K Heavy Chain
EVKLEESGGGLVQPGGSMKLSCAASGFTFDDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18266 - protein, 121 aa, Artificial Sequence
  Description of Artificial Sequence: Synthetic polypeptide
  VH of XENP020454
EVKLEESGGGLVQPGGSMKLSCAASGFTFDDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18267 - protein, 5 aa, Artificial Sequence
  Description of Artificial Sequence: Synthetic peptide
  XENP020454 vhCDR1
DAWMD

SEQ ID NO: 18268 - protein, 19 aa, Artificial Sequence
  Description of Artificial Sequence: Synthetic peptide
  XENP020454 vhCDR2
EIRTKANNHATYYAESVKG

SEQ ID NO: 18269 - protein, 10 aa, Artificial Sequence
  Description of Artificial Sequence: Synthetic peptide
  XENP020454 vhCDR3
LANWDWYFDV

SEQ ID NO: 18270 - protein, 218 aa, Artificial Sequence; identical to SEQ ID NO: 17590
  Description of Artificial Sequence: Synthetic polypeptide
  XENP020454 7G8_H0.6_L0_IgG1_PVA_/S267K Light Chain

SEQ ID NO: 18271 - protein, 111 aa, Artificial Sequence; identical to SEQ ID NO: 17591
  Description of Artificial Sequence: Synthetic polypeptide
  VL of XENP020454

SEQ ID NO: 18272 - protein, 15 aa, Artificial Sequence
  Description of Artificial Sequence: Synthetic peptide
  XENP020454 vlCDR1
KASQSVDYDGDSYMN

SEQ ID NO: 18273 - protein, 7 aa, Artificial Sequence
  Description of Artificial Sequence: Synthetic peptide
  XENP020454 vlCDR2
AASNLES

SEQ ID NO: 18274 - protein, 9 aa, Artificial Sequence
  Description of Artificial Sequence: Synthetic peptide
  XENP020454 vlCDR3
QQSNEDPFT

SEQ ID NO: 18275 - protein, 450 aa, Artificial Sequence
  Description of Artificial Sequence: Synthetic polypeptide
  XENP020455 7G8_H0.7_L0_IgG1_PVA_/S267K Heavy Chain
EVKLEESGGGLVQPGGSMKLSCAASGFTFGDAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18276 - protein, 121 aa, Artificial Sequence
  Description of Artificial Sequence: Synthetic polypeptide
  VH of XENP020455
EVKLEESGGGLVQPGGSMKLSCAASGFTFGDAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18277 - protein, 5 aa, Artificial Sequence
  Description of Artificial Sequence: Synthetic peptide
  XENP020455 vhCDR1
DAWMD

SEQ ID NO: 18278 - protein, 19 aa, Artificial Sequence
  Description of Artificial Sequence: Synthetic peptide
  XENP020455 vhCDR2
EIRTKANNHATYYAESVKG

SEQ ID NO: 18279 - protein, 10 aa, Artificial Sequence
  Description of Artificial Sequence: Synthetic peptide
  XENP020455 vhCDR3
LANWDWYFDV

SEQ ID NO: 18280 - protein, 218 aa, Artificial Sequence; identical to SEQ ID NO: 17590
  Description of Artificial Sequence: Synthetic polypeptide
  XENP020455 7G8_H0.7_L0_IgG1_PVA_/S267K Light Chain

SEQ ID NO: 18281 - protein, 111 aa, Artificial Sequence; identical to SEQ ID NO: 17591
  Description of Artificial Sequence: Synthetic polypeptide
  VL of XENP020455

SEQ ID NO: 18282 - protein, 15 aa, Artificial Sequence
  Description of Artificial Sequence: Synthetic peptide
  XENP020455 vlCDR1
KASQSVDYDGDSYMN

SEQ ID NO: 18283 - protein, 7 aa, Artificial Sequence
  Description of Artificial Sequence: Synthetic peptide
  XENP020455 vlCDR2
AASNLES

SEQ ID NO: 18284 - protein, 9 aa, Artificial Sequence
  Description of Artificial Sequence: Synthetic peptide
  XENP020455 vlCDR3
QQSNEDPFT

SEQ ID NO: 18285 - protein, 450 aa, Artificial Sequence
  Description of Artificial Sequence: Synthetic polypeptide
  XENP020456 7G8_H0.8_L0_IgG1_PVA_/S267K Heavy Chain
EVKLEESGGGLVQPGGSMKLSCAASGFTFSNAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18286 - protein, 121 aa, Artificial Sequence
  Description of Artificial Sequence: Synthetic polypeptide
  VH of XENP020456
EVKLEESGGGLVQPGGSMKLSCAASGFTFSNAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18287 - protein, 5 aa, Artificial Sequence
  Description of Artificial Sequence: Synthetic peptide
  XENP020456 vhCDR1
NAWMD

SEQ ID NO: 18288 - protein, 19 aa, Artificial Sequence
  Description of Artificial Sequence: Synthetic peptide
  XENP020456 vhCDR2
EIRTKANNHATYYAESVKG

SEQ ID NO: 18289 - protein, 10 aa, Artificial Sequence
  Description of Artificial Sequence: Synthetic peptide
  XENP020456 vhCDR3
LANWDWYFDV

SEQ ID NO: 18290 - protein, 218 aa, Artificial Sequence; identical to SEQ ID NO: 17590
  Description of Artificial Sequence: Synthetic polypeptide
  XENP020456 7G8_H0.8_L0_IgG1_PVA_/S267K Light Chain

SEQ ID NO: 18291 - protein, 111 aa, Artificial Sequence; identical to SEQ ID NO: 17591
  Description of Artificial Sequence: Synthetic polypeptide
  VL of XENP020456

SEQ ID NO: 18292 - protein, 15 aa, Artificial Sequence
  Description of Artificial Sequence: Synthetic peptide
  XENP020456 vlCDR1
KASQSVDYDGDSYMN

SEQ ID NO: 18293 - protein, 7 aa, Artificial Sequence
  Description of Artificial Sequence: Synthetic peptide
  XENP020456 vlCDR2
AASNLES

SEQ ID NO: 18294 - protein, 9 aa, Artificial Sequence
  Description of Artificial Sequence: Synthetic peptide
  XENP020456 vlCDR3
QQSNEDPFT

SEQ ID NO: 18295 - protein, 450 aa, Artificial Sequence
  Description of Artificial Sequence: Synthetic polypeptide
  XENP020457 7G8_H0.9_L0_IgG1_PVA_/S267K Heavy Chain
EVKLEESGGGLVQPGGSMKLSCAASGFTFSEAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18296 - protein, 121 aa, Artificial Sequence
  Description of Artificial Sequence: Synthetic polypeptide
  VH of XENP020457
EVKLEESGGGLVQPGGSMKLSCAASGFTFSEAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18297 - protein, 5 aa, Artificial Sequence
  Description of Artificial Sequence: Synthetic peptide
  XENP020457 vhCDR1
EAWMD

SEQ ID NO: 18298 - protein, 19 aa, Artificial Sequence
  Description of Artificial Sequence: Synthetic peptide
  XENP020457 vhCDR2
EIRTKANNHATYYAESVKG

SEQ ID NO: 18299 - protein, 10 aa, Artificial Sequence
  Description of Artificial Sequence: Synthetic peptide
  XENP020457 vhCDR3
LANWDWYFDV

SEQ ID NO: 18300 - protein, 218 aa, Artificial Sequence; identical to SEQ ID NO: 17590
  Description of Artificial Sequence: Synthetic polypeptide
  XENP020457 7G8_H0.9_L0_IgG1_PVA_/S267K Light Chain

SEQ ID NO: 18301 - protein, 111 aa, Artificial Sequence; identical to SEQ ID NO: 17591
  Description of Artificial Sequence: Synthetic polypeptide
  VL of XENP020457

SEQ ID NO: 18302 - protein, 15 aa, Artificial Sequence
  Description of Artificial Sequence: Synthetic peptide
  XENP020457 vlCDR1
KASQSVDYDGDSYMN

SEQ ID NO: 18303 - protein, 7 aa, Artificial Sequence
  Description of Artificial Sequence: Synthetic peptide
  XENP020457 vlCDR2
AASNLES

SEQ ID NO: 18304 - protein, 9 aa, Artificial Sequence
  Description of Artificial Sequence: Synthetic peptide
  XENP020457 vlCDR3
QQSNEDPFT

SEQ ID NO: 18305 - protein, 450 aa, Artificial Sequence
  Description of Artificial Sequence: Synthetic polypeptide
  XENP020458 7G8_H0.10_L0_IgG1_PVA_/S267K Heavy Chain
EVKLEESGGGLVQPGGSMKLSCAASGFTFSHAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18306 - protein, 121 aa, Artificial Sequence
  Description of Artificial Sequence: Synthetic polypeptide
  VH of XENP020458
EVKLEESGGGLVQPGGSMKLSCAASGFTFSHAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18307 - protein, 5 aa, Artificial Sequence
  Description of Artificial Sequence: Synthetic peptide
  XENP020458 vhCDR1
HAWMD

SEQ ID NO: 18308 - protein, 19 aa, Artificial Sequence
  Description of Artificial Sequence: Synthetic peptide
  XENP020458 vhCDR2
EIRTKANNHATYYAESVKG

SEQ ID NO: 18309 - protein, 10 aa, Artificial Sequence
  Description of Artificial Sequence: Synthetic peptide
  XENP020458 vhCDR3
LANWDWYFDV

SEQ ID NO: 18310 - protein, 218 aa, Artificial Sequence; identical to SEQ ID NO: 17590
  Description of Artificial Sequence: Synthetic polypeptide
  XENP020458 7G8_H0.10_L0_IgG1_PVA_/S267K Light Chain

SEQ ID NO: 18311 - protein, 111 aa, Artificial Sequence; identical to SEQ ID NO: 17591
  Description of Artificial Sequence: Synthetic polypeptide
  VL of XENP020458

SEQ ID NO: 18312 - protein, 15 aa, Artificial Sequence
  Description of Artificial Sequence: Synthetic peptide
  XENP020458 vlCDR1
KASQSVDYDGDSYMN

SEQ ID NO: 18313 - protein, 7 aa, Artificial Sequence
  Description of Artificial Sequence: Synthetic peptide
  XENP020458 vlCDR2
AASNLES

SEQ ID NO: 18314 - protein, 9 aa, Artificial Sequence
  Description of Artificial Sequence: Synthetic peptide
  XENP020458 vlCDR3
QQSNEDPFT

SEQ ID NO: 18315 - protein, 450 aa, Artificial Sequence
  Description of Artificial Sequence: Synthetic polypeptide
  XENP020459 7G8_H0.11_L0_IgG1_PVA_/S267K Heavy Chain
EVKLEESGGGLVQPGGSMKLSCAASGFTFSSAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18316 - protein, 121 aa, Artificial Sequence
  Description of Artificial Sequence: Synthetic polypeptide
  VH of XENP020459
EVKLEESGGGLVQPGGSMKLSCAASGFTFSSAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18317 - protein, 5 aa, Artificial Sequence
  Description of Artificial Sequence: Synthetic peptide
  XENP020459 vhCDR1
SAWMD

SEQ ID NO: 18318 - protein, 19 aa, Artificial Sequence
  Description of Artificial Sequence: Synthetic peptide
  XENP020459 vhCDR2
EIRTKANNHATYYAESVKG

SEQ ID NO: 18319 - protein, 10 aa, Artificial Sequence
  Description of Artificial Sequence: Synthetic peptide
  XENP020459 vhCDR3
LANWDWYFDV

SEQ ID NO: 18320 - protein, 218 aa, Artificial Sequence; identical to SEQ ID NO: 17590
  Description of Artificial Sequence: Synthetic polypeptide
  XENP020459 7G8_H0.11_L0_IgG1_PVA_/S267K Light Chain

SEQ ID NO: 18321 - protein, 111 aa, Artificial Sequence; identical to SEQ ID NO: 17591
  Description of Artificial Sequence: Synthetic polypeptide
  VL of XENP020459

SEQ ID NO: 18322 - protein, 15 aa, Artificial Sequence
  Description of Artificial Sequence: Synthetic peptide
  XENP020459 vlCDR1
KASQSVDYDGDSYMN

SEQ ID NO: 18323 - protein, 7 aa, Artificial Sequence
  Description of Artificial Sequence: Synthetic peptide
  XENP020459 vlCDR2
AASNLES

SEQ ID NO: 18324 - protein, 9 aa, Artificial Sequence
  Description of Artificial Sequence: Synthetic peptide
  XENP020459 vlCDR3
QQSNEDPFT

SEQ ID NO: 18325 - protein, 450 aa, Artificial Sequence
  Description of Artificial Sequence: Synthetic polypeptide
  XENP020460 7G8_H0.12_L0_IgG1_PVA_/S267K Heavy Chain
EVKLEESGGGLVQPGGSMKLSCAASGFTFSRAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18326 - protein, 121 aa, Artificial Sequence
  Description of Artificial Sequence: Synthetic polypeptide
  VH of XENP020460
EVKLEESGGGLVQPGGSMKLSCAASGFTFSRAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18327 - protein, 5 aa, Artificial Sequence
  Description of Artificial Sequence: Synthetic peptide
  XENP020460 vhCDR1
RAWMD

SEQ ID NO: 18328 - protein, 19 aa, Artificial Sequence
  Description of Artificial Sequence: Synthetic peptide
  XENP020460 vhCDR2
EIRTKANNHATYYAESVKG

SEQ ID NO: 18329 - protein, 10 aa, Artificial Sequence
  Description of Artificial Sequence: Synthetic peptide
  XENP020460 vhCDR3
LANWDWYFDV

SEQ ID NO: 18330 - protein, 218 aa, Artificial Sequence; identical to SEQ ID NO: 17590
  Description of Artificial Sequence: Synthetic polypeptide
  XENP020460 7G8_H0.12_L0_IgG1_PVA_/S267K Light Chain

SEQ ID NO: 18331 - protein, 111 aa, Artificial Sequence; identical to SEQ ID NO: 17591
  Description of Artificial Sequence: Synthetic polypeptide
  VL of XENP020460

SEQ ID NO: 18332 - protein, 15 aa, Artificial Sequence
  Description of Artificial Sequence: Synthetic peptide
  XENP020460 vlCDR1
KASQSVDYDGDSYMN

SEQ ID NO: 18333 - protein, 7 aa, Artificial Sequence
  Description of Artificial Sequence: Synthetic peptide
  XENP020460 vlCDR2
AASNLES

SEQ ID NO: 18334 - protein, 9 aa, Artificial Sequence
  Description of Artificial Sequence: Synthetic peptide
  XENP020460 vlCDR3
QQSNEDPFT

SEQ ID NO: 18335 - protein, 450 aa, Artificial Sequence
  Description of Artificial Sequence: Synthetic polypeptide
  XENP020461 7G8_H0.13_L0_IgG1_PVA_/S267K Heavy Chain
EVKLEESGGGLVQPGGSMKLSCAASGFTFSLAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18336 - protein, 121 aa, Artificial Sequence
  Description of Artificial Sequence: Synthetic polypeptide
  VH of XENP020461
EVKLEESGGGLVQPGGSMKLSCAASGFTFSLAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18337 - protein, 5 aa, Artificial Sequence
  Description of Artificial Sequence: Synthetic peptide
  XENP020461 vhCDR1
LAWMD

SEQ ID NO: 18338 - protein, 19 aa, Artificial Sequence
  Description of Artificial Sequence: Synthetic peptide
  XENP020461 vhCDR2
EIRTKANNHATYYAESVKG

SEQ ID NO: 18339 - protein, 10 aa, Artificial Sequence
  Description of Artificial Sequence: Synthetic peptide
  XENP020461 vhCDR3
LANWDWYFDV

SEQ ID NO: 18340 - protein, 218 aa, Artificial Sequence; identical to SEQ ID NO: 17590
  Description of Artificial Sequence: Synthetic polypeptide
  XENP020461 7G8_H0.13_L0_IgG1_PVA_/S267K Light Chain

SEQ ID NO: 18341 - protein, 111 aa, Artificial Sequence; identical to SEQ ID NO: 17591
  Description of Artificial Sequence: Synthetic polypeptide
  VL of XENP020461

SEQ ID NO: 18342 - protein, 15 aa, Artificial Sequence
  Description of Artificial Sequence: Synthetic peptide
  XENP020461 vlCDR1
KASQSVDYDGDSYMN

SEQ ID NO: 18343 - protein, 7 aa, Artificial Sequence
  Description of Artificial Sequence: Synthetic peptide
  XENP020461 vlCDR2
AASNLES

SEQ ID NO: 18344 - protein, 9 aa, Artificial Sequence
  Description of Artificial Sequence: Synthetic peptide
  XENP020461 vlCDR3
QQSNEDPFT

SEQ ID NO: 18345 - protein, 450 aa, Artificial Sequence
  Description of Artificial Sequence: Synthetic polypeptide
  XENP020462 7G8_H0.14_L0_IgG1_PVA_/S267K Heavy Chain
EVKLEESGGGLVQPGGSMKLSCAASGFTFSTAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18346 - protein, 121 aa, Artificial Sequence
  Description of Artificial Sequence: Synthetic polypeptide
  VH of XENP020462
EVKLEESGGGLVQPGGSMKLSCAASGFTFSTAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18347 - protein, 5 aa, Artificial Sequence
  Description of Artificial Sequence: Synthetic peptide
  XENP020462 vhCDR1
TAWMD

SEQ ID NO: 18348 - protein, 19 aa, Artificial Sequence
  Description of Artificial Sequence: Synthetic peptide
  XENP020462 vhCDR2
EIRTKANNHATYYAESVKG

SEQ ID NO: 18349 - protein, 10 aa, Artificial Sequence
  Description of Artificial Sequence: Synthetic peptide
  XENP020462 vhCDR3
LANWDWYFDV

SEQ ID NO: 18350 - protein, 218 aa, Artificial Sequence; identical to SEQ ID NO: 17590
  Description of Artificial Sequence: Synthetic polypeptide
  XENP020462 7G8_H0.14_L0_IgG1_PVA_/S267K Light Chain

SEQ ID NO: 18351 - protein, 111 aa, Artificial Sequence; identical to SEQ ID NO: 17591
  Description of Artificial Sequence: Synthetic polypeptide
  VL of XENP020462

SEQ ID NO: 18352 - protein, 15 aa, Artificial Sequence
  Description of Artificial Sequence: Synthetic peptide
  XENP020462 vlCDR1
KASQSVDYDGDSYMN

SEQ ID NO: 18353 - protein, 7 aa, Artificial Sequence
  Description of Artificial Sequence: Synthetic peptide
  XENP020462 vlCDR2
AASNLES

SEQ ID NO: 18354 - protein, 9 aa, Artificial Sequence
  Description of Artificial Sequence: Synthetic peptide
  XENP020462 vlCDR3
QQSNEDPFT

SEQ ID NO: 18355 - protein, 450 aa, Artificial Sequence
  Description of Artificial Sequence: Synthetic polypeptide
  XENP020463 7G8_H0.15_L0_IgG1_PVA_/S267K Heavy Chain
EVKLEESGGGLVQPGGSMKLSCAASGFTFSGAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18356 - protein, 121 aa, Artificial Sequence
  Description of Artificial Sequence: Synthetic polypeptide
  VH of XENP020463
EVKLEESGGGLVQPGGSMKLSCAASGFTFSGAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18357 - protein, 5 aa, Artificial Sequence
  Description of Artificial Sequence: Synthetic peptide
  XENP020463 vhCDR1
GAWMD

SEQ ID NO: 18358 - protein, 19 aa, Artificial Sequence
  Description of Artificial Sequence: Synthetic peptide
  XENP020463 vhCDR2
EIRTKANNHATYYAESVKG

SEQ ID NO: 18359 - protein, 10 aa, Artificial Sequence
  Description of Artificial Sequence: Synthetic peptide
  XENP020463 vhCDR3
LANWDWYFDV

SEQ ID NO: 18360 - protein, 218 aa, Artificial Sequence; identical to SEQ ID NO: 17590
  Description of Artificial Sequence: Synthetic polypeptide
  XENP020463 7G8_H0.15_L0_IgG1_PVA_/S267K Light Chain

SEQ ID NO: 18361 - protein, 111 aa, Artificial Sequence; identical to SEQ ID NO: 17591
  Description of Artificial Sequence: Synthetic polypeptide
  VL of XENP020463

SEQ ID NO: 18362 - protein, 15 aa, Artificial Sequence
  Description of Artificial Sequence: Synthetic peptide
  XENP020463 vlCDR1
KASQSVDYDGDSYMN

SEQ ID NO: 18363 - protein, 7 aa, Artificial Sequence
  Description of Artificial Sequence: Synthetic peptide
  XENP020463 vlCDR2
AASNLES

SEQ ID NO: 18364 - protein, 9 aa, Artificial Sequence
  Description of Artificial Sequence: Synthetic peptide
  XENP020463 vlCDR3
QQSNEDPFT

SEQ ID NO: 18365 - protein, 450 aa, Artificial Sequence
  Description of Artificial Sequence: Synthetic polypeptide
  XENP020464 7G8_H0.16_L0_IgG1_PVA_/S267K Heavy Chain
EVKLEESGGGLVQPGGSMKLSCAASGFTFSYAWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18366 - protein, 121 aa, Artificial Sequence
  Description of Artificial Sequence: Synthetic polypeptide
  VH of XENP020464
EVKLEESGGGLVQPGGSMKLSCAASGFTFSYAWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18367 - protein, 5 aa, Artificial Sequence
  Description of Artificial Sequence: Synthetic peptide
  XENP020464 vhCDR1
YAWMD

SEQ ID NO: 18368 - protein, 19 aa, Artificial Sequence
  Description of Artificial Sequence: Synthetic peptide
  XENP020464 vhCDR2
EIRTKANNHATYYAESVKG

SEQ ID NO: 18369 - protein, 10 aa, Artificial Sequence
  Description of Artificial Sequence: Synthetic peptide
  XENP020464 vhCDR3
LANWDWYFDV

SEQ ID NO: 18370 - protein, 218 aa, Artificial Sequence; identical to SEQ ID NO: 17590
  Description of Artificial Sequence: Synthetic polypeptide
  XENP020464 7G8_H0.16_L0_IgG1_PVA_/S267K Light Chain

SEQ ID NO: 18371 - protein, 111 aa, Artificial Sequence; identical to SEQ ID NO: 17591
  Description of Artificial Sequence: Synthetic polypeptide
  VL of XENP020464

SEQ ID NO: 18372 - protein, 15 aa, Artificial Sequence
  Description of Artificial Sequence: Synthetic peptide
  XENP020464 vlCDR1
KASQSVDYDGDSYMN

SEQ ID NO: 18373 - protein, 7 aa, Artificial Sequence
  Description of Artificial Sequence: Synthetic peptide
  XENP020464 vlCDR2
AASNLES

SEQ ID NO: 18374 - protein, 9 aa, Artificial Sequence
  Description of Artificial Sequence: Synthetic peptide
  XENP020464 vlCDR3
QQSNEDPFT

SEQ ID NO: 18375 - protein, 450 aa, Artificial Sequence
  Description of Artificial Sequence: Synthetic polypeptide
  XENP020465 7G8_H0.17_L0_IgG1_PVA_/S267K Heavy Chain
EVKLEESGGGLVQPGGSMKLSCAASGFTFSDSWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18376 - protein, 121 aa, Artificial Sequence
  Description of Artificial Sequence: Synthetic polypeptide
  VH of XENP020465
EVKLEESGGGLVQPGGSMKLSCAASGFTFSDSWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18377 - protein, 5 aa, Artificial Sequence
  Description of Artificial Sequence: Synthetic peptide
  XENP020465 vhCDR1
DSWMD

SEQ ID NO: 18378 - protein, 19 aa, Artificial Sequence
  Description of Artificial Sequence: Synthetic peptide
  XENP020465 vhCDR2
EIRTKANNHATYYAESVKG

SEQ ID NO: 18379 - protein, 10 aa, Artificial Sequence
  Description of Artificial Sequence: Synthetic peptide
  XENP020465 vhCDR3
LANWDWYFDV

SEQ ID NO: 18380 - protein, 218 aa, Artificial Sequence; identical to SEQ ID NO: 17590
  Description of Artificial Sequence: Synthetic polypeptide
  XENP020465 7G8_H0.17_L0_IgG1_PVA_/S267K Light Chain

SEQ ID NO: 18381 - protein, 111 aa, Artificial Sequence; identical to SEQ ID NO: 17591
  Description of Artificial Sequence: Synthetic polypeptide
  VL of XENP020465

SEQ ID NO: 18382 - protein, 15 aa, Artificial Sequence
  Description of Artificial Sequence: Synthetic peptide
  XENP020465 vlCDR1
KASQSVDYDGDSYMN

SEQ ID NO: 18383 - protein, 7 aa, Artificial Sequence
  Description of Artificial Sequence: Synthetic peptide
  XENP020465 vlCDR2
AASNLES

SEQ ID NO: 18384 - protein, 9 aa, Artificial Sequence
  Description of Artificial Sequence: Synthetic peptide
  XENP020465 vlCDR3
QQSNEDPFT

SEQ ID NO: 18385 - protein, 450 aa, Artificial Sequence
  Description of Artificial Sequence: Synthetic polypeptide
  XENP020466 7G8_H0.18_L0_IgG1_PVA_/S267K Heavy Chain
EVKLEESGGGLVQPGGSMKLSCAASGFTFSDTWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18386 - protein, 121 aa, Artificial Sequence
  Description of Artificial Sequence: Synthetic polypeptide
  VH of XENP020466
EVKLEESGGGLVQPGGSMKLSCAASGFTFSDTWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18387 - protein, 5 aa, Artificial Sequence
  Description of Artificial Sequence: Synthetic peptide
  XENP020466 vhCDR1
DTWMD

SEQ ID NO: 18388 - protein, 19 aa, Artificial Sequence
  Description of Artificial Sequence: Synthetic peptide
  XENP020466 vhCDR2
EIRTKANNHATYYAESVKG

SEQ ID NO: 18389 - protein, 10 aa, Artificial Sequence
  Description of Artificial Sequence: Synthetic peptide
  XENP020466 vhCDR3
LANWDWYFDV

SEQ ID NO: 18390 - protein, 218 aa, Artificial Sequence; identical to SEQ ID NO: 17590
  Description of Artificial Sequence: Synthetic polypeptide
  XENP020466 7G8_H0.18_L0_IgG1_PVA_/S267K Light Chain

SEQ ID NO: 18391 - protein, 111 aa, Artificial Sequence; identical to SEQ ID NO: 17591
  Description of Artificial Sequence: Synthetic polypeptide
  VL of XENP020466

SEQ ID NO: 18392 - protein, 15 aa, Artificial Sequence
  Description of Artificial Sequence: Synthetic peptide
  XENP020466 vlCDR1
KASQSVDYDGDSYMN

SEQ ID NO: 18393 - protein, 7 aa, Artificial Sequence
  Description of Artificial Sequence: Synthetic peptide
  XENP020466 vlCDR2
AASNLES

SEQ ID NO: 18394 - protein, 9 aa, Artificial Sequence
  Description of Artificial Sequence: Synthetic peptide
  XENP020466 vlCDR3
QQSNEDPFT

SEQ ID NO: 18395 - protein, 450 aa, Artificial Sequence
  Description of Artificial Sequence: Synthetic polypeptide
  XENP020467 7G8_H0.19_L0_IgG1_PVA_/S267K Heavy Chain
EVKLEESGGGLVQPGGSMKLSCAASGFTFSDGWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18396 - protein, 121 aa, Artificial Sequence
  Description of Artificial Sequence: Synthetic polypeptide
  VH of XENP020467
EVKLEESGGGLVQPGGSMKLSCAASGFTFSDGWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18397 - protein, 5 aa, Artificial Sequence
  Description of Artificial Sequence: Synthetic peptide
  XENP020467 vhCDR1
DGWMD

SEQ ID NO: 18398 - protein, 19 aa, Artificial Sequence
  Description of Artificial Sequence: Synthetic peptide
  XENP020467 vhCDR2
EIRTKANNHATYYAESVKG

SEQ ID NO: 18399 - protein, 10 aa, Artificial Sequence
  Description of Artificial Sequence: Synthetic peptide
  XENP020467 vhCDR3
LANWDWYFDV

SEQ ID NO: 18400 - protein, 218 aa, Artificial Sequence; identical to SEQ ID NO: 17590
  Description of Artificial Sequence: Synthetic polypeptide
  XENP020467 7G8_H0.19_L0_IgG1_PVA_/S267K Light Chain

SEQ ID NO: 18401 - protein, 111 aa, Artificial Sequence; identical to SEQ ID NO: 17591
  Description of Artificial Sequence: Synthetic polypeptide
  VL of XENP020467

SEQ ID NO: 18402 - protein, 15 aa, Artificial Sequence
  Description of Artificial Sequence: Synthetic peptide
  XENP020467 vlCDR1
KASQSVDYDGDSYMN

SEQ ID NO: 18403 - protein, 7 aa, Artificial Sequence
  Description of Artificial Sequence: Synthetic peptide
  XENP020467 vlCDR2
AASNLES

SEQ ID NO: 18404 - protein, 9 aa, Artificial Sequence
  Description of Artificial Sequence: Synthetic peptide
  XENP020467 vlCDR3
QQSNEDPFT

SEQ ID NO: 18405 - protein, 450 aa, Artificial Sequence
  Description of Artificial Sequence: Synthetic polypeptide
  XENP020468 7G8_H0.20_L0_IgG1_PVA_/S267K Heavy Chain
EVKLEESGGGLVQPGGSMKLSCAASGFTFSDHWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18406 - protein, 121 aa, Artificial Sequence
  Description of Artificial Sequence: Synthetic polypeptide
  VH of XENP020468
EVKLEESGGGLVQPGGSMKLSCAASGFTFSDHWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18407 - protein, 5 aa, Artificial Sequence
  Description of Artificial Sequence: Synthetic peptide
  XENP020468 vhCDR1
DHWMD

SEQ ID NO: 18408 - protein, 19 aa, Artificial Sequence
  Description of Artificial Sequence: Synthetic peptide
  XENP020468 vhCDR2
EIRTKANNHATYYAESVKG

SEQ ID NO: 18409 - protein, 10 aa, Artificial Sequence
  Description of Artificial Sequence: Synthetic peptide
  XENP020468 vhCDR3
LANWDWYFDV

SEQ ID NO: 18410 - protein, 218 aa, Artificial Sequence; identical to SEQ ID NO: 17590
  Description of Artificial Sequence: Synthetic polypeptide
  XENP020468 7G8_H0.20_L0_IgG1_PVA_/S267K Light Chain

SEQ ID NO: 18411 - protein, 111 aa, Artificial Sequence; identical to SEQ ID NO: 17591
  Description of Artificial Sequence: Synthetic polypeptide
  VL of XENP020468

SEQ ID NO: 18412 - protein, 15 aa, Artificial Sequence
  Description of Artificial Sequence: Synthetic peptide
  XENP020468 vlCDR1
KASQSVDYDGDSYMN

SEQ ID NO: 18413 - protein, 7 aa, Artificial Sequence
  Description of Artificial Sequence: Synthetic peptide
  XENP020468 vlCDR2
AASNLES

SEQ ID NO: 18414 - protein, 9 aa, Artificial Sequence
  Description of Artificial Sequence: Synthetic peptide
  XENP020468 vlCDR3
QQSNEDPFT

SEQ ID NO: 18415 - protein, 450 aa, Artificial Sequence
  Description of Artificial Sequence: Synthetic polypeptide
  XENP020469 7G8_H0.21_L0_IgG1_PVA_/S267K Heavy Chain
EVKLEESGGGLVQPGGSMKLSCAASGFTFSDDWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18416 - protein, 121 aa, Artificial Sequence
  Description of Artificial Sequence: Synthetic polypeptide
  VH of XENP020469
EVKLEESGGGLVQPGGSMKLSCAASGFTFSDDWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18417 - protein, 5 aa, Artificial Sequence
  Description of Artificial Sequence: Synthetic peptide
  XENP020469 vhCDR1
DDWMD

SEQ ID NO: 18418 - protein, 19 aa, Artificial Sequence
  Description of Artificial Sequence: Synthetic peptide
  XENP020469 vhCDR2
EIRTKANNHATYYAESVKG

SEQ ID NO: 18419 - protein, 10 aa, Artificial Sequence
  Description of Artificial Sequence: Synthetic peptide
  XENP020469 vhCDR3
LANWDWYFDV

SEQ ID NO: 18420 - protein, 218 aa, Artificial Sequence; identical to SEQ ID NO: 17590
  Description of Artificial Sequence: Synthetic polypeptide
  XENP020469 7G8_H0.21_L0_IgG1_PVA_/S267K Light Chain

SEQ ID NO: 18421 - protein, 111 aa, Artificial Sequence; identical to SEQ ID NO: 17591
  Description of Artificial Sequence: Synthetic polypeptide
  VL of XENP020469

SEQ ID NO: 18422 - protein, 15 aa, Artificial Sequence
  Description of Artificial Sequence: Synthetic peptide
  XENP020469 vlCDR1
KASQSVDYDGDSYMN

SEQ ID NO: 18423 - protein, 7 aa, Artificial Sequence
  Description of Artificial Sequence: Synthetic peptide
  XENP020469 vlCDR2
AASNLES

SEQ ID NO: 18424 - protein, 9 aa, Artificial Sequence
  Description of Artificial Sequence: Synthetic peptide
  XENP020469 vlCDR3
QQSNEDPFT

SEQ ID NO: 18425 - protein, 450 aa, Artificial Sequence
  Description of Artificial Sequence: Synthetic polypeptide
  XENP020470 7G8_H0.22_L0_IgG1_PVA_/S267K Heavy Chain
EVKLEESGGGLVQPGGSMKLSCAASGFTFSDLWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18426 - protein, 121 aa, Artificial Sequence
  Description of Artificial Sequence: Synthetic polypeptide
  VH of XENP020470
EVKLEESGGGLVQPGGSMKLSCAASGFTFSDLWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18427 - protein, 5 aa, Artificial Sequence
  Description of Artificial Sequence: Synthetic peptide
  XENP020470 vhCDR1
DLWMD

SEQ ID NO: 18428 - protein, 19 aa, Artificial Sequence
  Description of Artificial Sequence: Synthetic peptide
  XENP020470 vhCDR2
EIRTKANNHATYYAESVKG

SEQ ID NO: 18429 - protein, 10 aa, Artificial Sequence
  Description of Artificial Sequence: Synthetic peptide
  XENP020470 vhCDR3
LANWDWYFDV

SEQ ID NO: 18430 - protein, 218 aa, Artificial Sequence; identical to SEQ ID NO: 17590
  Description of Artificial Sequence: Synthetic polypeptide
  XENP020470 7G8_H0.22_L0_IgG1_PVA_/S267K Light Chain

SEQ ID NO: 18431 - protein, 111 aa, Artificial Sequence; identical to SEQ ID NO: 17591
  Description of Artificial Sequence: Synthetic polypeptide
  VL of XENP020470

SEQ ID NO: 18432 - protein, 15 aa, Artificial Sequence
  Description of Artificial Sequence: Synthetic peptide
  XENP020470 vlCDR1
KASQSVDYDGDSYMN

SEQ ID NO: 18433 - protein, 7 aa, Artificial Sequence
  Description of Artificial Sequence: Synthetic peptide
  XENP020470 vlCDR2
AASNLES

SEQ ID NO: 18434 - protein, 9 aa, Artificial Sequence
  Description of Artificial Sequence: Synthetic peptide
  XENP020470 vlCDR3
QQSNEDPFT

SEQ ID NO: 18435 - protein, 450 aa, Artificial Sequence
  Description of Artificial Sequence: Synthetic polypeptide
  XENP020471 7G8_H0.23_L0_IgG1_PVA_/S267K Heavy Chain
EVKLEESGGGLVQPGGSMKLSCAASGFTFSDKWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18436 - protein, 121 aa, Artificial Sequence
  Description of Artificial Sequence: Synthetic polypeptide
  VH of XENP020471
EVKLEESGGGLVQPGGSMKLSCAASGFTFSDKWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18437 - protein, 5 aa, Artificial Sequence
  Description of Artificial Sequence: Synthetic peptide
  XENP020471 vhCDR1
DKWMD

SEQ ID NO: 18438 - protein, 19 aa, Artificial Sequence
  Description of Artificial Sequence: Synthetic peptide
  XENP020471 vhCDR2
EIRTKANNHATYYAESVKG

SEQ ID NO: 18439 - protein, 10 aa, Artificial Sequence
  Description of Artificial Sequence: Synthetic peptide
  XENP020471 vhCDR3
LANWDWYFDV

SEQ ID NO: 18440 - protein, 218 aa, Artificial Sequence; identical to SEQ ID NO: 17590
  Description of Artificial Sequence: Synthetic polypeptide
  XENP020471 7G8_H0.23_L0_IgG1_PVA_/S267K Light Chain

SEQ ID NO: 18441 - protein, 111 aa, Artificial Sequence; identical to SEQ ID NO: 17591
  Description of Artificial Sequence: Synthetic polypeptide
  VL of XENP020471

SEQ ID NO: 18442 - protein, 15 aa, Artificial Sequence
  Description of Artificial Sequence: Synthetic peptide
  XENP020471 vlCDR1
KASQSVDYDGDSYMN

SEQ ID NO: 18443 - protein, 7 aa, Artificial Sequence
  Description of Artificial Sequence: Synthetic peptide
  XENP020471 vlCDR2
AASNLES

SEQ ID NO: 18444 - protein, 9 aa, Artificial Sequence
  Description of Artificial Sequence: Synthetic peptide
  XENP020471 vlCDR3
QQSNEDPFT

SEQ ID NO: 18445 - protein, 450 aa, Artificial Sequence
  Description of Artificial Sequence: Synthetic polypeptide
  XENP020472 7G8_H0.24_L0_IgG1_PVA_/S267K Heavy Chain
EVKLEESGGGLVQPGGSMKLSCAASGFTFSDYWMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18446 - protein, 121 aa, Artificial Sequence
  Description of Artificial Sequence: Synthetic polypeptide
  VH of XENP020472
EVKLEESGGGLVQPGGSMKLSCAASGFTFSDYWMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18447 - protein, 5 aa, Artificial Sequence
  Description of Artificial Sequence: Synthetic peptide
  XENP020472 vhCDR1
DYWMD

SEQ ID NO: 18448 - protein, 19 aa, Artificial Sequence
  Description of Artificial Sequence: Synthetic peptide
  XENP020472 vhCDR2
EIRTKANNHATYYAESVKG

SEQ ID NO: 18449 - protein, 10 aa, Artificial Sequence
  Description of Artificial Sequence: Synthetic peptide
  XENP020472 vhCDR3
LANWDWYFDV

SEQ ID NO: 18450 - protein, 218 aa, Artificial Sequence; identical to SEQ ID NO: 17590
  Description of Artificial Sequence: Synthetic polypeptide
  XENP020472 7G8_H0.24_L0_IgG1_PVA_/S267K Light Chain

SEQ ID NO: 18451 - protein, 111 aa, Artificial Sequence; identical to SEQ ID NO: 17591
  Description of Artificial Sequence: Synthetic polypeptide
  VL of XENP020472

SEQ ID NO: 18452 - protein, 15 aa, Artificial Sequence
  Description of Artificial Sequence: Synthetic peptide
  XENP020472 vlCDR1
KASQSVDYDGDSYMN

SEQ ID NO: 18453 - protein, 7 aa, Artificial Sequence
  Description of Artificial Sequence: Synthetic peptide
  XENP020472 vlCDR2
AASNLES

SEQ ID NO: 18454 - protein, 9 aa, Artificial Sequence
  Description of Artificial Sequence: Synthetic peptide
  XENP020472 vlCDR3
QQSNEDPFT

SEQ ID NO: 18455 - protein, 450 aa, Artificial Sequence
  Description of Artificial Sequence: Synthetic polypeptide
  XENP020473 7G8_H0.25_L0_IgG1_PVA_/S267K Heavy Chain
EVKLEESGGGLVQPGGSMKLSCAASGFTFSDAYMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18456 - protein, 121 aa, Artificial Sequence
  Description of Artificial Sequence: Synthetic polypeptide
  VH of XENP020473
EVKLEESGGGLVQPGGSMKLSCAASGFTFSDAYMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18457 - protein, 5 aa, Artificial Sequence
  Description of Artificial Sequence: Synthetic peptide
  XENP020473 vhCDR1
DAYMD

SEQ ID NO: 18458 - protein, 19 aa, Artificial Sequence
  Description of Artificial Sequence: Synthetic peptide
  XENP020473 vhCDR2
EIRTKANNHATYYAESVKG

SEQ ID NO: 18459 - protein, 10 aa, Artificial Sequence
  Description of Artificial Sequence: Synthetic peptide
  XENP020473 vhCDR3
LANWDWYFDV

SEQ ID NO: 18460 - protein, 218 aa, Artificial Sequence; identical to SEQ ID NO: 17590
  Description of Artificial Sequence: Synthetic polypeptide
  XENP020473 7G8_H0.25_L0_IgG1_PVA_/S267K Light Chain

SEQ ID NO: 18461 - protein, 111 aa, Artificial Sequence; identical to SEQ ID NO: 17591
  Description of Artificial Sequence: Synthetic polypeptide
  VL of XENP020473

SEQ ID NO: 18462 - protein, 15 aa, Artificial Sequence
  Description of Artificial Sequence: Synthetic peptide
  XENP020473 vlCDR1
KASQSVDYDGDSYMN

SEQ ID NO: 18463 - protein, 7 aa, Artificial Sequence
  Description of Artificial Sequence: Synthetic peptide
  XENP020473 vlCDR2
AASNLES

SEQ ID NO: 18464 - protein, 9 aa, Artificial Sequence
  Description of Artificial Sequence: Synthetic peptide
  XENP020473 vlCDR3
QQSNEDPFT

SEQ ID NO: 18465 - protein, 450 aa, Artificial Sequence
  Description of Artificial Sequence: Synthetic polypeptide
  XENP020474 7G8_H0.26_L0_IgG1_PVA_/S267K Heavy Chain
EVKLEESGGGLVQPGGSMKLSCAASGFTFSDAFMDWVRQSPEKGLEWVAEIRTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18466 - protein, 121 aa, Artificial Sequence
  Description of Artificial Sequence: Synthetic polypeptide
  VH of XENP020474
EVKLEESGGGLVQPGGSMKLSCAASGFTFSDAFMDWVRQSPEKGLEWVAEIRTKANNHATYYAESVKGRFTISRDDSKSSVYLQMNSLRAEDTGIYYCTRLANWDWYFDVWGAGTTVTVSS

SEQ ID NO: 18467 - protein, 5 aa, Artificial Sequence
  Description of Artificial Sequence: Synthetic peptide
  XENP020474 vhCDR1
DAFMD

SEQ ID NO: 18468 - protein, 19 aa, Artificial Sequence
  Description of Artificial Sequence: Synthetic peptide
  XENP020474 vhCDR2
EIRTKANNHATYYAESVKG

SEQ ID NO: 18469 - protein, 10 aa, Artificial Sequence
  Description of Artificial Sequence: Synthetic peptide
  XENP020474 vhCDR3
LANWDWYFDV

SEQ ID NO: 18470 - protein, 218 aa, Artificial Sequence; identical to SEQ ID NO: 17590
  Description of Artificial Sequence: Synthetic polypeptide
  XENP020474 7G8_H0.26_L0_IgG1_PVA_/S267K Light Chain

SEQ ID NO: 18471 - protein, 111 aa, Artificial Sequence; identical to SEQ ID NO: 17591
  Description of Artificial Sequence: Synthetic polypeptide
  VL of XENP020474

SEQ ID NO: 18472 - protein, 15 aa, Artificial Sequence
  Description of Artificial Sequence: Synthetic peptide
  XENP020474 vlCDR1
KASQSVDYDGDSYMN

SEQ ID NO: 18473 - protein, 7 aa, Artificial Sequence
  Description of Artificial Sequence: Synthetic peptide
  XENP020474 vlCDR2
AASNLES

SEQ ID NO: 18474 - protein, 9 aa, Artificial Sequence
  Description of Artificial Sequence: Synthetic peptide
  XENP020474 vlCDR3
QQSNEDPFT

SEQ ID NO: 18475 - protein, 450 aa, Artificial Sequence
  Description of Artificial Sequence: Synthetic polypeptide
  XENP020475 7G8_H0.27_L0_IgG1_PVA_/S267K Heavy Chain
EVKLEESGGGLVQPGGSMKLSCAASGFTFSDAWMDWVRQSPEKGLEWVAEIKTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18476 - protein, 121 aa, Artificial Sequence
  Description of Artificial Sequence: Synthetic polypeptide
  VH of XENP020475
EVKLEESGGGLVQPGGSMKLSCAASGFTFSDAWMDWVRQSPEKGLEWVAEIKTKANNHATYYAESVKGRFTISRDDSKSSVYLQMNSLRAEDTGIYYCTRLANWDWYFDVWGAGTTVTVSS

SEQ ID NO: 18477 - protein, 5 aa, Artificial Sequence
  Description of Artificial Sequence: Synthetic peptide
  XENP020475 vhCDR1
DAWMD

SEQ ID NO: 18478 - protein, 19 aa, Artificial Sequence
  Description of Artificial Sequence: Synthetic peptide
  XENP020475 vhCDR2
EIKTKANNHATYYAESVKG

SEQ ID NO: 18479 - protein, 10 aa, Artificial Sequence
  Description of Artificial Sequence: Synthetic peptide
  XENP020475 vhCDR3
LANWDWYFDV

SEQ ID NO: 18480 - protein, 218 aa, Artificial Sequence; identical to SEQ ID NO: 17590
  Description of Artificial Sequence: Synthetic polypeptide
  XENP020475 7G8_H0.27_L0_IgG1_PVA_/S267K Light Chain

SEQ ID NO: 18481 - protein, 111 aa, Artificial Sequence; identical to SEQ ID NO: 17591
  Description of Artificial Sequence: Synthetic polypeptide
  VL of XENP020475

SEQ ID NO: 18482 - protein, 15 aa, Artificial Sequence
  Description of Artificial Sequence: Synthetic peptide
  XENP020475 vlCDR1
KASQSVDYDGDSYMN

SEQ ID NO: 18483 - protein, 7 aa, Artificial Sequence
  Description of Artificial Sequence: Synthetic peptide
  XENP020475 vlCDR2
AASNLES

SEQ ID NO: 18484 - protein, 9 aa, Artificial Sequence
  Description of Artificial Sequence: Synthetic peptide
  XENP020475 vlCDR3
QQSNEDPFT

SEQ ID NO: 18485 - protein, 450 aa, Artificial Sequence
  Description of Artificial Sequence: Synthetic polypeptide
  XENP020476 7G8_H0.28_L0_IgG1_PVA_/S267K Heavy Chain
EVKLEESGGGLVQPGGSMKLSCAASGFTFSDAWMDWVRQSPEKGLEWVAEIETKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18486 - protein, 121 aa, Artificial Sequence
  Description of Artificial Sequence: Synthetic polypeptide
  VH of XENP020476
EVKLEESGGGLVQPGGSMKLSCAASGFTFSDAWMDWVRQSPEKGLEWVAEIETKANNHATYYAESVKGRFTISRDDSKSSVYLQMNSLRAEDTGIYYCTRLANWDWYFDVWGAGTTVTVSS

SEQ ID NO: 18487 - protein, 5 aa, Artificial Sequence
  Description of Artificial Sequence: Synthetic peptide
  XENP020476 vhCDR1
DAWMD

SEQ ID NO: 18488 - protein, 19 aa, Artificial Sequence
  Description of Artificial Sequence: Synthetic peptide
  XENP020476 vhCDR2
EIETKANNHATYYAESVKG

SEQ ID NO: 18489 - protein, 10 aa, Artificial Sequence
  Description of Artificial Sequence: Synthetic peptide
  XENP020476 vhCDR3
LANWDWYFDV

SEQ ID NO: 18490 - protein, 218 aa, Artificial Sequence; identical to SEQ ID NO: 17590
  Description of Artificial Sequence: Synthetic polypeptide
  XENP020476 7G8_H0.28_L0_IgG1_PVA_/S267K Light Chain

SEQ ID NO: 18491 - protein, 111 aa, Artificial Sequence; identical to SEQ ID NO: 17591
  Description of Artificial Sequence: Synthetic polypeptide
  VL of XENP020476

SEQ ID NO: 18492 - protein, 15 aa, Artificial Sequence
  Description of Artificial Sequence: Synthetic peptide
  XENP020476 vlCDR1
KASQSVDYDGDSYMN

SEQ ID NO: 18493 - protein, 7 aa, Artificial Sequence
  Description of Artificial Sequence: Synthetic peptide
  XENP020476 vlCDR2
AASNLES

SEQ ID NO: 18494 - protein, 9 aa, Artificial Sequence
  Description of Artificial Sequence: Synthetic peptide
  XENP020476 vlCDR3
QQSNEDPFT

SEQ ID NO: 18495 - protein, 450 aa, Artificial Sequence
  Description of Artificial Sequence: Synthetic polypeptide
  XENP020477 7G8_H0.29_L0_IgG1_PVA_/S267K Heavy Chain
EVKLEESGGGLVQPGGSMKLSCAASGFTFSDAWMDWVRQSPEKGLEWVAEIDTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18496 - protein, 121 aa, Artificial Sequence
  Description of Artificial Sequence: Synthetic polypeptide
  VH of XENP020477
EVKLEESGGGLVQPGGSMKLSCAASGFTFSDAWMDWVRQSPEKGLEWVAEIDTKANNHATYYAESVKGRFTISRDDSKSSVYLQMNSLRAEDTGIYYCTRLANWDWYFDVWGAGTTVTVSS

SEQ ID NO: 18497 - protein, 5 aa, Artificial Sequence
  Description of Artificial Sequence: Synthetic peptide
  XENP020477 vhCDR1
DAWMD

SEQ ID NO: 18498 - protein, 19 aa, Artificial Sequence
  Description of Artificial Sequence: Synthetic peptide
  XENP020477 vhCDR2
EIDTKANNHATYYAESVKG

SEQ ID NO: 18499 - protein, 10 aa, Artificial Sequence
  Description of Artificial Sequence: Synthetic peptide
  XENP020477 vhCDR3
LANWDWYFDV

SEQ ID NO: 18500 - protein, 218 aa, Artificial Sequence; identical to SEQ ID NO: 17590
  Description of Artificial Sequence: Synthetic polypeptide
  XENP020477 7G8_H0.29_L0_IgG1_PVA_/S267K Light Chain

SEQ ID NO: 18501 - protein, 111 aa, Artificial Sequence; identical to SEQ ID NO: 17591
  Description of Artificial Sequence: Synthetic polypeptide
  VL of XENP020477

SEQ ID NO: 18502 - protein, 15 aa, Artificial Sequence
  Description of Artificial Sequence: Synthetic peptide
  XENP020477 vlCDR1
KASQSVDYDGDSYMN

SEQ ID NO: 18503 - protein, 7 aa, Artificial Sequence
  Description of Artificial Sequence: Synthetic peptide
  XENP020477 vlCDR2
AASNLES

SEQ ID NO: 18504 - protein, 9 aa, Artificial Sequence
  Description of Artificial Sequence: Synthetic peptide
  XENP020477 vlCDR3
QQSNEDPFT

SEQ ID NO: 18505 - protein, 450 aa, Artificial Sequence
  Description of Artificial Sequence: Synthetic polypeptide
  XENP020478 7G8_H0.30_L0_IgG1_PVA_/S267K Heavy Chain
EVKLEESGGGLVQPGGSMKLSCAASGFTFSDAWMDWVRQSPEKGLEWVAEIHTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18506 - protein, 121 aa, Artificial Sequence
  Description of Artificial Sequence: Synthetic polypeptide
  VH of XENP020478
EVKLEESGGGLVQPGGSMKLSCAASGFTFSDAWMDWVRQSPEKGLEWVAEIHTKANNHATYYAESVKGRFTISRDDSKSSVYLQMNSLRAEDTGIYYCTRLANWDWYFDVWGAGTTVTVSS

SEQ ID NO: 18507 - protein, 5 aa, Artificial Sequence
  Description of Artificial Sequence: Synthetic peptide
  XENP020478 vhCDR1
DAWMD

SEQ ID NO: 18508 - protein, 19 aa, Artificial Sequence
  Description of Artificial Sequence: Synthetic peptide
  XENP020478 vhCDR2
EIHTKANNHATYYAESVKG

SEQ ID NO: 18509 - protein, 10 aa, Artificial Sequence
  Description of Artificial Sequence: Synthetic peptide
  XENP020478 vhCDR3
LANWDWYFDV

SEQ ID NO: 18510 - protein, 218 aa, Artificial Sequence; identical to SEQ ID NO: 17590
  Description of Artificial Sequence: Synthetic polypeptide
  XENP020478 7G8_H0.30_L0_IgG1_PVA_/S267K Light Chain

SEQ ID NO: 18511 - protein, 111 aa, Artificial Sequence; identical to SEQ ID NO: 17591
  Description of Artificial Sequence: Synthetic polypeptide
  VL of XENP020478

SEQ ID NO: 18512 - protein, 15 aa, Artificial Sequence
  Description of Artificial Sequence: Synthetic peptide
  XENP020478 vlCDR1
KASQSVDYDGDSYMN

SEQ ID NO: 18513 - protein, 7 aa, Artificial Sequence
  Description of Artificial Sequence: Synthetic peptide
  XENP020478 vlCDR2
AASNLES

SEQ ID NO: 18514 - protein, 9 aa, Artificial Sequence
  Description of Artificial Sequence: Synthetic peptide
  XENP020478 vlCDR3
QQSNEDPFT

SEQ ID NO: 18515 - protein, 450 aa, Artificial Sequence
  Description of Artificial Sequence: Synthetic polypeptide
  XENP020479 7G8_H0.31_L0_IgG1_PVA_/S267K Heavy Chain
EVKLEESGGGLVQPGGSMKLSCAASGFTFSDAWMDWVRQSPEKGLEWVAEISTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18516 - protein, 121 aa, Artificial Sequence
  Description of Artificial Sequence: Synthetic polypeptide
  VH of XENP020479
EVKLEESGGGLVQPGGSMKLSCAASGFTFSDAWMDWVRQSPEKGLEWVAEISTKANNHATYYAESVKGRFTISRDDSKSSVYLQMNSLRAEDTGIYYCTRLANWDWYFDVWGAGTTVTVSS

SEQ ID NO: 18517 - protein, 5 aa, Artificial Sequence
  Description of Artificial Sequence: Synthetic peptide
  XENP020479 vhCDR1
DAWMD

SEQ ID NO: 18518 - protein, 19 aa, Artificial Sequence
  Description of Artificial Sequence: Synthetic peptide
  XENP020479 vhCDR2
EISTKANNHATYYAESVKG

SEQ ID NO: 18519 - protein, 10 aa, Artificial Sequence
  Description of Artificial Sequence: Synthetic peptide
  XENP020479 vhCDR3
LANWDWYFDV

SEQ ID NO: 18520 - protein, 218 aa, Artificial Sequence; identical to SEQ ID NO: 17590
  Description of Artificial Sequence: Synthetic polypeptide
  XENP020479 7G8_H0.31_L0_IgG1_PVA_/S267K Light Chain

SEQ ID NO: 18521 - protein, 111 aa, Artificial Sequence; identical to SEQ ID NO: 17591
  Description of Artificial Sequence: Synthetic polypeptide
  VL of XENP020479

SEQ ID NO: 18522 - protein, 15 aa, Artificial Sequence
  Description of Artificial Sequence: Synthetic peptide
  XENP020479 vlCDR1
KASQSVDYDGDSYMN

SEQ ID NO: 18523 - protein, 7 aa, Artificial Sequence
  Description of Artificial Sequence: Synthetic peptide
  XENP020479 vlCDR2
AASNLES

SEQ ID NO: 18524 - protein, 9 aa, Artificial Sequence
  Description of Artificial Sequence: Synthetic peptide
  XENP020479 vlCDR3
QQSNEDPFT

SEQ ID NO: 18525 - protein, 450 aa, Artificial Sequence
  Description of Artificial Sequence: Synthetic polypeptide
  XENP020480 7G8_H0.32_L0_IgG1_PVA_/S267K Heavy Chain
EVKLEESGGGLVQPGGSMKLSCAASGFTFSDAWMDWVRQSPEKGLEWVAEIGTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18526 - protein, 121 aa, Artificial Sequence
  Description of Artificial Sequence: Synthetic polypeptide
  VH of XENP020480
EVKLEESGGGLVQPGGSMKLSCAASGFTFSDAWMDWVRQSPEKGLEWVAEIGTKANNHATYYAESVKGRFTISRDDSKSSVYLQMNSLRAEDTGIYYCTRLANWDWYFDVWGAGTTVTVSS

SEQ ID NO: 18527 - protein, 5 aa, Artificial Sequence
  Description of Artificial Sequence: Synthetic peptide
  XENP020480 vhCDR1
DAWMD

SEQ ID NO: 18528 - protein, 19 aa, Artificial Sequence
  Description of Artificial Sequence: Synthetic peptide
  XENP020480 vhCDR2
EIGTKANNHATYYAESVKG

SEQ ID NO: 18529 - protein, 10 aa, Artificial Sequence
  Description of Artificial Sequence: Synthetic peptide
  XENP020480 vhCDR3
LANWDWYFDV

SEQ ID NO: 18530 - protein, 218 aa, Artificial Sequence; identical to SEQ ID NO: 17590
  Description of Artificial Sequence: Synthetic polypeptide
  XENP020480 7G8_H0.32_L0_IgG1_PVA_/S267K Light Chain

SEQ ID NO: 18531 - protein, 111 aa, Artificial Sequence; identical to SEQ ID NO: 17591
  Description of Artificial Sequence: Synthetic polypeptide
  VL of XENP020480

SEQ ID NO: 18532 - protein, 15 aa, Artificial Sequence
  Description of Artificial Sequence: Synthetic peptide
  XENP020480 vlCDR1
KASQSVDYDGDSYMN

SEQ ID NO: 18533 - protein, 7 aa, Artificial Sequence
  Description of Artificial Sequence: Synthetic peptide
  XENP020480 vlCDR2
AASNLES

SEQ ID NO: 18534 - protein, 9 aa, Artificial Sequence
  Description of Artificial Sequence: Synthetic peptide
  XENP020480 vlCDR3
QQSNEDPFT

SEQ ID NO: 18535 - protein, 450 aa, Artificial Sequence
  Description of Artificial Sequence: Synthetic polypeptide
  XENP020481 7G8_H0.33_L0_IgG1_PVA_/S267K Heavy Chain
EVKLEESGGGLVQPGGSMKLSCAASGFTFSDAWMDWVRQSPEKGLEWVAEIYTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18536 - protein, 121 aa, Artificial Sequence
  Description of Artificial Sequence: Synthetic polypeptide
  VH of XENP020481
EVKLEESGGGLVQPGGSMKLSCAASGFTFSDAWMDWVRQSPEKGLEWVAEIYTKANNHATYYAESVKGRFTISRDDSKSSVYLQMNSLRAEDTGIYYCTRLANWDWYFDVWGAGTTVTVSS

SEQ ID NO: 18537 - protein, 5 aa, Artificial Sequence
  Description of Artificial Sequence: Synthetic peptide
  XENP020481 vhCDR1
DAWMD

SEQ ID NO: 18538 - protein, 19 aa, Artificial Sequence
  Description of Artificial Sequence: Synthetic peptide
  XENP020481 vhCDR2
EIYTKANNHATYYAESVKG

SEQ ID NO: 18539 - protein, 10 aa, Artificial Sequence
  Description of Artificial Sequence: Synthetic peptide
  XENP020481 vhCDR3
LANWDWYFDV

SEQ ID NO: 18540 - protein, 218 aa, Artificial Sequence; identical to SEQ ID NO: 17590
  Description of Artificial Sequence: Synthetic polypeptide
  XENP020481 7G8_H0.33_L0_IgG1_PVA_/S267K Light Chain

SEQ ID NO: 18541 - protein, 111 aa, Artificial Sequence; identical to SEQ ID NO: 17591
  Description of Artificial Sequence: Synthetic polypeptide
  VL of XENP020481

SEQ ID NO: 18542 - protein, 15 aa, Artificial Sequence
  Description of Artificial Sequence: Synthetic peptide
  XENP020481 vlCDR1
KASQSVDYDGDSYMN

SEQ ID NO: 18543 - protein, 7 aa, Artificial Sequence
  Description of Artificial Sequence: Synthetic peptide
  XENP020481 vlCDR2
AASNLES

SEQ ID NO: 18544 - protein, 9 aa, Artificial Sequence
  Description of Artificial Sequence: Synthetic peptide
  XENP020481 vlCDR3
QQSNEDPFT

SEQ ID NO: 18545 - protein, 450 aa, Artificial Sequence
  Description of Artificial Sequence: Synthetic polypeptide
  XENP020482 7G8_H0.34_L0_IgG1_PVA_/S267K Heavy Chain
EVKLEESGGGLVQPGGSMKLSCAASGFTFSDAWMDWVRQSPEKGLEWVAEIITKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18546 - protein, 121 aa, Artificial Sequence
  Description of Artificial Sequence: Synthetic polypeptide
  VH of XENP020482
EVKLEESGGGLVQPGGSMKLSCAASGFTFSDAWMDWVRQSPEKGLEWVAEIITKANNHATYYAESVKGRFTISRDDSKSSVYLQMNSLRAEDTGIYYCTRLANWDWYFDVWGAGTTVTVSS

SEQ ID NO: 18547 - protein, 5 aa, Artificial Sequence
  Description of Artificial Sequence: Synthetic peptide
  XENP020482 vhCDR1
DAWMD

SEQ ID NO: 18548 - protein, 19 aa, Artificial Sequence
  Description of Artificial Sequence: Synthetic peptide
  XENP020482 vhCDR2
EIITKANNHATYYAESVKG

SEQ ID NO: 18549 - protein, 10 aa, Artificial Sequence
  Description of Artificial Sequence: Synthetic peptide
  XENP020482 vhCDR3
LANWDWYFDV

SEQ ID NO: 18550 - protein, 218 aa, Artificial Sequence; identical to SEQ ID NO: 17590
  Description of Artificial Sequence: Synthetic polypeptide
  XENP020482 7G8_H0.34_L0_IgG1_PVA_/S267K Light Chain

SEQ ID NO: 18551 - protein, 111 aa, Artificial Sequence; identical to SEQ ID NO: 17591
  Description of Artificial Sequence: Synthetic polypeptide
  VL of XENP020482

SEQ ID NO: 18552 - protein, 15 aa, Artificial Sequence
  Description of Artificial Sequence: Synthetic peptide
  XENP020482 vlCDR1
KASQSVDYDGDSYMN

SEQ ID NO: 18553 - protein, 7 aa, Artificial Sequence
  Description of Artificial Sequence: Synthetic peptide
  XENP020482 vlCDR2
AASNLES

SEQ ID NO: 18554 - protein, 9 aa, Artificial Sequence
  Description of Artificial Sequence: Synthetic peptide
  XENP020482 vlCDR3
QQSNEDPFT

SEQ ID NO: 18555 - protein, 450 aa, Artificial Sequence
  Description of Artificial Sequence: Synthetic polypeptide
  XENP020483 7G8_H0.35_L0_IgG1_PVA_/S267K Heavy Chain
EVKLEESGGGLVQPGGSMKLSCAASGFTFSDAWMDWVRQSPEKGLEWVAEIWTKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18556 - protein, 121 aa, Artificial Sequence
  Description of Artificial Sequence: Synthetic polypeptide
  VH of XENP020483
EVKLEESGGGLVQPGGSMKLSCAASGFTFSDAWMDWVRQSPEKGLEWVAEIWTKANNHATYYAESVKGRFTISRDDSKSSVYLQMNSLRAEDTGIYYCTRLANWDWYFDVWGAGTTVTVSS

SEQ ID NO: 18557 - protein, 5 aa, Artificial Sequence
  Description of Artificial Sequence: Synthetic peptide
  XENP020483 vhCDR1
DAWMD

SEQ ID NO: 18558 - protein, 19 aa, Artificial Sequence
  Description of Artificial Sequence: Synthetic peptide
  XENP020483 vhCDR2
EIWTKANNHATYYAESVKG

SEQ ID NO: 18559 - protein, 10 aa, Artificial Sequence
  Description of Artificial Sequence: Synthetic peptide
  XENP020483 vhCDR3
LANWDWYFDV

SEQ ID NO: 18560 - protein, 218 aa, Artificial Sequence; identical to SEQ ID NO: 17590
  Description of Artificial Sequence: Synthetic polypeptide
  XENP020483 7G8_H0.35_L0_IgG1_PVA_/S267K Light Chain

SEQ ID NO: 18561 - protein, 111 aa, Artificial Sequence; identical to SEQ ID NO: 17591
  Description of Artificial Sequence: Synthetic polypeptide
  VL of XENP020483

SEQ ID NO: 18562 - protein, 15 aa, Artificial Sequence
  Description of Artificial Sequence: Synthetic peptide
  XENP020483 vlCDR1
KASQSVDYDGDSYMN

SEQ ID NO: 18563 - protein, 7 aa, Artificial Sequence
  Description of Artificial Sequence: Synthetic peptide
  XENP020483 vlCDR2
AASNLES

SEQ ID NO: 18564 - protein, 9 aa, Artificial Sequence
  Description of Artificial Sequence: Synthetic peptide
  XENP020483 vlCDR3
QQSNEDPFT

SEQ ID NO: 18565 - protein, 450 aa, Artificial Sequence
  Description of Artificial Sequence: Synthetic polypeptide
  XENP020484 7G8_H0.36_L0_IgG1_PVA_/S267K Heavy Chain
EVKLEESGGGLVQPGGSMKLSCAASGFTFSDAWMDWVRQSPEKGLEWVAEIRVKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18566 - protein, 121 aa, Artificial Sequence
  Description of Artificial Sequence: Synthetic polypeptide
  VH of XENP020484
EVKLEESGGGLVQPGGSMKLSCAASGFTFSDAWMDWVRQSPEKGLEWVAEIRVKANNHATYYAESVKGRFTISRDDSKSSVYLQMNSLRAEDTGIYYCTRLANWDWYFDVWGAGTTVTVSS

SEQ ID NO: 18567 - protein, 5 aa, Artificial Sequence
  Description of Artificial Sequence: Synthetic peptide
  XENP020484 vhCDR1
DAWMD

SEQ ID NO: 18568 - protein, 19 aa, Artificial Sequence
  Description of Artificial Sequence: Synthetic peptide
  XENP020484 vhCDR2
EIRVKANNHATYYAESVKG

SEQ ID NO: 18569 - protein, 10 aa, Artificial Sequence
  Description of Artificial Sequence: Synthetic peptide
  XENP020484 vhCDR3
LANWDWYFDV

SEQ ID NO: 18570 - protein, 218 aa, Artificial Sequence; identical to SEQ ID NO: 17590
  Description of Artificial Sequence: Synthetic polypeptide
  XENP020484 7G8_H0.36_L0_IgG1_PVA_/S267K Light Chain

SEQ ID NO: 18571 - protein, 111 aa, Artificial Sequence; identical to SEQ ID NO: 17591
  Description of Artificial Sequence: Synthetic polypeptide
  VL of XENP020484

SEQ ID NO: 18572 - protein, 15 aa, Artificial Sequence
  Description of Artificial Sequence: Synthetic peptide
  XENP020484 vlCDR1
KASQSVDYDGDSYMN

SEQ ID NO: 18573 - protein, 7 aa, Artificial Sequence
  Description of Artificial Sequence: Synthetic peptide
  XENP020484 vlCDR2
AASNLES

SEQ ID NO: 18574 - protein, 9 aa, Artificial Sequence
  Description of Artificial Sequence: Synthetic peptide
  XENP020484 vlCDR3
QQSNEDPFT

SEQ ID NO: 18575 - protein, 450 aa, Artificial Sequence
  Description of Artificial Sequence: Synthetic polypeptide
  XENP020485 7G8_H0.37_L0_IgG1_PVA_/S267K Heavy Chain
EVKLEESGGGLVQPGGSMKLSCAASGFTFSDAWMDWVRQSPEKGLEWVAEIRSKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18576 - protein, 121 aa, Artificial Sequence
  Description of Artificial Sequence: Synthetic polypeptide
  VH of XENP020485
EVKLEESGGGLVQPGGSMKLSCAASGFTFSDAWMDWVRQSPEKGLEWVAEIRSKANNHATYYAESVKGRFTISRDDSKSSVYLQMNSLRAEDTGIYYCTRLANWDWYFDVWGAGTTVTVSS

SEQ ID NO: 18577 - protein, 5 aa, Artificial Sequence
  Description of Artificial Sequence: Synthetic peptide
  XENP020485 vhCDR1
DAWMD

SEQ ID NO: 18578 - protein, 19 aa, Artificial Sequence
  Description of Artificial Sequence: Synthetic peptide
  XENP020485 vhCDR2
EIRSKANNHATYYAESVKG

SEQ ID NO: 18579 - protein, 10 aa, Artificial Sequence
  Description of Artificial Sequence: Synthetic peptide
  XENP020485 vhCDR3
LANWDWYFDV

SEQ ID NO: 18580 - protein, 218 aa, Artificial Sequence; identical to SEQ ID NO: 17590
  Description of Artificial Sequence: Synthetic polypeptide
  XENP020485 7G8_H0.37_L0_IgG1_PVA_/S267K Light Chain

SEQ ID NO: 18581 - protein, 111 aa, Artificial Sequence; identical to SEQ ID NO: 17591
  Description of Artificial Sequence: Synthetic polypeptide
  VL of XENP020485

SEQ ID NO: 18582 - protein, 15 aa, Artificial Sequence
  Description of Artificial Sequence: Synthetic peptide
  XENP020485 vlCDR1
KASQSVDYDGDSYMN

SEQ ID NO: 18583 - protein, 7 aa, Artificial Sequence
  Description of Artificial Sequence: Synthetic peptide
  XENP020485 vlCDR2
AASNLES

SEQ ID NO: 18584 - protein, 9 aa, Artificial Sequence
  Description of Artificial Sequence: Synthetic peptide
  XENP020485 vlCDR3
QQSNEDPFT

SEQ ID NO: 18585 - protein, 450 aa, Artificial Sequence
  Description of Artificial Sequence: Synthetic polypeptide
  XENP020486 7G8_H0.38_L0_IgG1_PVA_/S267K Heavy Chain
EVKLEESGGGLVQPGGSMKLSCAASGFTFSDAWMDWVRQSPEKGLEWVAEIRAKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18586 - protein, 121 aa, Artificial Sequence
  Description of Artificial Sequence: Synthetic polypeptide
  VH of XENP020486
EVKLEESGGGLVQPGGSMKLSCAASGFTFSDAWMDWVRQSPEKGLEWVAEIRAKANNHATYYAESVKGRFTISRDDSKSSVYLQMNSLRAEDTGIYYCTRLANWDWYFDVWGAGTTVTVSS

SEQ ID NO: 18587 - protein, 5 aa, Artificial Sequence
  Description of Artificial Sequence: Synthetic peptide
  XENP020486 vhCDR1
DAWMD

SEQ ID NO: 18588 - protein, 19 aa, Artificial Sequence
  Description of Artificial Sequence: Synthetic peptide
  XENP020486 vhCDR2
EIRAKANNHATYYAESVKG

SEQ ID NO: 18589 - protein, 10 aa, Artificial Sequence
  Description of Artificial Sequence: Synthetic peptide
  XENP020486 vhCDR3
LANWDWYFDV

SEQ ID NO: 18590 - protein, 218 aa, Artificial Sequence; identical to SEQ ID NO: 17590
  Description of Artificial Sequence: Synthetic polypeptide
  XENP020486 7G8_H0.38_L0_IgG1_PVA_/S267K Light Chain

SEQ ID NO: 18591 - protein, 111 aa, Artificial Sequence; identical to SEQ ID NO: 17591
  Description of Artificial Sequence: Synthetic polypeptide
  VL of XENP020486

SEQ ID NO: 18592 - protein, 15 aa, Artificial Sequence
  Description of Artificial Sequence: Synthetic peptide
  XENP020486 vlCDR1
KASQSVDYDGDSYMN

SEQ ID NO: 18593 - protein, 7 aa, Artificial Sequence
  Description of Artificial Sequence: Synthetic peptide
  XENP020486 vlCDR2
AASNLES

SEQ ID NO: 18594 - protein, 9 aa, Artificial Sequence
  Description of Artificial Sequence: Synthetic peptide
  XENP020486 vlCDR3
QQSNEDPFT

SEQ ID NO: 18595 - protein, 450 aa, Artificial Sequence
  Description of Artificial Sequence: Synthetic polypeptide
  XENP020487 7G8_H0.39_L0_IgG1_PVA_/S267K Heavy Chain
EVKLEESGGGLVQPGGSMKLSCAASGFTFSDAWMDWVRQSPEKGLEWVAEIRIKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18596 - protein, 121 aa, Artificial Sequence
  Description of Artificial Sequence: Synthetic polypeptide
  VH of XENP020487
EVKLEESGGGLVQPGGSMKLSCAASGFTFSDAWMDWVRQSPEKGLEWVAEIRIKANNHATYYAESVKGRFTISRDDSKSSVYLQMNSLRAEDTGIYYCTRLANWDWYFDVWGAGTTVTVSS

SEQ ID NO: 18597 - protein, 5 aa, Artificial Sequence
  Description of Artificial Sequence: Synthetic peptide
  XENP020487 vhCDR1
DAWMD

SEQ ID NO: 18598 - protein, 19 aa, Artificial Sequence
  Description of Artificial Sequence: Synthetic peptide
  XENP020487 vhCDR2
EIRIKANNHATYYAESVKG

SEQ ID NO: 18599 - protein, 10 aa, Artificial Sequence
  Description of Artificial Sequence: Synthetic peptide
  XENP020487 vhCDR3
LANWDWYFDV

SEQ ID NO: 18600 - protein, 218 aa, Artificial Sequence; identical to SEQ ID NO: 17590
  Description of Artificial Sequence: Synthetic polypeptide
  XENP020487 7G8_H0.39_L0_IgG1_PVA_/S267K Light Chain

SEQ ID NO: 18601 - protein, 111 aa, Artificial Sequence; identical to SEQ ID NO: 17591
  Description of Artificial Sequence: Synthetic polypeptide
  VL of XENP020487

SEQ ID NO: 18602 - protein, 15 aa, Artificial Sequence
  Description of Artificial Sequence: Synthetic peptide
  XENP020487 vlCDR1
KASQSVDYDGDSYMN

SEQ ID NO: 18603 - protein, 7 aa, Artificial Sequence
  Description of Artificial Sequence: Synthetic peptide
  XENP020487 vlCDR2
AASNLES

SEQ ID NO: 18604 - protein, 9 aa, Artificial Sequence
  Description of Artificial Sequence: Synthetic peptide
  XENP020487 vlCDR3
QQSNEDPFT

SEQ ID NO: 18605 - protein, 450 aa, Artificial Sequence
  Description of Artificial Sequence: Synthetic polypeptide
  XENP020488 7G8_H0.40_L0_IgG1_PVA_/S267K Heavy Chain
EVKLEESGGGLVQPGGSMKLSCAASGFTFSDAWMDWVRQSPEKGLEWVAEIRQKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18606 - protein, 121 aa, Artificial Sequence
  Description of Artificial Sequence: Synthetic polypeptide
  VH of XENP020488
EVKLEESGGGLVQPGGSMKLSCAASGFTFSDAWMDWVRQSPEKGLEWVAEIRQKANNHATYYAESVKGRFTISRDDSKSSVYLQMNSLRAEDTGIYYCTRLANWDWYFDVWGAGTTVTVSS

SEQ ID NO: 18607 - protein, 5 aa, Artificial Sequence
  Description of Artificial Sequence: Synthetic peptide
  XENP020488 vhCDR1
DAWMD

SEQ ID NO: 18608 - protein, 19 aa, Artificial Sequence
  Description of Artificial Sequence: Synthetic peptide
  XENP020488 vhCDR2
EIRQKANNHATYYAESVKG

SEQ ID NO: 18609 - protein, 10 aa, Artificial Sequence
  Description of Artificial Sequence: Synthetic peptide
  XENP020488 vhCDR3
LANWDWYFDV

SEQ ID NO: 18610 - protein, 218 aa, Artificial Sequence; identical to SEQ ID NO: 17590
  Description of Artificial Sequence: Synthetic polypeptide
  XENP020488 7G8_H0.40_L0_IgG1_PVA_/S267K Light Chain

SEQ ID NO: 18611 - protein, 111 aa, Artificial Sequence; identical to SEQ ID NO: 17591
  Description of Artificial Sequence: Synthetic polypeptide
  VL of XENP020488

SEQ ID NO: 18612 - protein, 15 aa, Artificial Sequence
  Description of Artificial Sequence: Synthetic peptide
  XENP020488 vlCDR1
KASQSVDYDGDSYMN

SEQ ID NO: 18613 - protein, 7 aa, Artificial Sequence
  Description of Artificial Sequence: Synthetic peptide
  XENP020488 vlCDR2
AASNLES

SEQ ID NO: 18614 - protein, 9 aa, Artificial Sequence
  Description of Artificial Sequence: Synthetic peptide
  XENP020488 vlCDR3
QQSNEDPFT

SEQ ID NO: 18615 - protein, 450 aa, Artificial Sequence
  Description of Artificial Sequence: Synthetic polypeptide
  XENP020489 7G8_H0.41_L0_IgG1_PVA_/S267K Heavy Chain
EVKLEESGGGLVQPGGSMKLSCAASGFTFSDAWMDWVRQSPEKGLEWVAEIRHKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18616 - protein, 121 aa, Artificial Sequence
  Description of Artificial Sequence: Synthetic polypeptide
  VH of XENP020489
EVKLEESGGGLVQPGGSMKLSCAASGFTFSDAWMDWVRQSPEKGLEWVAEIRHKANNHATYYAESVKGRFTISRDDSKSSVYLQMNSLRAEDTGIYYCTRLANWDWYFDVWGAGTTVTVSS

SEQ ID NO: 18617 - protein, 5 aa, Artificial Sequence
  Description of Artificial Sequence: Synthetic peptide
  XENP020489 vhCDR1
DAWMD

SEQ ID NO: 18618 - protein, 19 aa, Artificial Sequence
  Description of Artificial Sequence: Synthetic peptide
  XENP020489 vhCDR2
EIRHKANNHATYYAESVKG

SEQ ID NO: 18619 - protein, 10 aa, Artificial Sequence
  Description of Artificial Sequence: Synthetic peptide
  XENP020489 vhCDR3
LANWDWYFDV

SEQ ID NO: 18620 - protein, 218 aa, Artificial Sequence; identical to SEQ ID NO: 17590
  Description of Artificial Sequence: Synthetic polypeptide
  XENP020489 7G8_H0.41_L0_IgG1_PVA_/S267K Light Chain

SEQ ID NO: 18621 - protein, 111 aa, Artificial Sequence; identical to SEQ ID NO: 17591
  Description of Artificial Sequence: Synthetic polypeptide
  VL of XENP020489

SEQ ID NO: 18622 - protein, 15 aa, Artificial Sequence
  Description of Artificial Sequence: Synthetic peptide
  XENP020489 vlCDR1
KASQSVDYDGDSYMN

SEQ ID NO: 18623 - protein, 7 aa, Artificial Sequence
  Description of Artificial Sequence: Synthetic peptide
  XENP020489 vlCDR2
AASNLES

SEQ ID NO: 18624 - protein, 9 aa, Artificial Sequence
  Description of Artificial Sequence: Synthetic peptide
  XENP020489 vlCDR3
QQSNEDPFT

SEQ ID NO: 18625 - protein, 450 aa, Artificial Sequence
  Description of Artificial Sequence: Synthetic polypeptide
  XENP020490 7G8_H0.42_L0_IgG1_PVA_/S267K Heavy Chain
EVKLEESGGGLVQPGGSMKLSCAASGFTFSDAWMDWVRQSPEKGLEWVAEIRDKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18626 - protein, 121 aa, Artificial Sequence
  Description of Artificial Sequence: Synthetic polypeptide
  VH of XENP020490
EVKLEESGGGLVQPGGSMKLSCAASGFTFSDAWMDWVRQSPEKGLEWVAEIRDKANNHATYYAESVKGRFTISRDDSKSSVYLQMNSLRAEDTGIYYCTRLANWDWYFDVWGAGTTVTVSS

SEQ ID NO: 18627 - protein, 5 aa, Artificial Sequence
  Description of Artificial Sequence: Synthetic peptide
  XENP020490 vhCDR1
DAWMD

SEQ ID NO: 18628 - protein, 19 aa, Artificial Sequence
  Description of Artificial Sequence: Synthetic peptide
  XENP020490 vhCDR2
EIRDKANNHATYYAESVKG

SEQ ID NO: 18629 - protein, 10 aa, Artificial Sequence
  Description of Artificial Sequence: Synthetic peptide
  XENP020490 vhCDR3
LANWDWYFDV

SEQ ID NO: 18630 - protein, 218 aa, Artificial Sequence; identical to SEQ ID NO: 17590
  Description of Artificial Sequence: Synthetic polypeptide
  XENP020490 7G8_H0.42_L0_IgG1_PVA_/S267K Light Chain

SEQ ID NO: 18631 - protein, 111 aa, Artificial Sequence; identical to SEQ ID NO: 17591
  Description of Artificial Sequence: Synthetic polypeptide
  VL of XENP020490

SEQ ID NO: 18632 - protein, 15 aa, Artificial Sequence
  Description of Artificial Sequence: Synthetic peptide
  XENP020490 vlCDR1
KASQSVDYDGDSYMN

SEQ ID NO: 18633 - protein, 7 aa, Artificial Sequence
  Description of Artificial Sequence: Synthetic peptide
  XENP020490 vlCDR2
AASNLES

SEQ ID NO: 18634 - protein, 9 aa, Artificial Sequence
  Description of Artificial Sequence: Synthetic peptide
  XENP020490 vlCDR3
QQSNEDPFT

SEQ ID NO: 18635 - protein, 450 aa, Artificial Sequence
  Description of Artificial Sequence: Synthetic polypeptide
  XENP020491 7G8_H0.43_L0_IgG1_PVA_/S267K Heavy Chain
EVKLEESGGGLVQPGGSMKLSCAASGFTFSDAWMDWVRQSPEKGLEWVAEIRKKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18636 - protein, 121 aa, Artificial Sequence
  Description of Artificial Sequence: Synthetic polypeptide
  VH of XENP020491
EVKLEESGGGLVQPGGSMKLSCAASGFTFSDAWMDWVRQSPEKGLEWVAEIRKKANNHATYYAESVKGRFTISRDDSKSSVYLQMNSLRAEDTGIYYCTRLANWDWYFDVWGAGTTVTVSS

SEQ ID NO: 18637 - protein, 5 aa, Artificial Sequence
  Description of Artificial Sequence: Synthetic peptide
  XENP020491 vhCDR1
DAWMD

SEQ ID NO: 18638 - protein, 19 aa, Artificial Sequence
  Description of Artificial Sequence: Synthetic peptide
  XENP020491 vhCDR2
EIRKKANNHATYYAESVKG

SEQ ID NO: 18639 - protein, 10 aa, Artificial Sequence
  Description of Artificial Sequence: Synthetic peptide
  XENP020491 vhCDR3
LANWDWYFDV

SEQ ID NO: 18640 - protein, 218 aa, Artificial Sequence; identical to SEQ ID NO: 17590
  Description of Artificial Sequence: Synthetic polypeptide
  XENP020491 7G8_H0.43_L0_IgG1_PVA_/S267K Light Chain

SEQ ID NO: 18641 - protein, 111 aa, Artificial Sequence; identical to SEQ ID NO: 17591
  Description of Artificial Sequence: Synthetic polypeptide
  VL of XENP020491

SEQ ID NO: 18642 - protein, 15 aa, Artificial Sequence
  Description of Artificial Sequence: Synthetic peptide
  XENP020491 vlCDR1
KASQSVDYDGDSYMN

SEQ ID NO: 18643 - protein, 7 aa, Artificial Sequence
  Description of Artificial Sequence: Synthetic peptide
  XENP020491 vlCDR2
AASNLES

SEQ ID NO: 18644 - protein, 9 aa, Artificial Sequence
  Description of Artificial Sequence: Synthetic peptide
  XENP020491 vlCDR3
QQSNEDPFT

SEQ ID NO: 18645 - protein, 450 aa, Artificial Sequence
  Description of Artificial Sequence: Synthetic polypeptide
  XENP020492 7G8_H0.44_L0_IgG1_PVA_/S267K Heavy Chain
EVKLEESGGGLVQPGGSMKLSCAASGFTFSDAWMDWVRQSPEKGLEWVAEIRYKANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18646 - protein, 121 aa, Artificial Sequence
  Description of Artificial Sequence: Synthetic polypeptide
  VH of XENP020492
EVKLEESGGGLVQPGGSMKLSCAASGFTFSDAWMDWVRQSPEKGLEWVAEIRYKANNHATYYAESVKGRFTISRDDSKSSVYLQMNSLRAEDTGIYYCTRLANWDWYFDVWGAGTTVTVSS

SEQ ID NO: 18647 - protein, 5 aa, Artificial Sequence
  Description of Artificial Sequence: Synthetic peptide
  XENP020492 vhCDR1
DAWMD

SEQ ID NO: 18648 - protein, 19 aa, Artificial Sequence
  Description of Artificial Sequence: Synthetic peptide
  XENP020492 vhCDR2
EIRYKANNHATYYAESVKG

SEQ ID NO: 18649 - protein, 10 aa, Artificial Sequence
  Description of Artificial Sequence: Synthetic peptide
  XENP020492 vhCDR3
LANWDWYFDV

SEQ ID NO: 18650 - protein, 218 aa, Artificial Sequence; identical to SEQ ID NO: 17590
  Description of Artificial Sequence: Synthetic polypeptide
  XENP020492 7G8_H0.44_L0_IgG1_PVA_/S267K Light Chain

SEQ ID NO: 18651 - protein, 111 aa, Artificial Sequence; identical to SEQ ID NO: 17591
  Description of Artificial Sequence: Synthetic polypeptide
  VL of XENP020492

SEQ ID NO: 18652 - protein, 15 aa, Artificial Sequence
  Description of Artificial Sequence: Synthetic peptide
  XENP020492 vlCDR1
KASQSVDYDGDSYMN

SEQ ID NO: 18653 - protein, 7 aa, Artificial Sequence
  Description of Artificial Sequence: Synthetic peptide
  XENP020492 vlCDR2
AASNLES

SEQ ID NO: 18654 - protein, 9 aa, Artificial Sequence
  Description of Artificial Sequence: Synthetic peptide
  XENP020492 vlCDR3
QQSNEDPFT

SEQ ID NO: 18655 - protein, 450 aa, Artificial Sequence
  Description of Artificial Sequence: Synthetic polypeptide
  XENP020493 7G8_H0.45_L0_IgG1_PVA_/S267K Heavy Chain
EVKLEESGGGLVQPGGSMKLSCAASGFTFSDAWMDWVRQSPEKGLEWVAEIRTRANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18656 - protein, 121 aa, Artificial Sequence
  Description of Artificial Sequence: Synthetic polypeptide
  VH of XENP020493
EVKLEESGGGLVQPGGSMKLSCAASGFTFSDAWMDWVRQSPEKGLEWVAEIRTRANNHATYYAESVKGRFTISRDDSKSSVYLQMNSLRAEDTGIYYCTRLANWDWYFDVWGAGTTVTVSS

SEQ ID NO: 18657 - protein, 5 aa, Artificial Sequence
  Description of Artificial Sequence: Synthetic peptide
  XENP020493 vhCDR1
DAWMD

SEQ ID NO: 18658 - protein, 19 aa, Artificial Sequence
  Description of Artificial Sequence: Synthetic peptide
  XENP020493 vhCDR2
EIRTRANNHATYYAESVKG

SEQ ID NO: 18659 - protein, 10 aa, Artificial Sequence
  Description of Artificial Sequence: Synthetic peptide
  XENP020493 vhCDR3
LANWDWYFDV

SEQ ID NO: 18660 - protein, 218 aa, Artificial Sequence; identical to SEQ ID NO: 17590
  Description of Artificial Sequence: Synthetic polypeptide
  XENP020493 7G8_H0.45_L0_IgG1_PVA_/S267K Light Chain

SEQ ID NO: 18661 - protein, 111 aa, Artificial Sequence; identical to SEQ ID NO: 17591
  Description of Artificial Sequence: Synthetic polypeptide
  VL of XENP020493

SEQ ID NO: 18662 - protein, 15 aa, Artificial Sequence
  Description of Artificial Sequence: Synthetic peptide
  XENP020493 vlCDR1
KASQSVDYDGDSYMN

SEQ ID NO: 18663 - protein, 7 aa, Artificial Sequence
  Description of Artificial Sequence: Synthetic peptide
  XENP020493 vlCDR2
AASNLES

SEQ ID NO: 18664 - protein, 9 aa, Artificial Sequence
  Description of Artificial Sequence: Synthetic peptide
  XENP020493 vlCDR3
QQSNEDPFT

SEQ ID NO: 18665 - protein, 450 aa, Artificial Sequence
  Description of Artificial Sequence: Synthetic polypeptide
  XENP020494 7G8_H0.46_L0_IgG1_PVA_/S267K Heavy Chain
EVKLEESGGGLVQPGGSMKLSCAASGFTFSDAWMDWVRQSPEKGLEWVAEIRTEANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18666 - protein, 121 aa, Artificial Sequence
  Description of Artificial Sequence: Synthetic polypeptide
  VH of XENP020494
EVKLEESGGGLVQPGGSMKLSCAASGFTFSDAWMDWVRQSPEKGLEWVAEIRTEANNHATYYAESVKGRFTISRDDSKSSVYLQMNSLRAEDTGIYYCTRLANWDWYFDVWGAGTTVTVSS

SEQ ID NO: 18667 - protein, 5 aa, Artificial Sequence
  Description of Artificial Sequence: Synthetic peptide
  XENP020494 vhCDR1
DAWMD

SEQ ID NO: 18668 - protein, 19 aa, Artificial Sequence
  Description of Artificial Sequence: Synthetic peptide
  XENP020494 vhCDR2
EIRTEANNHATYYAESVKG

SEQ ID NO: 18669 - protein, 10 aa, Artificial Sequence
  Description of Artificial Sequence: Synthetic peptide
  XENP020494 vhCDR3
LANWDWYFDV

SEQ ID NO: 18670 - protein, 218 aa, Artificial Sequence; identical to SEQ ID NO: 17590
  Description of Artificial Sequence: Synthetic polypeptide
  XENP020494 7G8_H0.46_L0_IgG1_PVA_/S267K Light Chain

SEQ ID NO: 18671 - protein, 111 aa, Artificial Sequence; identical to SEQ ID NO: 17591
  Description of Artificial Sequence: Synthetic polypeptide
  VL of XENP020494

SEQ ID NO: 18672 - protein, 15 aa, Artificial Sequence
  Description of Artificial Sequence: Synthetic peptide
  XENP020494 vlCDR1
KASQSVDYDGDSYMN

SEQ ID NO: 18673 - protein, 7 aa, Artificial Sequence
  Description of Artificial Sequence: Synthetic peptide
  XENP020494 vlCDR2
AASNLES

SEQ ID NO: 18674 - protein, 9 aa, Artificial Sequence
  Description of Artificial Sequence: Synthetic peptide
  XENP020494 vlCDR3
QQSNEDPFT

SEQ ID NO: 18675 - protein, 450 aa, Artificial Sequence
  Description of Artificial Sequence: Synthetic polypeptide
  XENP020495 7G8_H0.47_L0_IgG1_PVA_/S267K Heavy Chain
EVKLEESGGGLVQPGGSMKLSCAASGFTFSDAWMDWVRQSPEKGLEWVAEIRTHANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18676 - protein, 121 aa, Artificial Sequence
  Description of Artificial Sequence: Synthetic polypeptide
  VH of XENP020495
EVKLEESGGGLVQPGGSMKLSCAASGFTFSDAWMDWVRQSPEKGLEWVAEIRTHANNHATYYAESVKGRFTISRDDSKSSVYLQMNSLRAEDTGIYYCTRLANWDWYFDVWGAGTTVTVSS

SEQ ID NO: 18677 - protein, 5 aa, Artificial Sequence
  Description of Artificial Sequence: Synthetic peptide
  XENP020495 vhCDR1
DAWMD

SEQ ID NO: 18678 - protein, 19 aa, Artificial Sequence
  Description of Artificial Sequence: Synthetic peptide
  XENP020495 vhCDR2
EIRTHANNHATYYAESVKG

SEQ ID NO: 18679 - protein, 10 aa, Artificial Sequence
  Description of Artificial Sequence: Synthetic peptide
  XENP020495 vhCDR3
LANWDWYFDV

SEQ ID NO: 18680 - protein, 218 aa, Artificial Sequence; identical to SEQ ID NO: 17590
  Description of Artificial Sequence: Synthetic polypeptide
  XENP020495 7G8_H0.47_L0_IgG1_PVA_/S267K Light Chain

SEQ ID NO: 18681 - protein, 111 aa, Artificial Sequence; identical to SEQ ID NO: 17591
  Description of Artificial Sequence: Synthetic polypeptide
  VL of XENP020495

SEQ ID NO: 18682 - protein, 15 aa, Artificial Sequence
  Description of Artificial Sequence: Synthetic peptide
  XENP020495 vlCDR1
KASQSVDYDGDSYMN

SEQ ID NO: 18683 - protein, 7 aa, Artificial Sequence
  Description of Artificial Sequence: Synthetic peptide
  XENP020495 vlCDR2
AASNLES

SEQ ID NO: 18684 - protein, 9 aa, Artificial Sequence
  Description of Artificial Sequence: Synthetic peptide
  XENP020495 vlCDR3
QQSNEDPFT

SEQ ID NO: 18685 - protein, 450 aa, Artificial Sequence
  Description of Artificial Sequence: Synthetic polypeptide
  XENP020496 7G8_H0.48_L0_IgG1_PVA_/S267K Heavy Chain
EVKLEESGGGLVQPGGSMKLSCAASGFTFSDAWMDWVRQSPEKGLEWVAEIRTSANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18686 - protein, 121 aa, Artificial Sequence
  Description of Artificial Sequence: Synthetic polypeptide
  VH of XENP020496
EVKLEESGGGLVQPGGSMKLSCAASGFTFSDAWMDWVRQSPEKGLEWVAEIRTSANNHATYYAESVKGRFTISRDDSKSSVYLQMNSLRAEDTGIYYCTRLANWDWYFDVWGAGTTVTVSS

SEQ ID NO: 18687 - protein, 5 aa, Artificial Sequence
  Description of Artificial Sequence: Synthetic peptide
  XENP020496 vhCDR1
DAWMD

SEQ ID NO: 18688 - protein, 19 aa, Artificial Sequence
  Description of Artificial Sequence: Synthetic peptide
  XENP020496 vhCDR2
EIRTSANNHATYYAESVKG

SEQ ID NO: 18689 - protein, 10 aa, Artificial Sequence
  Description of Artificial Sequence: Synthetic peptide
  XENP020496 vhCDR3
LANWDWYFDV

SEQ ID NO: 18690 - protein, 218 aa, Artificial Sequence; identical to SEQ ID NO: 17590
  Description of Artificial Sequence: Synthetic polypeptide
  XENP020496 7G8_H0.48_L0_IgG1_PVA_/S267K Light Chain

SEQ ID NO: 18691 - protein, 111 aa, Artificial Sequence; identical to SEQ ID NO: 17591
  Description of Artificial Sequence: Synthetic polypeptide
  VL of XENP020496

SEQ ID NO: 18692 - protein, 15 aa, Artificial Sequence
  Description of Artificial Sequence: Synthetic peptide
  XENP020496 vlCDR1
KASQSVDYDGDSYMN

SEQ ID NO: 18693 - protein, 7 aa, Artificial Sequence
  Description of Artificial Sequence: Synthetic peptide
  XENP020496 vlCDR2
AASNLES

SEQ ID NO: 18694 - protein, 9 aa, Artificial Sequence
  Description of Artificial Sequence: Synthetic peptide
  XENP020496 vlCDR3
QQSNEDPFT

SEQ ID NO: 18695 - protein, 450 aa, Artificial Sequence
  Description of Artificial Sequence: Synthetic polypeptide
  XENP020501 7G8_H0.49_L0_IgG1_PVA_/S267K Heavy Chain
EVKLEESGGGLVQPGGSMKLSCAASGFTFSDAWMDWVRQSPEKGLEWVAEIRTDANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18696 - protein, 121 aa, Artificial Sequence
  Description of Artificial Sequence: Synthetic polypeptide
  VH of XENP020501
EVKLEESGGGLVQPGGSMKLSCAASGFTFSDAWMDWVRQSPEKGLEWVAEIRTDANNHATYYAESVKGRFTISRDDSKSSVYLQMNSLRAEDTGIYYCTRLANWDWYFDVWGAGTTVTVSS

SEQ ID NO: 18697 - protein, 5 aa, Artificial Sequence
  Description of Artificial Sequence: Synthetic peptide
  XENP020501 vhCDR1
DAWMD

SEQ ID NO: 18698 - protein, 19 aa, Artificial Sequence
  Description of Artificial Sequence: Synthetic peptide
  XENP020501 vhCDR2
EIRTDANNHATYYAESVKG

SEQ ID NO: 18699 - protein, 10 aa, Artificial Sequence
  Description of Artificial Sequence: Synthetic peptide
  XENP020501 vhCDR3
LANWDWYFDV

SEQ ID NO: 18700 - protein, 218 aa, Artificial Sequence; identical to SEQ ID NO: 17590
  Description of Artificial Sequence: Synthetic polypeptide
  XENP020501 7G8_H0.49_L0_IgG1_PVA_/S267K Light Chain

SEQ ID NO: 18701 - protein, 111 aa, Artificial Sequence; identical to SEQ ID NO: 17591
  Description of Artificial Sequence: Synthetic polypeptide
  VL of XENP020501

SEQ ID NO: 18702 - protein, 15 aa, Artificial Sequence
  Description of Artificial Sequence: Synthetic peptide
  XENP020501 vlCDR1
KASQSVDYDGDSYMN

SEQ ID NO: 18703 - protein, 7 aa, Artificial Sequence
  Description of Artificial Sequence: Synthetic peptide
  XENP020501 vlCDR2
AASNLES

SEQ ID NO: 18704 - protein, 9 aa, Artificial Sequence
  Description of Artificial Sequence: Synthetic peptide
  XENP020501 vlCDR3
QQSNEDPFT

SEQ ID NO: 18705 - protein, 450 aa, Artificial Sequence
  Description of Artificial Sequence: Synthetic polypeptide
  XENP020502 7G8_H0.50_L0_IgG1_PVA_/S267K Heavy Chain
EVKLEESGGGLVQPGGSMKLSCAASGFTFSDAWMDWVRQSPEKGLEWVAEIRTAANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18706 - protein, 121 aa, Artificial Sequence
  Description of Artificial Sequence: Synthetic polypeptide
  VH of XENP020502
EVKLEESGGGLVQPGGSMKLSCAASGFTFSDAWMDWVRQSPEKGLEWVAEIRTAANNHATYYAESVKGRFTISRDDSKSSVYLQMNSLRAEDTGIYYCTRLANWDWYFDVWGAGTTVTVSS

SEQ ID NO: 18707 - protein, 5 aa, Artificial Sequence
  Description of Artificial Sequence: Synthetic peptide
  XENP020502 vhCDR1
DAWMD

SEQ ID NO: 18708 - protein, 19 aa, Artificial Sequence
  Description of Artificial Sequence: Synthetic peptide
  XENP020502 vhCDR2
EIRTAANNHATYYAESVKG

SEQ ID NO: 18709 - protein, 10 aa, Artificial Sequence
  Description of Artificial Sequence: Synthetic peptide
  XENP020502 vhCDR3
LANWDWYFDV

SEQ ID NO: 18710 - protein, 218 aa, Artificial Sequence; identical to SEQ ID NO: 17590
  Description of Artificial Sequence: Synthetic polypeptide
  XENP020502 7G8_H0.50_L0_IgG1_PVA_/S267K Light Chain

SEQ ID NO: 18711 - protein, 111 aa, Artificial Sequence; identical to SEQ ID NO: 17591
  Description of Artificial Sequence: Synthetic polypeptide
  VL of XENP020502

SEQ ID NO: 18712 - protein, 15 aa, Artificial Sequence
  Description of Artificial Sequence: Synthetic peptide
  XENP020502 vlCDR1
KASQSVDYDGDSYMN

SEQ ID NO: 18713 - protein, 7 aa, Artificial Sequence
  Description of Artificial Sequence: Synthetic peptide
  XENP020502 vlCDR2
AASNLES

SEQ ID NO: 18714 - protein, 9 aa, Artificial Sequence
  Description of Artificial Sequence: Synthetic peptide
  XENP020502 vlCDR3
QQSNEDPFT

SEQ ID NO: 18715 - protein, 450 aa, Artificial Sequence
  Description of Artificial Sequence: Synthetic polypeptide
  XENP020503 7G8_H0.51_L0_IgG1_PVA_/S267K Heavy Chain
EVKLEESGGGLVQPGGSMKLSCAASGFTFSDAWMDWVRQSPEKGLEWVAEIRTGANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18716 - protein, 121 aa, Artificial Sequence
  Description of Artificial Sequence: Synthetic polypeptide
  VH of XENP020503
EVKLEESGGGLVQPGGSMKLSCAASGFTFSDAWMDWVRQSPEKGLEWVAEIRTGANNHATYYAESVKGRFTISRDDSKSSVYLQMNSLRAEDTGIYYCTRLANWDWYFDVWGAGTTVTVSS

SEQ ID NO: 18717 - protein, 5 aa, Artificial Sequence
  Description of Artificial Sequence: Synthetic peptide
  XENP020503 vhCDR1
DAWMD

SEQ ID NO: 18718 - protein, 19 aa, Artificial Sequence
  Description of Artificial Sequence: Synthetic peptide
  XENP020503 vhCDR2
EIRTGANNHATYYAESVKG

SEQ ID NO: 18719 - protein, 10 aa, Artificial Sequence
  Description of Artificial Sequence: Synthetic peptide
  XENP020503 vhCDR3
LANWDWYFDV

SEQ ID NO: 18720 - protein, 218 aa, Artificial Sequence; identical to SEQ ID NO: 17590
  Description of Artificial Sequence: Synthetic polypeptide
  XENP020503 7G8_H0.51_L0_IgG1_PVA_/S267K Light Chain

SEQ ID NO: 18721 - protein, 111 aa, Artificial Sequence; identical to SEQ ID NO: 17591
  Description of Artificial Sequence: Synthetic polypeptide
  VL of XENP020503

SEQ ID NO: 18722 - protein, 15 aa, Artificial Sequence
  Description of Artificial Sequence: Synthetic peptide
  XENP020503 vlCDR1
KASQSVDYDGDSYMN

SEQ ID NO: 18723 - protein, 7 aa, Artificial Sequence
  Description of Artificial Sequence: Synthetic peptide
  XENP020503 vlCDR2
AASNLES

SEQ ID NO: 18724 - protein, 9 aa, Artificial Sequence
  Description of Artificial Sequence: Synthetic peptide
  XENP020503 vlCDR3
QQSNEDPFT

SEQ ID NO: 18725 - protein, 450 aa, Artificial Sequence
  Description of Artificial Sequence: Synthetic polypeptide
  XENP020504 7G8_H0.52_L0_IgG1_PVA_/S267K Heavy Chain
EVKLEESGGGLVQPGGSMKLSCAASGFTFSDAWMDWVRQSPEKGLEWVAEIRTYANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18726 - protein, 121 aa, Artificial Sequence
  Description of Artificial Sequence: Synthetic polypeptide
  VH of XENP020504
EVKLEESGGGLVQPGGSMKLSCAASGFTFSDAWMDWVRQSPEKGLEWVAEIRTYANNHATYYAESVKGRFTISRDDSKSSVYLQMNSLRAEDTGIYYCTRLANWDWYFDVWGAGTTVTVSS

SEQ ID NO: 18727 - protein, 5 aa, Artificial Sequence
  Description of Artificial Sequence: Synthetic peptide
  XENP020504 vhCDR1
DAWMD

SEQ ID NO: 18728 - protein, 19 aa, Artificial Sequence
  Description of Artificial Sequence: Synthetic peptide
  XENP020504 vhCDR2
EIRTYANNHATYYAESVKG

SEQ ID NO: 18729 - protein, 10 aa, Artificial Sequence
  Description of Artificial Sequence: Synthetic peptide
  XENP020504 vhCDR3
LANWDWYFDV

SEQ ID NO: 18730 - protein, 218 aa, Artificial Sequence; identical to SEQ ID NO: 17590
  Description of Artificial Sequence: Synthetic polypeptide
  XENP020504 7G8_H0.52_L0_IgG1_PVA_/S267K Light Chain

SEQ ID NO: 18731 - protein, 111 aa, Artificial Sequence; identical to SEQ ID NO: 17591
  Description of Artificial Sequence: Synthetic polypeptide
  VL of XENP020504

SEQ ID NO: 18732 - protein, 15 aa, Artificial Sequence
  Description of Artificial Sequence: Synthetic peptide
  XENP020504 vlCDR1
KASQSVDYDGDSYMN

SEQ ID NO: 18733 - protein, 7 aa, Artificial Sequence
  Description of Artificial Sequence: Synthetic peptide
  XENP020504 vlCDR2
AASNLES

SEQ ID NO: 18734 - protein, 9 aa, Artificial Sequence
  Description of Artificial Sequence: Synthetic peptide
  XENP020504 vlCDR3
QQSNEDPFT

SEQ ID NO: 18735 - protein, 450 aa, Artificial Sequence
  Description of Artificial Sequence: Synthetic polypeptide
  XENP020505 7G8_H0.53_L0_IgG1_PVA_/S267K Heavy Chain
EVKLEESGGGLVQPGGSMKLSCAASGFTFSDAWMDWVRQSPEKGLEWVAEIRTIANNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18736 - protein, 121 aa, Artificial Sequence
  Description of Artificial Sequence: Synthetic polypeptide
  VH of XENP020505
EVKLEESGGGLVQPGGSMKLSCAASGFTFSDAWMDWVRQSPEKGLEWVAEIRTIANNHATYYAESVKGRFTISRDDSKSSVYLQMNSLRAEDTGIYYCTRLANWDWYFDVWGAGTTVTVSS

SEQ ID NO: 18737 - protein, 5 aa, Artificial Sequence
  Description of Artificial Sequence: Synthetic peptide
  XENP020505 vhCDR1
DAWMD

SEQ ID NO: 18738 - protein, 19 aa, Artificial Sequence
  Description of Artificial Sequence: Synthetic peptide
  XENP020505 vhCDR2
EIRTIANNHATYYAESVKG

SEQ ID NO: 18739 - protein, 10 aa, Artificial Sequence
  Description of Artificial Sequence: Synthetic peptide
  XENP020505 vhCDR3
LANWDWYFDV

SEQ ID NO: 18740 - protein, 218 aa, Artificial Sequence; identical to SEQ ID NO: 17590
  Description of Artificial Sequence: Synthetic polypeptide
  XENP020505 7G8_H0.53_L0_IgG1_PVA_/S267K Light Chain

SEQ ID NO: 18741 - protein, 111 aa, Artificial Sequence; identical to SEQ ID NO: 17591
  Description of Artificial Sequence: Synthetic polypeptide
  VL of XENP020505

SEQ ID NO: 18742 - protein, 15 aa, Artificial Sequence
  Description of Artificial Sequence: Synthetic peptide
  XENP020505 vlCDR1
KASQSVDYDGDSYMN

SEQ ID NO: 18743 - protein, 7 aa, Artificial Sequence
  Description of Artificial Sequence: Synthetic peptide
  XENP020505 vlCDR2
AASNLES

SEQ ID NO: 18744 - protein, 9 aa, Artificial Sequence
  Description of Artificial Sequence: Synthetic peptide
  XENP020505 vlCDR3
QQSNEDPFT

SEQ ID NO: 18745 - protein, 450 aa, Artificial Sequence
  Description of Artificial Sequence: Synthetic polypeptide
  XENP020506 7G8_H0.54_L0_IgG1_PVA_/S267K Heavy Chain
EVKLEESGGGLVQPGGSMKLSCAASGFTFSDAWMDWVRQSPEKGLEWVAEIRTKSNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18746 - protein, 121 aa, Artificial Sequence
  Description of Artificial Sequence: Synthetic polypeptide
  VH of XENP020506
EVKLEESGGGLVQPGGSMKLSCAASGFTFSDAWMDWVRQSPEKGLEWVAEIRTKSNNHATYYAESVKGRFTISRDDSKSSVYLQMNSLRAEDTGIYYCTRLANWDWYFDVWGAGTTVTVSS

SEQ ID NO: 18747 - protein, 5 aa, Artificial Sequence
  Description of Artificial Sequence: Synthetic peptide
  XENP020506 vhCDR1
DAWMD

SEQ ID NO: 18748 - protein, 19 aa, Artificial Sequence
  Description of Artificial Sequence: Synthetic peptide
  XENP020506 vhCDR2
EIRTKSNNHATYYAESVKG

SEQ ID NO: 18749 - protein, 10 aa, Artificial Sequence
  Description of Artificial Sequence: Synthetic peptide
  XENP020506 vhCDR3
LANWDWYFDV

SEQ ID NO: 18750 - protein, 218 aa, Artificial Sequence; identical to SEQ ID NO: 17590
  Description of Artificial Sequence: Synthetic polypeptide
  XENP020506 7G8_H0.54_L0_IgG1_PVA_/S267K Light Chain

SEQ ID NO: 18751 - protein, 111 aa, Artificial Sequence; identical to SEQ ID NO: 17591
  Description of Artificial Sequence: Synthetic polypeptide
  VL of XENP020506

SEQ ID NO: 18752 - protein, 15 aa, Artificial Sequence
  Description of Artificial Sequence: Synthetic peptide
  XENP020506 vlCDR1
KASQSVDYDGDSYMN

SEQ ID NO: 18753 - protein, 7 aa, Artificial Sequence
  Description of Artificial Sequence: Synthetic peptide
  XENP020506 vlCDR2
AASNLES

SEQ ID NO: 18754 - protein, 9 aa, Artificial Sequence
  Description of Artificial Sequence: Synthetic peptide
  XENP020506 vlCDR3
QQSNEDPFT

SEQ ID NO: 18755 - protein, 450 aa, Artificial Sequence
  Description of Artificial Sequence: Synthetic polypeptide
  XENP020507 7G8_H0.55_L0_IgG1_PVA_/S267K Heavy Chain
EVKLEESGGGLVQPGGSMKLSCAASGFTFSDAWMDWVRQSPEKGLEWVAEIRTKTNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18756 - protein, 121 aa, Artificial Sequence
  Description of Artificial Sequence: Synthetic polypeptide
  VH of XENP020507
EVKLEESGGGLVQPGGSMKLSCAASGFTFSDAWMDWVRQSPEKGLEWVAEIRTKTNNHATYYAESVKGRFTISRDDSKSSVYLQMNSLRAEDTGIYYCTRLANWDWYFDVWGAGTTVTVSS

SEQ ID NO: 18757 - protein, 5 aa, Artificial Sequence
  Description of Artificial Sequence: Synthetic peptide
  XENP020507 vhCDR1
DAWMD

SEQ ID NO: 18758 - protein, 19 aa, Artificial Sequence
  Description of Artificial Sequence: Synthetic peptide
  XENP020507 vhCDR2
EIRTKTNNHATYYAESVKG

SEQ ID NO: 18759 - protein, 10 aa, Artificial Sequence
  Description of Artificial Sequence: Synthetic peptide
  XENP020507 vhCDR3
LANWDWYFDV

SEQ ID NO: 18760 - protein, 218 aa, Artificial Sequence; identical to SEQ ID NO: 17590
  Description of Artificial Sequence: Synthetic polypeptide
  XENP020507 7G8_H0.55_L0_IgG1_PVA_/S267K Light Chain

SEQ ID NO: 18761 - protein, 111 aa, Artificial Sequence; identical to SEQ ID NO: 17591
  Description of Artificial Sequence: Synthetic polypeptide
  VL of XENP020507

SEQ ID NO: 18762 - protein, 15 aa, Artificial Sequence
  Description of Artificial Sequence: Synthetic peptide
  XENP020507 vlCDR1
KASQSVDYDGDSYMN

SEQ ID NO: 18763 - protein, 7 aa, Artificial Sequence
  Description of Artificial Sequence: Synthetic peptide
  XENP020507 vlCDR2
AASNLES

SEQ ID NO: 18764 - protein, 9 aa, Artificial Sequence
  Description of Artificial Sequence: Synthetic peptide
  XENP020507 vlCDR3
QQSNEDPFT

SEQ ID NO: 18765 - protein, 450 aa, Artificial Sequence
  Description of Artificial Sequence: Synthetic polypeptide
  XENP020508 7G8_H0.56_L0_IgG1_PVA_/S267K Heavy Chain
EVKLEESGGGLVQPGGSMKLSCAASGFTFSDAWMDWVRQSPEKGLEWVAEIRTKGNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18766 - protein, 121 aa, Artificial Sequence
  Description of Artificial Sequence: Synthetic polypeptide
  VH of XENP020508
EVKLEESGGGLVQPGGSMKLSCAASGFTFSDAWMDWVRQSPEKGLEWVAEIRTKGNNHATYYAESVKGRFTISRDDSKSSVYLQMNSLRAEDTGIYYCTRLANWDWYFDVWGAGTTVTVSS

SEQ ID NO: 18767 - protein, 5 aa, Artificial Sequence
  Description of Artificial Sequence: Synthetic peptide
  XENP020508 vhCDR1
DAWMD

SEQ ID NO: 18768 - protein, 19 aa, Artificial Sequence
  Description of Artificial Sequence: Synthetic peptide
  XENP020508 vhCDR2
EIRTKGNNHATYYAESVKG

SEQ ID NO: 18769 - protein, 10 aa, Artificial Sequence
  Description of Artificial Sequence: Synthetic peptide
  XENP020508 vhCDR3
LANWDWYFDV

SEQ ID NO: 18770 - protein, 218 aa, Artificial Sequence; identical to SEQ ID NO: 17590
  Description of Artificial Sequence: Synthetic polypeptide
  XENP020508 7G8_H0.56_L0_IgG1_PVA_/S267K Light Chain

SEQ ID NO: 18771 - protein, 111 aa, Artificial Sequence; identical to SEQ ID NO: 17591
  Description of Artificial Sequence: Synthetic polypeptide
  VL of XENP020508

SEQ ID NO: 18772 - protein, 15 aa, Artificial Sequence
  Description of Artificial Sequence: Synthetic peptide
  XENP020508 vlCDR1
KASQSVDYDGDSYMN

SEQ ID NO: 18773 - protein, 7 aa, Artificial Sequence
  Description of Artificial Sequence: Synthetic peptide
  XENP020508 vlCDR2
AASNLES

SEQ ID NO: 18774 - protein, 9 aa, Artificial Sequence
  Description of Artificial Sequence: Synthetic peptide
  XENP020508 vlCDR3
QQSNEDPFT

SEQ ID NO: 18775 - protein, 450 aa, Artificial Sequence
  Description of Artificial Sequence: Synthetic polypeptide
  XENP020509 7G8_H0.57_L0_IgG1_PVA_/S267K Heavy Chain
EVKLEESGGGLVQPGGSMKLSCAASGFTFSDAWMDWVRQSPEKGLEWVAEIRTKHNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18776 - protein, 121 aa, Artificial Sequence
  Description of Artificial Sequence: Synthetic polypeptide
  VH of XENP020509
EVKLEESGGGLVQPGGSMKLSCAASGFTFSDAWMDWVRQSPEKGLEWVAEIRTKHNNHATYYAESVKGRFTISRDDSKSSVYLQMNSLRAEDTGIYYCTRLANWDWYFDVWGAGTTVTVSS

SEQ ID NO: 18777 - protein, 5 aa, Artificial Sequence
  Description of Artificial Sequence: Synthetic peptide
  XENP020509 vhCDR1
DAWMD

SEQ ID NO: 18778 - protein, 19 aa, Artificial Sequence
  Description of Artificial Sequence: Synthetic peptide
  XENP020509 vhCDR2
EIRTKHNNHATYYAESVKG

SEQ ID NO: 18779 - protein, 10 aa, Artificial Sequence
  Description of Artificial Sequence: Synthetic peptide
  XENP020509 vhCDR3
LANWDWYFDV

SEQ ID NO: 18780 - protein, 218 aa, Artificial Sequence; identical to SEQ ID NO: 17590
  Description of Artificial Sequence: Synthetic polypeptide
  XENP020509 7G8_H0.57_L0_IgG1_PVA_/S267K Light Chain

SEQ ID NO: 18781 - protein, 111 aa, Artificial Sequence; identical to SEQ ID NO: 17591
  Description of Artificial Sequence: Synthetic polypeptide
  VL of XENP020509

SEQ ID NO: 18782 - protein, 15 aa, Artificial Sequence
  Description of Artificial Sequence: Synthetic peptide
  XENP020509 vlCDR1
KASQSVDYDGDSYMN

SEQ ID NO: 18783 - protein, 7 aa, Artificial Sequence
  Description of Artificial Sequence: Synthetic peptide
  XENP020509 vlCDR2
AASNLES

SEQ ID NO: 18784 - protein, 9 aa, Artificial Sequence
  Description of Artificial Sequence: Synthetic peptide
  XENP020509 vlCDR3
QQSNEDPFT

SEQ ID NO: 18785 - protein, 450 aa, Artificial Sequence
  Description of Artificial Sequence: Synthetic polypeptide
  XENP020510 7G8_H0.58_L0_IgG1_PVA_/S267K Heavy Chain
EVKLEESGGGLVQPGGSMKLSCAASGFTFSDAWMDWVRQSPEKGLEWVAEIRTKQNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18786 - protein, 121 aa, Artificial Sequence
  Description of Artificial Sequence: Synthetic polypeptide
  VH of XENP020510
EVKLEESGGGLVQPGGSMKLSCAASGFTFSDAWMDWVRQSPEKGLEWVAEIRTKQNNHATYYAESVKGRFTISRDDSKSSVYLQMNSLRAEDTGIYYCTRLANWDWYFDVWGAGTTVTVSS

SEQ ID NO: 18787 - protein, 5 aa, Artificial Sequence
  Description of Artificial Sequence: Synthetic peptide
  XENP020510 vhCDR1
DAWMD

SEQ ID NO: 18788 - protein, 19 aa, Artificial Sequence
  Description of Artificial Sequence: Synthetic peptide
  XENP020510 vhCDR2
EIRTKQNNHATYYAESVKG

SEQ ID NO: 18789 - protein, 10 aa, Artificial Sequence
  Description of Artificial Sequence: Synthetic peptide
  XENP020510 vhCDR3
LANWDWYFDV

SEQ ID NO: 18790 - protein, 218 aa, Artificial Sequence; identical to SEQ ID NO: 17590
  Description of Artificial Sequence: Synthetic polypeptide
  XENP020510 7G8_H0.58_L0_IgG1_PVA_/S267K Light Chain

SEQ ID NO: 18791 - protein, 111 aa, Artificial Sequence; identical to SEQ ID NO: 17591
  Description of Artificial Sequence: Synthetic polypeptide
  VL of XENP020510

SEQ ID NO: 18792 - protein, 15 aa, Artificial Sequence
  Description of Artificial Sequence: Synthetic peptide
  XENP020510 vlCDR1
KASQSVDYDGDSYMN

SEQ ID NO: 18793 - protein, 7 aa, Artificial Sequence
  Description of Artificial Sequence: Synthetic peptide
  XENP020510 vlCDR2
AASNLES

SEQ ID NO: 18794 - protein, 9 aa, Artificial Sequence
  Description of Artificial Sequence: Synthetic peptide
  XENP020510 vlCDR3
QQSNEDPFT

SEQ ID NO: 18795 - protein, 450 aa, Artificial Sequence
  Description of Artificial Sequence: Synthetic polypeptide
  XENP020511 7G8_H0.59_L0_IgG1_PVA_/S267K Heavy Chain
EVKLEESGGGLVQPGGSMKLSCAASGFTFSDAWMDWVRQSPEKGLEWVAEIRTKDNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18796 - protein, 121 aa, Artificial Sequence
  Description of Artificial Sequence: Synthetic polypeptide
  VH of XENP020511
EVKLEESGGGLVQPGGSMKLSCAASGFTFSDAWMDWVRQSPEKGLEWVAEIRTKDNNHATYYAESVKGRFTISRDDSKSSVYLQMNSLRAEDTGIYYCTRLANWDWYFDVWGAGTTVTVSS

SEQ ID NO: 18797 - protein, 5 aa, Artificial Sequence
  Description of Artificial Sequence: Synthetic peptide
  XENP020511 vhCDR1
DAWMD

SEQ ID NO: 18798 - protein, 19 aa, Artificial Sequence
  Description of Artificial Sequence: Synthetic peptide
  XENP020511 vhCDR2
EIRTKDNNHATYYAESVKG

SEQ ID NO: 18799 - protein, 10 aa, Artificial Sequence
  Description of Artificial Sequence: Synthetic peptide
  XENP020511 vhCDR3
LANWDWYFDV

SEQ ID NO: 18800 - protein, 218 aa, Artificial Sequence; identical to SEQ ID NO: 17590
  Description of Artificial Sequence: Synthetic polypeptide
  XENP020511 7G8_H0.59_L0_IgG1_PVA_/S267K Light Chain

SEQ ID NO: 18801 - protein, 111 aa, Artificial Sequence; identical to SEQ ID NO: 17591
  Description of Artificial Sequence: Synthetic polypeptide
  VL of XENP020511

SEQ ID NO: 18802 - protein, 15 aa, Artificial Sequence
  Description of Artificial Sequence: Synthetic peptide
  XENP020511 vlCDR1
KASQSVDYDGDSYMN

SEQ ID NO: 18803 - protein, 7 aa, Artificial Sequence
  Description of Artificial Sequence: Synthetic peptide
  XENP020511 vlCDR2
AASNLES

SEQ ID NO: 18804 - protein, 9 aa, Artificial Sequence
  Description of Artificial Sequence: Synthetic peptide
  XENP020511 vlCDR3
QQSNEDPFT

SEQ ID NO: 18805 - protein, 450 aa, Artificial Sequence
  Description of Artificial Sequence: Synthetic polypeptide
  XENP020512 7G8_H0.60_L0_IgG1_PVA_/S267K Heavy Chain
EVKLEESGGGLVQPGGSMKLSCAASGFTFSDAWMDWVRQSPEKGLEWVAEIRTKLNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18806 - protein, 121 aa, Artificial Sequence
  Description of Artificial Sequence: Synthetic polypeptide
  VH of XENP020512
EVKLEESGGGLVQPGGSMKLSCAASGFTFSDAWMDWVRQSPEKGLEWVAEIRTKLNNHATYYAESVKGRFTISRDDSKSSVYLQMNSLRAEDTGIYYCTRLANWDWYFDVWGAGTTVTVSS

SEQ ID NO: 18807 - protein, 5 aa, Artificial Sequence
  Description of Artificial Sequence: Synthetic peptide
  XENP020512 vhCDR1
DAWMD

SEQ ID NO: 18808 - protein, 19 aa, Artificial Sequence
  Description of Artificial Sequence: Synthetic peptide
  XENP020512 vhCDR2
EIRTKLNNHATYYAESVKG

SEQ ID NO: 18809 - protein, 10 aa, Artificial Sequence
  Description of Artificial Sequence: Synthetic peptide
  XENP020512 vhCDR3
LANWDWYFDV

SEQ ID NO: 18810 - protein, 218 aa, Artificial Sequence; identical to SEQ ID NO: 17590
  Description of Artificial Sequence: Synthetic polypeptide
  XENP020512 7G8_H0.60_L0_IgG1_PVA_/S267K Light Chain

SEQ ID NO: 18811 - protein, 111 aa, Artificial Sequence; identical to SEQ ID NO: 17591
  Description of Artificial Sequence: Synthetic polypeptide
  VL of XENP020512

SEQ ID NO: 18812 - protein, 15 aa, Artificial Sequence
  Description of Artificial Sequence: Synthetic peptide
  XENP020512 vlCDR1
KASQSVDYDGDSYMN

SEQ ID NO: 18813 - protein, 7 aa, Artificial Sequence
  Description of Artificial Sequence: Synthetic peptide
  XENP020512 vlCDR2
AASNLES

SEQ ID NO: 18814 - protein, 9 aa, Artificial Sequence
  Description of Artificial Sequence: Synthetic peptide
  XENP020512 vlCDR3
QQSNEDPFT

SEQ ID NO: 18815 - protein, 450 aa, Artificial Sequence
  Description of Artificial Sequence: Synthetic polypeptide
  XENP020513 7G8_H0.61_L0_IgG1_PVA_/S267K Heavy Chain
EVKLEESGGGLVQPGGSMKLSCAASGFTFSDAWMDWVRQSPEKGLEWVAEIRTKKNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18816 - protein, 121 aa, Artificial Sequence
  Description of Artificial Sequence: Synthetic polypeptide
  VH of XENP020513
EVKLEESGGGLVQPGGSMKLSCAASGFTFSDAWMDWVRQSPEKGLEWVAEIRTKKNNHATYYAESVKGRFTISRDDSKSSVYLQMNSLRAEDTGIYYCTRLANWDWYFDVWGAGTTVTVSS

SEQ ID NO: 18817 - protein, 5 aa, Artificial Sequence
  Description of Artificial Sequence: Synthetic peptide
  XENP020513 vhCDR1
DAWMD

SEQ ID NO: 18818 - protein, 19 aa, Artificial Sequence
  Description of Artificial Sequence: Synthetic peptide
  XENP020513 vhCDR2
EIRTKKNNHATYYAESVKG

SEQ ID NO: 18819 - protein, 10 aa, Artificial Sequence
  Description of Artificial Sequence: Synthetic peptide
  XENP020513 vhCDR3
LANWDWYFDV

SEQ ID NO: 18820 - protein, 218 aa, Artificial Sequence; identical to SEQ ID NO: 17590
  Description of Artificial Sequence: Synthetic polypeptide
  XENP020513 7G8_H0.61_L0_IgG1_PVA_/S267K Light Chain

SEQ ID NO: 18821 - protein, 111 aa, Artificial Sequence; identical to SEQ ID NO: 17591
  Description of Artificial Sequence: Synthetic polypeptide
  VL of XENP020513

SEQ ID NO: 18822 - protein, 15 aa, Artificial Sequence
  Description of Artificial Sequence: Synthetic peptide
  XENP020513 vlCDR1
KASQSVDYDGDSYMN

SEQ ID NO: 18823 - protein, 7 aa, Artificial Sequence
  Description of Artificial Sequence: Synthetic peptide
  XENP020513 vlCDR2
AASNLES

SEQ ID NO: 18824 - protein, 9 aa, Artificial Sequence
  Description of Artificial Sequence: Synthetic peptide
  XENP020513 vlCDR3
QQSNEDPFT

SEQ ID NO: 18825 - protein, 450 aa, Artificial Sequence
  Description of Artificial Sequence: Synthetic polypeptide
  XENP020514 7G8_H0.62_L0_IgG1_PVA_/S267K Heavy Chain
EVKLEESGGGLVQPGGSMKLSCAASGFTFSDAWMDWVRQSPEKGLEWVAEIRTKYNNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18826 - protein, 121 aa, Artificial Sequence
  Description of Artificial Sequence: Synthetic polypeptide
  VH of XENP020514
EVKLEESGGGLVQPGGSMKLSCAASGFTFSDAWMDWVRQSPEKGLEWVAEIRTKYNNHATYYAESVKGRFTISRDDSKSSVYLQMNSLRAEDTGIYYCTRLANWDWYFDVWGAGTTVTVSS

SEQ ID NO: 18827 - protein, 5 aa, Artificial Sequence
  Description of Artificial Sequence: Synthetic peptide
  XENP020514 vhCDR1
DAWMD

SEQ ID NO: 18828 - protein, 19 aa, Artificial Sequence
  Description of Artificial Sequence: Synthetic peptide
  XENP020514 vhCDR2
EIRTKYNNHATYYAESVKG

SEQ ID NO: 18829 - protein, 10 aa, Artificial Sequence
  Description of Artificial Sequence: Synthetic peptide
  XENP020514 vhCDR3
LANWDWYFDV

SEQ ID NO: 18830 - protein, 218 aa, Artificial Sequence; identical to SEQ ID NO: 17590
  Description of Artificial Sequence: Synthetic polypeptide
  XENP020514 7G8_H0.62_L0_IgG1_PVA_/S267K Light Chain

SEQ ID NO: 18831 - protein, 111 aa, Artificial Sequence; identical to SEQ ID NO: 17591
  Description of Artificial Sequence: Synthetic polypeptide
  VL of XENP020514

SEQ ID NO: 18832 - protein, 15 aa, Artificial Sequence
  Description of Artificial Sequence: Synthetic peptide
  XENP020514 vlCDR1
KASQSVDYDGDSYMN

SEQ ID NO: 18833 - protein, 7 aa, Artificial Sequence
  Description of Artificial Sequence: Synthetic peptide
  XENP020514 vlCDR2
AASNLES

SEQ ID NO: 18834 - protein, 9 aa, Artificial Sequence
  Description of Artificial Sequence: Synthetic peptide
  XENP020514 vlCDR3
QQSNEDPFT

SEQ ID NO: 18835 - protein, 450 aa, Artificial Sequence
  Description of Artificial Sequence: Synthetic polypeptide
  XENP020515 7G8_H0.63_L0_IgG1_PVA_/S267K Heavy Chain
EVKLEESGGGLVQPGGSMKLSCAASGFTFSDAWMDWVRQSPEKGLEWVAEIRTKADNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18836 - protein, 121 aa, Artificial Sequence
  Description of Artificial Sequence: Synthetic polypeptide
  VH of XENP020515
EVKLEESGGGLVQPGGSMKLSCAASGFTFSDAWMDWVRQSPEKGLEWVAEIRTKADNHATYYAESVKGRFTISRDDSKSSVYLQMNSLRAEDTGIYYCTRLANWDWYFDVWGAGTTVTVSS

SEQ ID NO: 18837 - protein, 5 aa, Artificial Sequence
  Description of Artificial Sequence: Synthetic peptide
  XENP020515 vhCDR1
DAWMD

SEQ ID NO: 18838 - protein, 19 aa, Artificial Sequence
  Description of Artificial Sequence: Synthetic peptide
  XENP020515 vhCDR2
EIRTKADNHATYYAESVKG

SEQ ID NO: 18839 - protein, 10 aa, Artificial Sequence
  Description of Artificial Sequence: Synthetic peptide
  XENP020515 vhCDR3
LANWDWYFDV

SEQ ID NO: 18840 - protein, 218 aa, Artificial Sequence; identical to SEQ ID NO: 17590
  Description of Artificial Sequence: Synthetic polypeptide
  XENP020515 7G8_H0.63_L0_IgG1_PVA_/S267K Light Chain

SEQ ID NO: 18841 - protein, 111 aa, Artificial Sequence; identical to SEQ ID NO: 17591
  Description of Artificial Sequence: Synthetic polypeptide
  VL of XENP020515

SEQ ID NO: 18842 - protein, 15 aa, Artificial Sequence
  Description of Artificial Sequence: Synthetic peptide
  XENP020515 vlCDR1
KASQSVDYDGDSYMN

SEQ ID NO: 18843 - protein, 7 aa, Artificial Sequence
  Description of Artificial Sequence: Synthetic peptide
  XENP020515 vlCDR2
AASNLES

SEQ ID NO: 18844 - protein, 9 aa, Artificial Sequence
  Description of Artificial Sequence: Synthetic peptide
  XENP020515 vlCDR3
QQSNEDPFT

SEQ ID NO: 18845 - protein, 450 aa, Artificial Sequence
  Description of Artificial Sequence: Synthetic polypeptide
  XENP020516 7G8_H0.64_L0_IgG1_PVA_/S267K Heavy Chain
EVKLEESGGGLVQPGGSMKLSCAASGFTFSDAWMDWVRQSPEKGLEWVAEIRTKAHNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18846 - protein, 121 aa, Artificial Sequence
  Description of Artificial Sequence: Synthetic polypeptide
  VH of XENP020516
EVKLEESGGGLVQPGGSMKLSCAASGFTFSDAWMDWVRQSPEKGLEWVAEIRTKAHNHATYYAESVKGRFTISRDDSKSSVYLQMNSLRAEDTGIYYCTRLANWDWYFDVWGAGTTVTVSS

SEQ ID NO: 18847 - protein, 5 aa, Artificial Sequence
  Description of Artificial Sequence: Synthetic peptide
  XENP020516 vhCDR1
DAWMD

SEQ ID NO: 18848 - protein, 19 aa, Artificial Sequence
  Description of Artificial Sequence: Synthetic peptide
  XENP020516 vhCDR2
EIRTKAHNHATYYAESVKG

SEQ ID NO: 18849 - protein, 10 aa, Artificial Sequence
  Description of Artificial Sequence: Synthetic peptide
  XENP020516 vhCDR3
LANWDWYFDV

SEQ ID NO: 18850 - protein, 218 aa, Artificial Sequence; identical to SEQ ID NO: 17590
  Description of Artificial Sequence: Synthetic polypeptide
  XENP020516 7G8_H0.64_L0_IgG1_PVA_/S267K Light Chain

SEQ ID NO: 18851 - protein, 111 aa, Artificial Sequence; identical to SEQ ID NO: 17591
  Description of Artificial Sequence: Synthetic polypeptide
  VL of XENP020516

SEQ ID NO: 18852 - protein, 15 aa, Artificial Sequence
  Description of Artificial Sequence: Synthetic peptide
  XENP020516 vlCDR1
KASQSVDYDGDSYMN

SEQ ID NO: 18853 - protein, 7 aa, Artificial Sequence
  Description of Artificial Sequence: Synthetic peptide
  XENP020516 vlCDR2
AASNLES

SEQ ID NO: 18854 - protein, 9 aa, Artificial Sequence
  Description of Artificial Sequence: Synthetic peptide
  XENP020516 vlCDR3
QQSNEDPFT

SEQ ID NO: 18855 - protein, 450 aa, Artificial Sequence
  Description of Artificial Sequence: Synthetic polypeptide
  XENP020517 7G8_H0.65_L0_IgG1_PVA_/S267K Heavy Chain
EVKLEESGGGLVQPGGSMKLSCAASGFTFSDAWMDWVRQSPEKGLEWVAEIRTKAENHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18856 - protein, 121 aa, Artificial Sequence
  Description of Artificial Sequence: Synthetic polypeptide
  VH of XENP020517
EVKLEESGGGLVQPGGSMKLSCAASGFTFSDAWMDWVRQSPEKGLEWVAEIRTKAENHATYYAESVKGRFTISRDDSKSSVYLQMNSLRAEDTGIYYCTRLANWDWYFDVWGAGTTVTVSS

SEQ ID NO: 18857 - protein, 5 aa, Artificial Sequence
  Description of Artificial Sequence: Synthetic peptide
  XENP020517 vhCDR1
DAWMD

SEQ ID NO: 18858 - protein, 19 aa, Artificial Sequence
  Description of Artificial Sequence: Synthetic peptide
  XENP020517 vhCDR2
EIRTKAENHATYYAESVKG

SEQ ID NO: 18859 - protein, 10 aa, Artificial Sequence
  Description of Artificial Sequence: Synthetic peptide
  XENP020517 vhCDR3
LANWDWYFDV

SEQ ID NO: 18860 - protein, 218 aa, Artificial Sequence; identical to SEQ ID NO: 17590
  Description of Artificial Sequence: Synthetic polypeptide
  XENP020517 7G8_H0.65_L0_IgG1_PVA_/S267K Light Chain

SEQ ID NO: 18861 - protein, 111 aa, Artificial Sequence; identical to SEQ ID NO: 17591
  Description of Artificial Sequence: Synthetic polypeptide
  VL of XENP020517

SEQ ID NO: 18862 - protein, 15 aa, Artificial Sequence
  Description of Artificial Sequence: Synthetic peptide
  XENP020517 vlCDR1
KASQSVDYDGDSYMN

SEQ ID NO: 18863 - protein, 7 aa, Artificial Sequence
  Description of Artificial Sequence: Synthetic peptide
  XENP020517 vlCDR2
AASNLES

SEQ ID NO: 18864 - protein, 9 aa, Artificial Sequence
  Description of Artificial Sequence: Synthetic peptide
  XENP020517 vlCDR3
QQSNEDPFT

SEQ ID NO: 18865 - protein, 450 aa, Artificial Sequence
  Description of Artificial Sequence: Synthetic polypeptide
  XENP020518 7G8_H0.66_L0_IgG1_PVA_/S267K Heavy Chain
EVKLEESGGGLVQPGGSMKLSCAASGFTFSDAWMDWVRQSPEKGLEWVAEIRTKASNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18866 - protein, 121 aa, Artificial Sequence
  Description of Artificial Sequence: Synthetic polypeptide
  VH of XENP020518
EVKLEESGGGLVQPGGSMKLSCAASGFTFSDAWMDWVRQSPEKGLEWVAEIRTKASNHATYYAESVKGRFTISRDDSKSSVYLQMNSLRAEDTGIYYCTRLANWDWYFDVWGAGTTVTVSS

SEQ ID NO: 18867 - protein, 5 aa, Artificial Sequence
  Description of Artificial Sequence: Synthetic peptide
  XENP020518 vhCDR1
DAWMD

SEQ ID NO: 18868 - protein, 19 aa, Artificial Sequence
  Description of Artificial Sequence: Synthetic peptide
  XENP020518 vhCDR2
EIRTKASNHATYYAESVKG

SEQ ID NO: 18869 - protein, 10 aa, Artificial Sequence
  Description of Artificial Sequence: Synthetic peptide
  XENP020518 vhCDR3
LANWDWYFDV

SEQ ID NO: 18870 - protein, 218 aa, Artificial Sequence; identical to SEQ ID NO: 17590
  Description of Artificial Sequence: Synthetic polypeptide
  XENP020518 7G8_H0.66_L0_IgG1_PVA_/S267K Light Chain

SEQ ID NO: 18871 - protein, 111 aa, Artificial Sequence; identical to SEQ ID NO: 17591
  Description of Artificial Sequence: Synthetic polypeptide
  VL of XENP020518

SEQ ID NO: 18872 - protein, 15 aa, Artificial Sequence
  Description of Artificial Sequence: Synthetic peptide
  XENP020518 vlCDR1
KASQSVDYDGDSYMN

SEQ ID NO: 18873 - protein, 7 aa, Artificial Sequence
  Description of Artificial Sequence: Synthetic peptide
  XENP020518 vlCDR2
AASNLES

SEQ ID NO: 18874 - protein, 9 aa, Artificial Sequence
  Description of Artificial Sequence: Synthetic peptide
  XENP020518 vlCDR3
QQSNEDPFT

SEQ ID NO: 18875 - protein, 450 aa, Artificial Sequence
  Description of Artificial Sequence: Synthetic polypeptide
  XENP020519 7G8_H0.67_L0_IgG1_PVA_/S267K Heavy Chain
EVKLEESGGGLVQPGGSMKLSCAASGFTFSDAWMDWVRQSPEKGLEWVAEIRTKARNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18876 - protein, 121 aa, Artificial Sequence
  Description of Artificial Sequence: Synthetic polypeptide
  VH of XENP020519
EVKLEESGGGLVQPGGSMKLSCAASGFTFSDAWMDWVRQSPEKGLEWVAEIRTKARNHATYYAESVKGRFTISRDDSKSSVYLQMNSLRAEDTGIYYCTRLANWDWYFDVWGAGTTVTVSS

SEQ ID NO: 18877 - protein, 5 aa, Artificial Sequence
  Description of Artificial Sequence: Synthetic peptide
  XENP020519 vhCDR1
DAWMD

SEQ ID NO: 18878 - protein, 19 aa, Artificial Sequence
  Description of Artificial Sequence: Synthetic peptide
  XENP020519 vhCDR2
EIRTKARNHATYYAESVKG

SEQ ID NO: 18879 - protein, 10 aa, Artificial Sequence
  Description of Artificial Sequence: Synthetic peptide
  XENP020519 vhCDR3
LANWDWYFDV

SEQ ID NO: 18880 - protein, 218 aa, Artificial Sequence; identical to SEQ ID NO: 17590
  Description of Artificial Sequence: Synthetic polypeptide
  XENP020519 7G8_H0.67_L0_IgG1_PVA_/S267K Light Chain

SEQ ID NO: 18881 - protein, 111 aa, Artificial Sequence; identical to SEQ ID NO: 17591
  Description of Artificial Sequence: Synthetic polypeptide
  VL of XENP020519

SEQ ID NO: 18882 - protein, 15 aa, Artificial Sequence
  Description of Artificial Sequence: Synthetic peptide
  XENP020519 vlCDR1
KASQSVDYDGDSYMN

SEQ ID NO: 18883 - protein, 7 aa, Artificial Sequence
  Description of Artificial Sequence: Synthetic peptide
  XENP020519 vlCDR2
AASNLES

SEQ ID NO: 18884 - protein, 9 aa, Artificial Sequence
  Description of Artificial Sequence: Synthetic peptide
  XENP020519 vlCDR3
QQSNEDPFT

SEQ ID NO: 18885 - protein, 450 aa, Artificial Sequence
  Description of Artificial Sequence: Synthetic polypeptide
  XENP020520 7G8_H0.68_L0_IgG1_PVA_/S267K Heavy Chain
EVKLEESGGGLVQPGGSMKLSCAASGFTFSDAWMDWVRQSPEKGLEWVAEIRTKALNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18886 - protein, 121 aa, Artificial Sequence
  Description of Artificial Sequence: Synthetic polypeptide
  VH of XENP020520
EVKLEESGGGLVQPGGSMKLSCAASGFTFSDAWMDWVRQSPEKGLEWVAEIRTKALNHATYYAESVKGRFTISRDDSKSSVYLQMNSLRAEDTGIYYCTRLANWDWYFDVWGAGTTVTVSS

SEQ ID NO: 18887 - protein, 5 aa, Artificial Sequence
  Description of Artificial Sequence: Synthetic peptide
  XENP020520 vhCDR1
DAWMD

SEQ ID NO: 18888 - protein, 19 aa, Artificial Sequence
  Description of Artificial Sequence: Synthetic peptide
  XENP020520 vhCDR2
EIRTKALNHATYYAESVKG

SEQ ID NO: 18889 - protein, 10 aa, Artificial Sequence
  Description of Artificial Sequence: Synthetic peptide
  XENP020520 vhCDR3
LANWDWYFDV

SEQ ID NO: 18890 - protein, 218 aa, Artificial Sequence; identical to SEQ ID NO: 17590
  Description of Artificial Sequence: Synthetic polypeptide
  XENP020520 7G8_H0.68_L0_IgG1_PVA_/S267K Light Chain

SEQ ID NO: 18891 - protein, 111 aa, Artificial Sequence; identical to SEQ ID NO: 17591
  Description of Artificial Sequence: Synthetic polypeptide
  VL of XENP020520

SEQ ID NO: 18892 - protein, 15 aa, Artificial Sequence
  Description of Artificial Sequence: Synthetic peptide
  XENP020520 vlCDR1
KASQSVDYDGDSYMN

SEQ ID NO: 18893 - protein, 7 aa, Artificial Sequence
  Description of Artificial Sequence: Synthetic peptide
  XENP020520 vlCDR2
AASNLES

SEQ ID NO: 18894 - protein, 9 aa, Artificial Sequence
  Description of Artificial Sequence: Synthetic peptide
  XENP020520 vlCDR3
QQSNEDPFT

SEQ ID NO: 18895 - protein, 450 aa, Artificial Sequence
  Description of Artificial Sequence: Synthetic polypeptide
  XENP020521 7G8_H0.69_L0_IgG1_PVA_/S267K Heavy Chain
EVKLEESGGGLVQPGGSMKLSCAASGFTFSDAWMDWVRQSPEKGLEWVAEIRTKATNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18896 - protein, 121 aa, Artificial Sequence
  Description of Artificial Sequence: Synthetic polypeptide
  VH of XENP020521
EVKLEESGGGLVQPGGSMKLSCAASGFTFSDAWMDWVRQSPEKGLEWVAEIRTKATNHATYYAESVKGRFTISRDDSKSSVYLQMNSLRAEDTGIYYCTRLANWDWYFDVWGAGTTVTVSS

SEQ ID NO: 18897 - protein, 5 aa, Artificial Sequence
  Description of Artificial Sequence: Synthetic peptide
  XENP020521 vhCDR1
DAWMD

SEQ ID NO: 18898 - protein, 19 aa, Artificial Sequence
  Description of Artificial Sequence: Synthetic peptide
  XENP020521 vhCDR2
EIRTKATNHATYYAESVKG

SEQ ID NO: 18899 - protein, 10 aa, Artificial Sequence
  Description of Artificial Sequence: Synthetic peptide
  XENP020521 vhCDR3
LANWDWYFDV

SEQ ID NO: 18900 - protein, 218 aa, Artificial Sequence; identical to SEQ ID NO: 17590
  Description of Artificial Sequence: Synthetic polypeptide
  XENP020521 7G8_H0.69_L0_IgG1_PVA_/S267K Light Chain

SEQ ID NO: 18901 - protein, 111 aa, Artificial Sequence; identical to SEQ ID NO: 17591
  Description of Artificial Sequence: Synthetic polypeptide
  VL of XENP020521

SEQ ID NO: 18902 - protein, 15 aa, Artificial Sequence
  Description of Artificial Sequence: Synthetic peptide
  XENP020521 vlCDR1
KASQSVDYDGDSYMN

SEQ ID NO: 18903 - protein, 7 aa, Artificial Sequence
  Description of Artificial Sequence: Synthetic peptide
  XENP020521 vlCDR2
AASNLES

SEQ ID NO: 18904 - protein, 9 aa, Artificial Sequence
  Description of Artificial Sequence: Synthetic peptide
  XENP020521 vlCDR3
QQSNEDPFT

SEQ ID NO: 18905 - protein, 450 aa, Artificial Sequence
  Description of Artificial Sequence: Synthetic polypeptide
  XENP020522 7G8_H0.70_L0_IgG1_PVA_/S267K Heavy Chain
EVKLEESGGGLVQPGGSMKLSCAASGFTFSDAWMDWVRQSPEKGLEWVAEIRTKAGNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18906 - protein, 121 aa, Artificial Sequence
  Description of Artificial Sequence: Synthetic polypeptide
  VH of XENP020522
EVKLEESGGGLVQPGGSMKLSCAASGFTFSDAWMDWVRQSPEKGLEWVAEIRTKAGNHATYYAESVKGRFTISRDDSKSSVYLQMNSLRAEDTGIYYCTRLANWDWYFDVWGAGTTVTVSS

SEQ ID NO: 18907 - protein, 5 aa, Artificial Sequence
  Description of Artificial Sequence: Synthetic peptide
  XENP020522 vhCDR1
DAWMD

SEQ ID NO: 18908 - protein, 19 aa, Artificial Sequence
  Description of Artificial Sequence: Synthetic peptide
  XENP020522 vhCDR2
EIRTKAGNHATYYAESVKG

SEQ ID NO: 18909 - protein, 10 aa, Artificial Sequence
  Description of Artificial Sequence: Synthetic peptide
  XENP020522 vhCDR3
LANWDWYFDV

SEQ ID NO: 18910 - protein, 218 aa, Artificial Sequence; identical to SEQ ID NO: 17590
  Description of Artificial Sequence: Synthetic polypeptide
  XENP020522 7G8_H0.70_L0_IgG1_PVA_/S267K Light Chain

SEQ ID NO: 18911 - protein, 111 aa, Artificial Sequence; identical to SEQ ID NO: 17591
  Description of Artificial Sequence: Synthetic polypeptide
  VL of XENP020522

SEQ ID NO: 18912 - protein, 15 aa, Artificial Sequence
  Description of Artificial Sequence: Synthetic peptide
  XENP020522 vlCDR1
KASQSVDYDGDSYMN

SEQ ID NO: 18913 - protein, 7 aa, Artificial Sequence
  Description of Artificial Sequence: Synthetic peptide
  XENP020522 vlCDR2
AASNLES

SEQ ID NO: 18914 - protein, 9 aa, Artificial Sequence
  Description of Artificial Sequence: Synthetic peptide
  XENP020522 vlCDR3
QQSNEDPFT

SEQ ID NO: 18915 - protein, 450 aa, Artificial Sequence
  Description of Artificial Sequence: Synthetic polypeptide
  XENP020523 7G8_H0.71_L0_IgG1_PVA_/S267K Heavy Chain
EVKLEESGGGLVQPGGSMKLSCAASGFTFSDAWMDWVRQSPEKGLEWVAEIRTKAYNHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18916 - protein, 121 aa, Artificial Sequence
  Description of Artificial Sequence: Synthetic polypeptide
  VH of XENP020523
EVKLEESGGGLVQPGGSMKLSCAASGFTFSDAWMDWVRQSPEKGLEWVAEIRTKAYNHATYYAESVKGRFTISRDDSKSSVYLQMNSLRAEDTGIYYCTRLANWDWYFDVWGAGTTVTVSS

SEQ ID NO: 18917 - protein, 5 aa, Artificial Sequence
  Description of Artificial Sequence: Synthetic peptide
  XENP020523 vhCDR1
DAWMD

SEQ ID NO: 18918 - protein, 19 aa, Artificial Sequence
  Description of Artificial Sequence: Synthetic peptide
  XENP020523 vhCDR2
EIRTKAYNHATYYAESVKG

SEQ ID NO: 18919 - protein, 10 aa, Artificial Sequence
  Description of Artificial Sequence: Synthetic peptide
  XENP020523 vhCDR3
LANWDWYFDV

SEQ ID NO: 18920 - protein, 218 aa, Artificial Sequence; identical to SEQ ID NO: 17590
  Description of Artificial Sequence: Synthetic polypeptide
  XENP020523 7G8_H0.71_L0_IgG1_PVA_/S267K Light Chain

SEQ ID NO: 18921 - protein, 111 aa, Artificial Sequence; identical to SEQ ID NO: 17591
  Description of Artificial Sequence: Synthetic polypeptide
  VL of XENP020523

SEQ ID NO: 18922 - protein, 15 aa, Artificial Sequence
  Description of Artificial Sequence: Synthetic peptide
  XENP020523 vlCDR1
KASQSVDYDGDSYMN

SEQ ID NO: 18923 - protein, 7 aa, Artificial Sequence
  Description of Artificial Sequence: Synthetic peptide
  XENP020523 vlCDR2
AASNLES

SEQ ID NO: 18924 - protein, 9 aa, Artificial Sequence
  Description of Artificial Sequence: Synthetic peptide
  XENP020523 vlCDR3
QQSNEDPFT

SEQ ID NO: 18925 - protein, 450 aa, Artificial Sequence
  Description of Artificial Sequence: Synthetic polypeptide
  XENP020524 7G8_H0.72_L0_IgG1_PVA_/S267K Heavy Chain
EVKLEESGGGLVQPGGSMKLSCAASGFTFSDAWMDWVRQSPEKGLEWVAEIRTKANDHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18926 - protein, 121 aa, Artificial Sequence
  Description of Artificial Sequence: Synthetic polypeptide
  VH of XENP020524
EVKLEESGGGLVQPGGSMKLSCAASGFTFSDAWMDWVRQSPEKGLEWVAEIRTKANDHATYYAESVKGRFTISRDDSKSSVYLQMNSLRAEDTGIYYCTRLANWDWYFDVWGAGTTVTVSS

SEQ ID NO: 18927 - protein, 5 aa, Artificial Sequence
  Description of Artificial Sequence: Synthetic peptide
  XENP020524 vhCDR1
DAWMD

SEQ ID NO: 18928 - protein, 19 aa, Artificial Sequence
  Description of Artificial Sequence: Synthetic peptide
  XENP020524 vhCDR2
EIRTKANDHATYYAESVKG

SEQ ID NO: 18929 - protein, 10 aa, Artificial Sequence
  Description of Artificial Sequence: Synthetic peptide
  XENP020524 vhCDR3
LANWDWYFDV

SEQ ID NO: 18930 - protein, 218 aa, Artificial Sequence; identical to SEQ ID NO: 17590
  Description of Artificial Sequence: Synthetic polypeptide
  XENP020524 7G8_H0.72_L0_IgG1_PVA_/S267K Light Chain

SEQ ID NO: 18931 - protein, 111 aa, Artificial Sequence; identical to SEQ ID NO: 17591
  Description of Artificial Sequence: Synthetic polypeptide
  VL of XENP020524

SEQ ID NO: 18932 - protein, 15 aa, Artificial Sequence
  Description of Artificial Sequence: Synthetic peptide
  XENP020524 vlCDR1
KASQSVDYDGDSYMN

SEQ ID NO: 18933 - protein, 7 aa, Artificial Sequence
  Description of Artificial Sequence: Synthetic peptide
  XENP020524 vlCDR2
AASNLES

SEQ ID NO: 18934 - protein, 9 aa, Artificial Sequence
  Description of Artificial Sequence: Synthetic peptide
  XENP020524 vlCDR3
QQSNEDPFT

SEQ ID NO: 18935 - protein, 450 aa, Artificial Sequence
  Description of Artificial Sequence: Synthetic polypeptide
  XENP020525 7G8_H0.73_L0_IgG1_PVA_/S267K Heavy Chain
EVKLEESGGGLVQPGGSMKLSCAASGFTFSDAWMDWVRQSPEKGLEWVAEIRTKANHHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18936 - protein, 121 aa, Artificial Sequence
  Description of Artificial Sequence: Synthetic polypeptide
  VH of XENP020525
EVKLEESGGGLVQPGGSMKLSCAASGFTFSDAWMDWVRQSPEKGLEWVAEIRTKANHHATYYAESVKGRFTISRDDSKSSVYLQMNSLRAEDTGIYYCTRLANWDWYFDVWGAGTTVTVSS

SEQ ID NO: 18937 - protein, 5 aa, Artificial Sequence
  Description of Artificial Sequence: Synthetic peptide
  XENP020525 vhCDR1
DAWMD

SEQ ID NO: 18938 - protein, 19 aa, Artificial Sequence
  Description of Artificial Sequence: Synthetic peptide
  XENP020525 vhCDR2
EIRTKANHHATYYAESVKG

SEQ ID NO: 18939 - protein, 10 aa, Artificial Sequence
  Description of Artificial Sequence: Synthetic peptide
  XENP020525 vhCDR3
LANWDWYFDV

SEQ ID NO: 18940 - protein, 218 aa, Artificial Sequence; identical to SEQ ID NO: 17590
  Description of Artificial Sequence: Synthetic polypeptide
  XENP020525 7G8_H0.73_L0_IgG1_PVA_/S267K Light Chain

SEQ ID NO: 18941 - protein, 111 aa, Artificial Sequence; identical to SEQ ID NO: 17591
  Description of Artificial Sequence: Synthetic polypeptide
  VL of XENP020525

SEQ ID NO: 18942 - protein, 15 aa, Artificial Sequence
  Description of Artificial Sequence: Synthetic peptide
  XENP020525 vlCDR1
KASQSVDYDGDSYMN

SEQ ID NO: 18943 - protein, 7 aa, Artificial Sequence
  Description of Artificial Sequence: Synthetic peptide
  XENP020525 vlCDR2
AASNLES

SEQ ID NO: 18944 - protein, 9 aa, Artificial Sequence
  Description of Artificial Sequence: Synthetic peptide
  XENP020525 vlCDR3
QQSNEDPFT

SEQ ID NO: 18945 - protein, 450 aa, Artificial Sequence
  Description of Artificial Sequence: Synthetic polypeptide
  XENP020526 7G8_H0.74_L0_IgG1_PVA_/S267K Heavy Chain
EVKLEESGGGLVQPGGSMKLSCAASGFTFSDAWMDWVRQSPEKGLEWVAEIRTKANEHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18946 - protein, 121 aa, Artificial Sequence
  Description of Artificial Sequence: Synthetic polypeptide
  VH of XENP020526
EVKLEESGGGLVQPGGSMKLSCAASGFTFSDAWMDWVRQSPEKGLEWVAEIRTKANEHATYYAESVKGRFTISRDDSKSSVYLQMNSLRAEDTGIYYCTRLANWDWYFDVWGAGTTVTVSS

SEQ ID NO: 18947 - protein, 5 aa, Artificial Sequence
  Description of Artificial Sequence: Synthetic peptide
  XENP020526 vhCDR1
DAWMD

SEQ ID NO: 18948 - protein, 19 aa, Artificial Sequence
  Description of Artificial Sequence: Synthetic peptide
  XENP020526 vhCDR2
EIRTKANEHATYYAESVKG

SEQ ID NO: 18949 - protein, 10 aa, Artificial Sequence
  Description of Artificial Sequence: Synthetic peptide
  XENP020526 vhCDR3
LANWDWYFDV

SEQ ID NO: 18950 - protein, 218 aa, Artificial Sequence; identical to SEQ ID NO: 17590
  Description of Artificial Sequence: Synthetic polypeptide
  XENP020526 7G8_H0.74_L0_IgG1_PVA_/S267K Light Chain

SEQ ID NO: 18951 - protein, 111 aa, Artificial Sequence; identical to SEQ ID NO: 17591
  Description of Artificial Sequence: Synthetic polypeptide
  VL of XENP020526

SEQ ID NO: 18952 - protein, 15 aa, Artificial Sequence
  Description of Artificial Sequence: Synthetic peptide
  XENP020526 vlCDR1
KASQSVDYDGDSYMN

SEQ ID NO: 18953 - protein, 7 aa, Artificial Sequence
  Description of Artificial Sequence: Synthetic peptide
  XENP020526 vlCDR2
AASNLES

SEQ ID NO: 18954 - protein, 9 aa, Artificial Sequence
  Description of Artificial Sequence: Synthetic peptide
  XENP020526 vlCDR3
QQSNEDPFT

SEQ ID NO: 18955 - protein, 450 aa, Artificial Sequence
  Description of Artificial Sequence: Synthetic polypeptide
  XENP020527 7G8_H0.75_L0_IgG1_PVA_/S267K Heavy Chain
EVKLEESGGGLVQPGGSMKLSCAASGFTFSDAWMDWVRQSPEKGLEWVAEIRTKANSHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18956 - protein, 121 aa, Artificial Sequence
  Description of Artificial Sequence: Synthetic polypeptide
  VH of XENP020527
EVKLEESGGGLVQPGGSMKLSCAASGFTFSDAWMDWVRQSPEKGLEWVAEIRTKANSHATYYAESVKGRFTISRDDSKSSVYLQMNSLRAEDTGIYYCTRLANWDWYFDVWGAGTTVTVSS

SEQ ID NO: 18957 - protein, 5 aa, Artificial Sequence
  Description of Artificial Sequence: Synthetic peptide
  XENP020527 vhCDR1
DAWMD

SEQ ID NO: 18958 - protein, 19 aa, Artificial Sequence
  Description of Artificial Sequence: Synthetic peptide
  XENP020527 vhCDR2
EIRTKANSHATYYAESVKG

SEQ ID NO: 18959 - protein, 10 aa, Artificial Sequence
  Description of Artificial Sequence: Synthetic peptide
  XENP020527 vhCDR3
LANWDWYFDV

SEQ ID NO: 18960 - protein, 218 aa, Artificial Sequence; identical to SEQ ID NO: 17590
  Description of Artificial Sequence: Synthetic polypeptide
  XENP020527 7G8_H0.75_L0_IgG1_PVA_/S267K Light Chain

SEQ ID NO: 18961 - protein, 111 aa, Artificial Sequence; identical to SEQ ID NO: 17591
  Description of Artificial Sequence: Synthetic polypeptide
  VL of XENP020527

SEQ ID NO: 18962 - protein, 15 aa, Artificial Sequence
  Description of Artificial Sequence: Synthetic peptide
  XENP020527 vlCDR1
KASQSVDYDGDSYMN

SEQ ID NO: 18963 - protein, 7 aa, Artificial Sequence
  Description of Artificial Sequence: Synthetic peptide
  XENP020527 vlCDR2
AASNLES

SEQ ID NO: 18964 - protein, 9 aa, Artificial Sequence
  Description of Artificial Sequence: Synthetic peptide
  XENP020527 vlCDR3
QQSNEDPFT

SEQ ID NO: 18965 - protein, 450 aa, Artificial Sequence
  Description of Artificial Sequence: Synthetic polypeptide
  XENP020528 7G8_H0.76_L0_IgG1_PVA_/S267K Heavy Chain
EVKLEESGGGLVQPGGSMKLSCAASGFTFSDAWMDWVRQSPEKGLEWVAEIRTKANRHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18966 - protein, 121 aa, Artificial Sequence
  Description of Artificial Sequence: Synthetic polypeptide
  VH of XENP020528
EVKLEESGGGLVQPGGSMKLSCAASGFTFSDAWMDWVRQSPEKGLEWVAEIRTKANRHATYYAESVKGRFTISRDDSKSSVYLQMNSLRAEDTGIYYCTRLANWDWYFDVWGAGTTVTVSS

SEQ ID NO: 18967 - protein, 5 aa, Artificial Sequence
  Description of Artificial Sequence: Synthetic peptide
  XENP020528 vhCDR1
DAWMD

SEQ ID NO: 18968 - protein, 19 aa, Artificial Sequence
  Description of Artificial Sequence: Synthetic peptide
  XENP020528 vhCDR2
EIRTKANRHATYYAESVKG

SEQ ID NO: 18969 - protein, 10 aa, Artificial Sequence
  Description of Artificial Sequence: Synthetic peptide
  XENP020528 vhCDR3
LANWDWYFDV

SEQ ID NO: 18970 - protein, 218 aa, Artificial Sequence; identical to SEQ ID NO: 17590
  Description of Artificial Sequence: Synthetic polypeptide
  XENP020528 7G8_H0.76_L0_IgG1_PVA_/S267K Light Chain

SEQ ID NO: 18971 - protein, 111 aa, Artificial Sequence; identical to SEQ ID NO: 17591
  Description of Artificial Sequence: Synthetic polypeptide
  VL of XENP020528

SEQ ID NO: 18972 - protein, 15 aa, Artificial Sequence
  Description of Artificial Sequence: Synthetic peptide
  XENP020528 vlCDR1
KASQSVDYDGDSYMN

SEQ ID NO: 18973 - protein, 7 aa, Artificial Sequence
  Description of Artificial Sequence: Synthetic peptide
  XENP020528 vlCDR2
AASNLES

SEQ ID NO: 18974 - protein, 9 aa, Artificial Sequence
  Description of Artificial Sequence: Synthetic peptide
  XENP020528 vlCDR3
QQSNEDPFT

SEQ ID NO: 18975 - protein, 450 aa, Artificial Sequence
  Description of Artificial Sequence: Synthetic polypeptide
  XENP020529 7G8_H0.77_L0_IgG1_PVA_/S267K Heavy Chain
EVKLEESGGGLVQPGGSMKLSCAASGFTFSDAWMDWVRQSPEKGLEWVAEIRTKANLHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18976 - protein, 121 aa, Artificial Sequence
  Description of Artificial Sequence: Synthetic polypeptide
  VH of XENP020529
EVKLEESGGGLVQPGGSMKLSCAASGFTFSDAWMDWVRQSPEKGLEWVAEIRTKANLHATYYAESVKGRFTISRDDSKSSVYLQMNSLRAEDTGIYYCTRLANWDWYFDVWGAGTTVTVSS

SEQ ID NO: 18977 - protein, 5 aa, Artificial Sequence
  Description of Artificial Sequence: Synthetic peptide
  XENP020529 vhCDR1
DAWMD

SEQ ID NO: 18978 - protein, 19 aa, Artificial Sequence
  Description of Artificial Sequence: Synthetic peptide
  XENP020529 vhCDR2
EIRTKANLHATYYAESVKG

SEQ ID NO: 18979 - protein, 10 aa, Artificial Sequence
  Description of Artificial Sequence: Synthetic peptide
  XENP020529 vhCDR3
LANWDWYFDV

SEQ ID NO: 18980 - protein, 218 aa, Artificial Sequence; identical to SEQ ID NO: 17590
  Description of Artificial Sequence: Synthetic polypeptide
  XENP020529 7G8_H0.77_L0_IgG1_PVA_/S267K Light Chain

SEQ ID NO: 18981 - protein, 111 aa, Artificial Sequence; identical to SEQ ID NO: 17591
  Description of Artificial Sequence: Synthetic polypeptide
  VL of XENP020529

SEQ ID NO: 18982 - protein, 15 aa, Artificial Sequence
  Description of Artificial Sequence: Synthetic peptide
  XENP020529 vlCDR1
KASQSVDYDGDSYMN

SEQ ID NO: 18983 - protein, 7 aa, Artificial Sequence
  Description of Artificial Sequence: Synthetic peptide
  XENP020529 vlCDR2
AASNLES

SEQ ID NO: 18984 - protein, 9 aa, Artificial Sequence
  Description of Artificial Sequence: Synthetic peptide
  XENP020529 vlCDR3
QQSNEDPFT

SEQ ID NO: 18985 - protein, 450 aa, Artificial Sequence
  Description of Artificial Sequence: Synthetic polypeptide
  XENP020530 7G8_H0.78_L0_IgG1_PVA_/S267K Heavy Chain
EVKLEESGGGLVQPGGSMKLSCAASGFTFSDAWMDWVRQSPEKGLEWVAEIRTKANTHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18986 - protein, 121 aa, Artificial Sequence
  Description of Artificial Sequence: Synthetic polypeptide
  VH of XENP020530
EVKLEESGGGLVQPGGSMKLSCAASGFTFSDAWMDWVRQSPEKGLEWVAEIRTKANTHATYYAESVKGRFTISRDDSKSSVYLQMNSLRAEDTGIYYCTRLANWDWYFDVWGAGTTVTVSS

SEQ ID NO: 18987 - protein, 5 aa, Artificial Sequence
  Description of Artificial Sequence: Synthetic peptide
  XENP020530 vhCDR1
DAWMD

SEQ ID NO: 18988 - protein, 19 aa, Artificial Sequence
  Description of Artificial Sequence: Synthetic peptide
  XENP020530 vhCDR2
EIRTKANTHATYYAESVKG

SEQ ID NO: 18989 - protein, 10 aa, Artificial Sequence
  Description of Artificial Sequence: Synthetic peptide
  XENP020530 vhCDR3
LANWDWYFDV

SEQ ID NO: 18990 - protein, 218 aa, Artificial Sequence; identical to SEQ ID NO: 17590
  Description of Artificial Sequence: Synthetic polypeptide
  XENP020530 7G8_H0.78_L0_IgG1_PVA_/S267K Light Chain

SEQ ID NO: 18991 - protein, 111 aa, Artificial Sequence; identical to SEQ ID NO: 17591
  Description of Artificial Sequence: Synthetic polypeptide
  VL of XENP020530

SEQ ID NO: 18992 - protein, 15 aa, Artificial Sequence
  Description of Artificial Sequence: Synthetic peptide
  XENP020530 vlCDR1
KASQSVDYDGDSYMN

SEQ ID NO: 18993 - protein, 7 aa, Artificial Sequence
  Description of Artificial Sequence: Synthetic peptide
  XENP020530 vlCDR2
AASNLES

SEQ ID NO: 18994 - protein, 9 aa, Artificial Sequence
  Description of Artificial Sequence: Synthetic peptide
  XENP020530 vlCDR3
QQSNEDPFT

SEQ ID NO: 18995 - protein, 450 aa, Artificial Sequence
  Description of Artificial Sequence: Synthetic polypeptide
  XENP020531 7G8_H0.79_L0_IgG1_PVA_/S267K Heavy Chain
EVKLEESGGGLVQPGGSMKLSCAASGFTFSDAWMDWVRQSPEKGLEWVAEIRTKANGHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 18996 - protein, 121 aa, Artificial Sequence
  Description of Artificial Sequence: Synthetic polypeptide
  VH of XENP020531
EVKLEESGGGLVQPGGSMKLSCAASGFTFSDAWMDWVRQSPEKGLEWVAEIRTKANGHATYYAESVKGRFTISRDDSKSSVYLQMNSLRAEDTGIYYCTRLANWDWYFDVWGAGTTVTVSS

SEQ ID NO: 18997 - protein, 5 aa, Artificial Sequence
  Description of Artificial Sequence: Synthetic peptide
  XENP020531 vhCDR1
DAWMD

SEQ ID NO: 18998 - protein, 19 aa, Artificial Sequence
  Description of Artificial Sequence: Synthetic peptide
  XENP020531 vhCDR2
EIRTKANGHATYYAESVKG

SEQ ID NO: 18999 - protein, 10 aa, Artificial Sequence
  Description of Artificial Sequence: Synthetic peptide
  XENP020531 vhCDR3
LANWDWYFDV

SEQ ID NO: 19000 - protein, 218 aa, Artificial Sequence; identical to SEQ ID NO: 17590
  Description of Artificial Sequence: Synthetic polypeptide
  XENP020531 7G8_H0.79_L0_IgG1_PVA_/S267K Light Chain

SEQ ID NO: 19001 - protein, 111 aa, Artificial Sequence; identical to SEQ ID NO: 17591
  Description of Artificial Sequence: Synthetic polypeptide
  VL of XENP020531

SEQ ID NO: 19002 - protein, 15 aa, Artificial Sequence
  Description of Artificial Sequence: Synthetic peptide
  XENP020531 vlCDR1
KASQSVDYDGDSYMN

SEQ ID NO: 19003 - protein, 7 aa, Artificial Sequence
  Description of Artificial Sequence: Synthetic peptide
  XENP020531 vlCDR2
AASNLES

SEQ ID NO: 19004 - protein, 9 aa, Artificial Sequence
  Description of Artificial Sequence: Synthetic peptide
  XENP020531 vlCDR3
QQSNEDPFT

SEQ ID NO: 19005 - protein, 450 aa, Artificial Sequence
  Description of Artificial Sequence: Synthetic polypeptide
  XENP020532 7G8_H0.80_L0_IgG1_PVA_/S267K Heavy Chain
EVKLEESGGGLVQPGGSMKLSCAASGFTFSDAWMDWVRQSPEKGLEWVAEIRTKANYHATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19006 - protein, 121 aa, Artificial Sequence
  Description of Artificial Sequence: Synthetic polypeptide
  VH of XENP020532
EVKLEESGGGLVQPGGSMKLSCAASGFTFSDAWMDWVRQSPEKGLEWVAEIRTKANYHATYYAESVKGRFTISRDDSKSSVYLQMNSLRAEDTGIYYCTRLANWDWYFDVWGAGTTVTVSS

SEQ ID NO: 19007 - protein, 5 aa, Artificial Sequence
  Description of Artificial Sequence: Synthetic peptide
  XENP020532 vhCDR1
DAWMD

SEQ ID NO: 19008 - protein, 19 aa, Artificial Sequence
  Description of Artificial Sequence: Synthetic peptide
  XENP020532 vhCDR2
EIRTKANYHATYYAESVKG

SEQ ID NO: 19009 - protein, 10 aa, Artificial Sequence
  Description of Artificial Sequence: Synthetic peptide
  XENP020532 vhCDR3
LANWDWYFDV

SEQ ID NO: 19010 - protein, 218 aa, Artificial Sequence; identical to SEQ ID NO: 17590
  Description of Artificial Sequence: Synthetic polypeptide
  XENP020532 7G8_H0.80_L0_IgG1_PVA_/S267K Light Chain

SEQ ID NO: 19011 - protein, 111 aa, Artificial Sequence; identical to SEQ ID NO: 17591
  Description of Artificial Sequence: Synthetic polypeptide
  VL of XENP020532

SEQ ID NO: 19012 - protein, 15 aa, Artificial Sequence
  Description of Artificial Sequence: Synthetic peptide
  XENP020532 vlCDR1
KASQSVDYDGDSYMN

SEQ ID NO: 19013 - protein, 7 aa, Artificial Sequence
  Description of Artificial Sequence: Synthetic peptide
  XENP020532 vlCDR2
AASNLES

SEQ ID NO: 19014 - protein, 9 aa, Artificial Sequence
  Description of Artificial Sequence: Synthetic peptide
  XENP020532 vlCDR3
QQSNEDPFT

SEQ ID NO: 19015 - protein, 450 aa, Artificial Sequence
  Description of Artificial Sequence: Synthetic polypeptide
  XENP020533 7G8_H0.81_L0_IgG1_PVA_/S267K Heavy Chain
EVKLEESGGGLVQPGGSMKLSCAASGFTFSDAWMDWVRQSPEKGLEWVAEIRTKANNYATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19016 - protein, 121 aa, Artificial Sequence
  Description of Artificial Sequence: Synthetic polypeptide
  VH of XENP020533
EVKLEESGGGLVQPGGSMKLSCAASGFTFSDAWMDWVRQSPEKGLEWVAEIRTKANNYATYYAESVKGRFTISRDDSKSSVYLQMNSLRAEDTGIYYCTRLANWDWYFDVWGAGTTVTVSS

SEQ ID NO: 19017 - protein, 5 aa, Artificial Sequence
  Description of Artificial Sequence: Synthetic peptide
  XENP020533 vhCDR1
DAWMD

SEQ ID NO: 19018 - protein, 19 aa, Artificial Sequence
  Description of Artificial Sequence: Synthetic peptide
  XENP020533 vhCDR2
EIRTKANNYATYYAESVKG

SEQ ID NO: 19019 - protein, 10 aa, Artificial Sequence
  Description of Artificial Sequence: Synthetic peptide
  XENP020533 vhCDR3
LANWDWYFDV

SEQ ID NO: 19020 - protein, 218 aa, Artificial Sequence; identical to SEQ ID NO: 17590
  Description of Artificial Sequence: Synthetic polypeptide
  XENP020533 7G8_H0.81_L0_IgG1_PVA_/S267K Light Chain

SEQ ID NO: 19021 - protein, 111 aa, Artificial Sequence; identical to SEQ ID NO: 17591
  Description of Artificial Sequence: Synthetic polypeptide
  VL of XENP020533

SEQ ID NO: 19022 - protein, 15 aa, Artificial Sequence
  Description of Artificial Sequence: Synthetic peptide
  XENP020533 vlCDR1
KASQSVDYDGDSYMN

SEQ ID NO: 19023 - protein, 7 aa, Artificial Sequence
  Description of Artificial Sequence: Synthetic peptide
  XENP020533 vlCDR2
AASNLES

SEQ ID NO: 19024 - protein, 9 aa, Artificial Sequence
  Description of Artificial Sequence: Synthetic peptide
  XENP020533 vlCDR3
QQSNEDPFT

SEQ ID NO: 19025 - protein, 450 aa, Artificial Sequence
  Description of Artificial Sequence: Synthetic polypeptide
  XENP020534 7G8_H0.82_L0_IgG1_PVA_/S267K Heavy Chain
EVKLEESGGGLVQPGGSMKLSCAASGFTFSDAWMDWVRQSPEKGLEWVAEIRTKANNQATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19026 - protein, 121 aa, Artificial Sequence
  Description of Artificial Sequence: Synthetic polypeptide
  VH of XENP020534
EVKLEESGGGLVQPGGSMKLSCAASGFTFSDAWMDWVRQSPEKGLEWVAEIRTKANNQATYYAESVKGRFTISRDDSKSSVYLQMNSLRAEDTGIYYCTRLANWDWYFDVWGAGTTVTVSS

SEQ ID NO: 19027 - protein, 5 aa, Artificial Sequence
  Description of Artificial Sequence: Synthetic peptide
  XENP020534 vhCDR1
DAWMD

SEQ ID NO: 19028 - protein, 19 aa, Artificial Sequence
  Description of Artificial Sequence: Synthetic peptide
  XENP020534 vhCDR2
EIRTKANNQATYYAESVKG

SEQ ID NO: 19029 - protein, 10 aa, Artificial Sequence
  Description of Artificial Sequence: Synthetic peptide
  XENP020534 vhCDR3
LANWDWYFDV

SEQ ID NO: 19030 - protein, 218 aa, Artificial Sequence; identical to SEQ ID NO: 17590
  Description of Artificial Sequence: Synthetic polypeptide
  XENP020534 7G8_H0.82_L0_IgG1_PVA_/S267K Light Chain

SEQ ID NO: 19031 - protein, 111 aa, Artificial Sequence; identical to SEQ ID NO: 17591
  Description of Artificial Sequence: Synthetic polypeptide
  VL of XENP020534

SEQ ID NO: 19032 - protein, 15 aa, Artificial Sequence
  Description of Artificial Sequence: Synthetic peptide
  XENP020534 vlCDR1
KASQSVDYDGDSYMN

SEQ ID NO: 19033 - protein, 7 aa, Artificial Sequence
  Description of Artificial Sequence: Synthetic peptide
  XENP020534 vlCDR2
AASNLES

SEQ ID NO: 19034 - protein, 9 aa, Artificial Sequence
  Description of Artificial Sequence: Synthetic peptide
  XENP020534 vlCDR3
QQSNEDPFT

SEQ ID NO: 19035 - protein, 450 aa, Artificial Sequence
  Description of Artificial Sequence: Synthetic polypeptide
  XENP020535 7G8_H0.83_L0_IgG1_PVA_/S267K Heavy Chain
EVKLEESGGGLVQPGGSMKLSCAASGFTFSDAWMDWVRQSPEKGLEWVAEIRTKANNDATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19036 - protein, 121 aa, Artificial Sequence
  Description of Artificial Sequence: Synthetic polypeptide
  VH of XENP020535
EVKLEESGGGLVQPGGSMKLSCAASGFTFSDAWMDWVRQSPEKGLEWVAEIRTKANNDATYYAESVKGRFTISRDDSKSSVYLQMNSLRAEDTGIYYCTRLANWDWYFDVWGAGTTVTVSS

SEQ ID NO: 19037 - protein, 5 aa, Artificial Sequence
  Description of Artificial Sequence: Synthetic peptide
  XENP020535 vhCDR1
DAWMD

SEQ ID NO: 19038 - protein, 19 aa, Artificial Sequence
  Description of Artificial Sequence: Synthetic peptide
  XENP020535 vhCDR2
EIRTKANNDATYYAESVKG

SEQ ID NO: 19039 - protein, 10 aa, Artificial Sequence
  Description of Artificial Sequence: Synthetic peptide
  XENP020535 vhCDR3
LANWDWYFDV

SEQ ID NO: 19040 - protein, 218 aa, Artificial Sequence; identical to SEQ ID NO: 17590
  Description of Artificial Sequence: Synthetic polypeptide
  XENP020535 7G8_H0.83_L0_IgG1_PVA_/S267K Light Chain

SEQ ID NO: 19041 - protein, 111 aa, Artificial Sequence; identical to SEQ ID NO: 17591
  Description of Artificial Sequence: Synthetic polypeptide
  VL of XENP020535

SEQ ID NO: 19042 - protein, 15 aa, Artificial Sequence
  Description of Artificial Sequence: Synthetic peptide
  XENP020535 vlCDR1
KASQSVDYDGDSYMN

SEQ ID NO: 19043 - protein, 7 aa, Artificial Sequence
  Description of Artificial Sequence: Synthetic peptide
  XENP020535 vlCDR2
AASNLES

SEQ ID NO: 19044 - protein, 9 aa, Artificial Sequence
  Description of Artificial Sequence: Synthetic peptide
  XENP020535 vlCDR3
QQSNEDPFT

SEQ ID NO: 19045 - protein, 450 aa, Artificial Sequence
  Description of Artificial Sequence: Synthetic polypeptide
  XENP020536 7G8_H0.84_L0_IgG1_PVA_/S267K Heavy Chain
EVKLEESGGGLVQPGGSMKLSCAASGFTFSDAWMDWVRQSPEKGLEWVAEIRTKANNFATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19046 - protein, 121 aa, Artificial Sequence
  Description of Artificial Sequence: Synthetic polypeptide
  VH of XENP020536
EVKLEESGGGLVQPGGSMKLSCAASGFTFSDAWMDWVRQSPEKGLEWVAEIRTKANNFATYYAESVKGRFTISRDDSKSSVYLQMNSLRAEDTGIYYCTRLANWDWYFDVWGAGTTVTVSS

SEQ ID NO: 19047 - protein, 5 aa, Artificial Sequence
  Description of Artificial Sequence: Synthetic peptide
  XENP020536 vhCDR1
DAWMD

SEQ ID NO: 19048 - protein, 19 aa, Artificial Sequence
  Description of Artificial Sequence: Synthetic peptide
  XENP020536 vhCDR2
EIRTKANNFATYYAESVKG

SEQ ID NO: 19049 - protein, 10 aa, Artificial Sequence
  Description of Artificial Sequence: Synthetic peptide
  XENP020536 vhCDR3
LANWDWYFDV

SEQ ID NO: 19050 - protein, 218 aa, Artificial Sequence; identical to SEQ ID NO: 17590
  Description of Artificial Sequence: Synthetic polypeptide
  XENP020536 7G8_H0.84_L0_IgG1_PVA_/S267K Light Chain

SEQ ID NO: 19051 - protein, 111 aa, Artificial Sequence; identical to SEQ ID NO: 17591
  Description of Artificial Sequence: Synthetic polypeptide
  VL of XENP020536

SEQ ID NO: 19052 - protein, 15 aa, Artificial Sequence
  Description of Artificial Sequence: Synthetic peptide
  XENP020536 vlCDR1
KASQSVDYDGDSYMN

SEQ ID NO: 19053 - protein, 7 aa, Artificial Sequence
  Description of Artificial Sequence: Synthetic peptide
  XENP020536 vlCDR2
AASNLES

SEQ ID NO: 19054 - protein, 9 aa, Artificial Sequence
  Description of Artificial Sequence: Synthetic peptide
  XENP020536 vlCDR3
QQSNEDPFT

SEQ ID NO: 19055 - protein, 450 aa, Artificial Sequence
  Description of Artificial Sequence: Synthetic polypeptide
  XENP020537 7G8_H0.85_L0_IgG1_PVA_/S267K Heavy Chain
EVKLEESGGGLVQPGGSMKLSCAASGFTFSDAWMDWVRQSPEKGLEWVAEIRTKANNAATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19056 - protein, 121 aa, Artificial Sequence
  Description of Artificial Sequence: Synthetic polypeptide
  VH of XENP020537
EVKLEESGGGLVQPGGSMKLSCAASGFTFSDAWMDWVRQSPEKGLEWVAEIRTKANNAATYYAESVKGRFTISRDDSKSSVYLQMNSLRAEDTGIYYCTRLANWDWYFDVWGAGTTVTVSS

SEQ ID NO: 19057 - protein, 5 aa, Artificial Sequence
  Description of Artificial Sequence: Synthetic peptide
  XENP020537 vhCDR1
DAWMD

SEQ ID NO: 19058 - protein, 19 aa, Artificial Sequence
  Description of Artificial Sequence: Synthetic peptide
  XENP020537 vhCDR2
EIRTKANNAATYYAESVKG

SEQ ID NO: 19059 - protein, 10 aa, Artificial Sequence
  Description of Artificial Sequence: Synthetic peptide
  XENP020537 vhCDR3
LANWDWYFDV

SEQ ID NO: 19060 - protein, 218 aa, Artificial Sequence; identical to SEQ ID NO: 17590
  Description of Artificial Sequence: Synthetic polypeptide
  XENP020537 7G8_H0.85_L0_IgG1_PVA_/S267K Light Chain

SEQ ID NO: 19061 - protein, 111 aa, Artificial Sequence; identical to SEQ ID NO: 17591
  Description of Artificial Sequence: Synthetic polypeptide
  VL of XENP020537

SEQ ID NO: 19062 - protein, 15 aa, Artificial Sequence
  Description of Artificial Sequence: Synthetic peptide
  XENP020537 vlCDR1
KASQSVDYDGDSYMN

SEQ ID NO: 19063 - protein, 7 aa, Artificial Sequence
  Description of Artificial Sequence: Synthetic peptide
  XENP020537 vlCDR2
AASNLES

SEQ ID NO: 19064 - protein, 9 aa, Artificial Sequence
  Description of Artificial Sequence: Synthetic peptide
  XENP020537 vlCDR3
QQSNEDPFT

SEQ ID NO: 19065 - protein, 450 aa, Artificial Sequence
  Description of Artificial Sequence: Synthetic polypeptide
  XENP020538 7G8_H0.86_L0_IgG1_PVA_/S267K Heavy Chain
EVKLEESGGGLVQPGGSMKLSCAASGFTFSDAWMDWVRQSPEKGLEWVAEIRTKANNKATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19066 - protein, 121 aa, Artificial Sequence
  Description of Artificial Sequence: Synthetic polypeptide
  VH of XENP020538
EVKLEESGGGLVQPGGSMKLSCAASGFTFSDAWMDWVRQSPEKGLEWVAEIRTKANNKATYYAESVKGRFTISRDDSKSSVYLQMNSLRAEDTGIYYCTRLANWDWYFDVWGAGTTVTVSS

SEQ ID NO: 19067 - protein, 5 aa, Artificial Sequence
  Description of Artificial Sequence: Synthetic peptide
  XENP020538 vhCDR1
DAWMD

SEQ ID NO: 19068 - protein, 19 aa, Artificial Sequence
  Description of Artificial Sequence: Synthetic peptide
  XENP020538 vhCDR2
EIRTKANNKATYYAESVKG

SEQ ID NO: 19069 - protein, 10 aa, Artificial Sequence
  Description of Artificial Sequence: Synthetic peptide
  XENP020538 vhCDR3
LANWDWYFDV

SEQ ID NO: 19070 - protein, 218 aa, Artificial Sequence; identical to SEQ ID NO: 17590
  Description of Artificial Sequence: Synthetic polypeptide
  XENP020538 7G8_H0.86_L0_IgG1_PVA_/S267K Light Chain

SEQ ID NO: 19071 - protein, 111 aa, Artificial Sequence; identical to SEQ ID NO: 17591
  Description of Artificial Sequence: Synthetic polypeptide
  VL of XENP020538

SEQ ID NO: 19072 - protein, 15 aa, Artificial Sequence
  Description of Artificial Sequence: Synthetic peptide
  XENP020538 vlCDR1
KASQSVDYDGDSYMN

SEQ ID NO: 19073 - protein, 7 aa, Artificial Sequence
  Description of Artificial Sequence: Synthetic peptide
  XENP020538 vlCDR2
AASNLES

SEQ ID NO: 19074 - protein, 9 aa, Artificial Sequence
  Description of Artificial Sequence: Synthetic peptide
  XENP020538 vlCDR3
QQSNEDPFT

SEQ ID NO: 19075 - protein, 450 aa, Artificial Sequence
  Description of Artificial Sequence: Synthetic polypeptide
  XENP020539 7G8_H0.87_L0_IgG1_PVA_/S267K Heavy Chain
EVKLEESGGGLVQPGGSMKLSCAASGFTFSDAWMDWVRQSPEKGLEWVAEIRTKANNGATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19076 - protein, 121 aa, Artificial Sequence
  Description of Artificial Sequence: Synthetic polypeptide
  VH of XENP020539
EVKLEESGGGLVQPGGSMKLSCAASGFTFSDAWMDWVRQSPEKGLEWVAEIRTKANNGATYYAESVKGRFTISRDDSKSSVYLQMNSLRAEDTGIYYCTRLANWDWYFDVWGAGTTVTVSS

SEQ ID NO: 19077 - protein, 5 aa, Artificial Sequence
  Description of Artificial Sequence: Synthetic peptide
  XENP020539 vhCDR1
DAWMD

SEQ ID NO: 19078 - protein, 19 aa, Artificial Sequence
  Description of Artificial Sequence: Synthetic peptide
  XENP020539 vhCDR2
EIRTKANNGATYYAESVKG

SEQ ID NO: 19079 - protein, 10 aa, Artificial Sequence
  Description of Artificial Sequence: Synthetic peptide
  XENP020539 vhCDR3
LANWDWYFDV

SEQ ID NO: 19080 - protein, 218 aa, Artificial Sequence; identical to SEQ ID NO: 17590
  Description of Artificial Sequence: Synthetic polypeptide
  XENP020539 7G8_H0.87_L0_IgG1_PVA_/S267K Light Chain

SEQ ID NO: 19081 - protein, 111 aa, Artificial Sequence; identical to SEQ ID NO: 17591
  Description of Artificial Sequence: Synthetic polypeptide
  VL of XENP020539

SEQ ID NO: 19082 - protein, 15 aa, Artificial Sequence
  Description of Artificial Sequence: Synthetic peptide
  XENP020539 vlCDR1
KASQSVDYDGDSYMN

SEQ ID NO: 19083 - protein, 7 aa, Artificial Sequence
  Description of Artificial Sequence: Synthetic peptide
  XENP020539 vlCDR2
AASNLES

SEQ ID NO: 19084 - protein, 9 aa, Artificial Sequence
  Description of Artificial Sequence: Synthetic peptide
  XENP020539 vlCDR3
QQSNEDPFT

SEQ ID NO: 19085 - protein, 450 aa, Artificial Sequence
  Description of Artificial Sequence: Synthetic polypeptide
  XENP020540 7G8_H0.88_L0_IgG1_PVA_/S267K Heavy Chain
EVKLEESGGGLVQPGGSMKLSCAASGFTFSDAWMDWVRQSPEKGLEWVAEIRTKANNLATYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19086 - protein, 121 aa, Artificial Sequence
  Description of Artificial Sequence: Synthetic polypeptide
  VH of XENP020540
EVKLEESGGGLVQPGGSMKLSCAASGFTFSDAWMDWVRQSPEKGLEWVAEIRTKANNLATYYAESVKGRFTISRDDSKSSVYLQMNSLRAEDTGIYYCTRLANWDWYFDVWGAGTTVTVSS

SEQ ID NO: 19087 - protein, 5 aa, Artificial Sequence
  Description of Artificial Sequence: Synthetic peptide
  XENP020540 vhCDR1
DAWMD

SEQ ID NO: 19088 - protein, 19 aa, Artificial Sequence
  Description of Artificial Sequence: Synthetic peptide
  XENP020540 vhCDR2
EIRTKANNLATYYAESVKG

SEQ ID NO: 19089 - protein, 10 aa, Artificial Sequence
  Description of Artificial Sequence: Synthetic peptide
  XENP020540 vhCDR3
LANWDWYFDV

SEQ ID NO: 19090 - protein, 218 aa, Artificial Sequence; identical to SEQ ID NO: 17590
  Description of Artificial Sequence: Synthetic polypeptide
  XENP020540 7G8_H0.88_L0_IgG1_PVA_/S267K Light Chain

SEQ ID NO: 19091 - protein, 111 aa, Artificial Sequence; identical to SEQ ID NO: 17591
  Description of Artificial Sequence: Synthetic polypeptide
  VL of XENP020540

SEQ ID NO: 19092 - protein, 15 aa, Artificial Sequence
  Description of Artificial Sequence: Synthetic peptide
  XENP020540 vlCDR1
KASQSVDYDGDSYMN

SEQ ID NO: 19093 - protein, 7 aa, Artificial Sequence
  Description of Artificial Sequence: Synthetic peptide
  XENP020540 vlCDR2
AASNLES

SEQ ID NO: 19094 - protein, 9 aa, Artificial Sequence
  Description of Artificial Sequence: Synthetic peptide
  XENP020540 vlCDR3
QQSNEDPFT

SEQ ID NO: 19095 - protein, 450 aa, Artificial Sequence
  Description of Artificial Sequence: Synthetic polypeptide
  XENP020541 7G8_H0.89_L0_IgG1_PVA_/S267K Heavy Chain
EVKLEESGGGLVQPGGSMKLSCAASGFTFSDAWMDWVRQSPEKGLEWVAEIRTKANNHGTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19096 - protein, 121 aa, Artificial Sequence
  Description of Artificial Sequence: Synthetic polypeptide
  VH of XENP020541
EVKLEESGGGLVQPGGSMKLSCAASGFTFSDAWMDWVRQSPEKGLEWVAEIRTKANNHGTYYAESVKGRFTISRDDSKSSVYLQMNSLRAEDTGIYYCTRLANWDWYFDVWGAGTTVTVSS

SEQ ID NO: 19097 - protein, 5 aa, Artificial Sequence
  Description of Artificial Sequence: Synthetic peptide
  XENP020541 vhCDR1
DAWMD

SEQ ID NO: 19098 - protein, 19 aa, Artificial Sequence
  Description of Artificial Sequence: Synthetic peptide
  XENP020541 vhCDR2
EIRTKANNHGTYYAESVKG

SEQ ID NO: 19099 - protein, 10 aa, Artificial Sequence
  Description of Artificial Sequence: Synthetic peptide
  XENP020541 vhCDR3
LANWDWYFDV

SEQ ID NO: 19100 - protein, 218 aa, Artificial Sequence; identical to SEQ ID NO: 17590
  Description of Artificial Sequence: Synthetic polypeptide
  XENP020541 7G8_H0.89_L0_IgG1_PVA_/S267K Light Chain

SEQ ID NO: 19101 - protein, 111 aa, Artificial Sequence; identical to SEQ ID NO: 17591
  Description of Artificial Sequence: Synthetic polypeptide
  VL of XENP020541

SEQ ID NO: 19102 - protein, 15 aa, Artificial Sequence
  Description of Artificial Sequence: Synthetic peptide
  XENP020541 vlCDR1
KASQSVDYDGDSYMN

SEQ ID NO: 19103 - protein, 7 aa, Artificial Sequence
  Description of Artificial Sequence: Synthetic peptide
  XENP020541 vlCDR2
AASNLES

SEQ ID NO: 19104 - protein, 9 aa, Artificial Sequence
  Description of Artificial Sequence: Synthetic peptide
  XENP020541 vlCDR3
QQSNEDPFT

SEQ ID NO: 19105 - protein, 450 aa, Artificial Sequence
  Description of Artificial Sequence: Synthetic polypeptide
  XENP020542 7G8_H0.90_L0_IgG1_PVA_/S267K Heavy Chain
EVKLEESGGGLVQPGGSMKLSCAASGFTFSDAWMDWVRQSPEKGLEWVAEIRTKANNHHTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19106 - protein, 121 aa, Artificial Sequence
  Description of Artificial Sequence: Synthetic polypeptide
  VH of XENP020542
EVKLEESGGGLVQPGGSMKLSCAASGFTFSDAWMDWVRQSPEKGLEWVAEIRTKANNHHTYYAESVKGRFTISRDDSKSSVYLQMNSLRAEDTGIYYCTRLANWDWYFDVWGAGTTVTVSS

SEQ ID NO: 19107 - protein, 5 aa, Artificial Sequence
  Description of Artificial Sequence: Synthetic peptide
  XENP020542 vhCDR1
DAWMD

SEQ ID NO: 19108 - protein, 19 aa, Artificial Sequence
  Description of Artificial Sequence: Synthetic peptide
  XENP020542 vhCDR2
EIRTKANNHHTYYAESVKG

SEQ ID NO: 19109 - protein, 10 aa, Artificial Sequence
  Description of Artificial Sequence: Synthetic peptide
  XENP020542 vhCDR3
LANWDWYFDV

SEQ ID NO: 19110 - protein, 218 aa, Artificial Sequence; identical to SEQ ID NO: 17590
  Description of Artificial Sequence: Synthetic polypeptide
  XENP020542 7G8_H0.90_L0_IgG1_PVA_/S267K Light Chain

SEQ ID NO: 19111 - protein, 111 aa, Artificial Sequence; identical to SEQ ID NO: 17591
  Description of Artificial Sequence: Synthetic polypeptide
  VL of XENP020542

SEQ ID NO: 19112 - protein, 15 aa, Artificial Sequence
  Description of Artificial Sequence: Synthetic peptide
  XENP020542 vlCDR1
KASQSVDYDGDSYMN

SEQ ID NO: 19113 - protein, 7 aa, Artificial Sequence
  Description of Artificial Sequence: Synthetic peptide
  XENP020542 vlCDR2
AASNLES

SEQ ID NO: 19114 - protein, 9 aa, Artificial Sequence
  Description of Artificial Sequence: Synthetic peptide
  XENP020542 vlCDR3
QQSNEDPFT

SEQ ID NO: 19115 - protein, 450 aa, Artificial Sequence
  Description of Artificial Sequence: Synthetic polypeptide
  XENP020543 7G8_H0.91_L0_IgG1_PVA_/S267K Heavy Chain
EVKLEESGGGLVQPGGSMKLSCAASGFTFSDAWMDWVRQSPEKGLEWVAEIRTKANNHQTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19116 - protein, 121 aa, Artificial Sequence
  Description of Artificial Sequence: Synthetic polypeptide
  VH of XENP020543
EVKLEESGGGLVQPGGSMKLSCAASGFTFSDAWMDWVRQSPEKGLEWVAEIRTKANNHQTYYAESVKGRFTISRDDSKSSVYLQMNSLRAEDTGIYYCTRLANWDWYFDVWGAGTTVTVSS

SEQ ID NO: 19117 - protein, 5 aa, Artificial Sequence
  Description of Artificial Sequence: Synthetic peptide
  XENP020543 vhCDR1
DAWMD

SEQ ID NO: 19118 - protein, 19 aa, Artificial Sequence
  Description of Artificial Sequence: Synthetic peptide
  XENP020543 vhCDR2
EIRTKANNHQTYYAESVKG

SEQ ID NO: 19119 - protein, 10 aa, Artificial Sequence
  Description of Artificial Sequence: Synthetic peptide
  XENP020543 vhCDR3
LANWDWYFDV

SEQ ID NO: 19120 - protein, 218 aa, Artificial Sequence; identical to SEQ ID NO: 17590
  Description of Artificial Sequence: Synthetic polypeptide
  XENP020543 7G8_H0.91_L0_IgG1_PVA_/S267K Light Chain

SEQ ID NO: 19121 - protein, 111 aa, Artificial Sequence; identical to SEQ ID NO: 17591
  Description of Artificial Sequence: Synthetic polypeptide
  VL of XENP020543

SEQ ID NO: 19122 - protein, 15 aa, Artificial Sequence
  Description of Artificial Sequence: Synthetic peptide
  XENP020543 vlCDR1
KASQSVDYDGDSYMN

SEQ ID NO: 19123 - protein, 7 aa, Artificial Sequence
  Description of Artificial Sequence: Synthetic peptide
  XENP020543 vlCDR2
AASNLES

SEQ ID NO: 19124 - protein, 9 aa, Artificial Sequence
  Description of Artificial Sequence: Synthetic peptide
  XENP020543 vlCDR3
QQSNEDPFT

SEQ ID NO: 19125 - protein, 450 aa, Artificial Sequence
  Description of Artificial Sequence: Synthetic polypeptide
  XENP020544 7G8_H0.92_L0_IgG1_PVA_/S267K Heavy Chain
EVKLEESGGGLVQPGGSMKLSCAASGFTFSDAWMDWVRQSPEKGLEWVAEIRTKANNHDTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19126 - protein, 121 aa, Artificial Sequence
  Description of Artificial Sequence: Synthetic polypeptide
  VH of XENP020544
EVKLEESGGGLVQPGGSMKLSCAASGFTFSDAWMDWVRQSPEKGLEWVAEIRTKANNHDTYYAESVKGRFTISRDDSKSSVYLQMNSLRAEDTGIYYCTRLANWDWYFDVWGAGTTVTVSS

SEQ ID NO: 19127 - protein, 5 aa, Artificial Sequence
  Description of Artificial Sequence: Synthetic peptide
  XENP020544 vhCDR1
DAWMD

SEQ ID NO: 19128 - protein, 19 aa, Artificial Sequence
  Description of Artificial Sequence: Synthetic peptide
  XENP020544 vhCDR2
EIRTKANNHDTYYAESVKG

SEQ ID NO: 19129 - protein, 10 aa, Artificial Sequence
  Description of Artificial Sequence: Synthetic peptide
  XENP020544 vhCDR3
LANWDWYFDV

SEQ ID NO: 19130 - protein, 218 aa, Artificial Sequence; identical to SEQ ID NO: 17590
  Description of Artificial Sequence: Synthetic polypeptide
  XENP020544 7G8_H0.92_L0_IgG1_PVA_/S267K Light Chain

SEQ ID NO: 19131 - protein, 111 aa, Artificial Sequence; identical to SEQ ID NO: 17591
  Description of Artificial Sequence: Synthetic polypeptide
  VL of XENP020544

SEQ ID NO: 19132 - protein, 15 aa, Artificial Sequence
  Description of Artificial Sequence: Synthetic peptide
  XENP020544 vlCDR1
KASQSVDYDGDSYMN

SEQ ID NO: 19133 - protein, 7 aa, Artificial Sequence
  Description of Artificial Sequence: Synthetic peptide
  XENP020544 vlCDR2
AASNLES

SEQ ID NO: 19134 - protein, 9 aa, Artificial Sequence
  Description of Artificial Sequence: Synthetic peptide
  XENP020544 vlCDR3
QQSNEDPFT

SEQ ID NO: 19135 - protein, 450 aa, Artificial Sequence
  Description of Artificial Sequence: Synthetic polypeptide
  XENP020545 7G8_H0.93_L0_IgG1_PVA_/S267K Heavy Chain
EVKLEESGGGLVQPGGSMKLSCAASGFTFSDAWMDWVRQSPEKGLEWVAEIRTKANNHLTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19136 - protein, 121 aa, Artificial Sequence
  Description of Artificial Sequence: Synthetic polypeptide
  VH of XENP020545
EVKLEESGGGLVQPGGSMKLSCAASGFTFSDAWMDWVRQSPEKGLEWVAEIRTKANNHLTYYAESVKGRFTISRDDSKSSVYLQMNSLRAEDTGIYYCTRLANWDWYFDVWGAGTTVTVSS

SEQ ID NO: 19137 - protein, 5 aa, Artificial Sequence
  Description of Artificial Sequence: Synthetic peptide
  XENP020545 vhCDR1
DAWMD

SEQ ID NO: 19138 - protein, 19 aa, Artificial Sequence
  Description of Artificial Sequence: Synthetic peptide
  XENP020545 vhCDR2
EIRTKANNHLTYYAESVKG

SEQ ID NO: 19139 - protein, 10 aa, Artificial Sequence
  Description of Artificial Sequence: Synthetic peptide
  XENP020545 vhCDR3
LANWDWYFDV

SEQ ID NO: 19140 - protein, 218 aa, Artificial Sequence; identical to SEQ ID NO: 17590
  Description of Artificial Sequence: Synthetic polypeptide
  XENP020545 7G8_H0.93_L0_IgG1_PVA_/S267K Light Chain

SEQ ID NO: 19141 - protein, 111 aa, Artificial Sequence; identical to SEQ ID NO: 17591
  Description of Artificial Sequence: Synthetic polypeptide
  VL of XENP020545

SEQ ID NO: 19142 - protein, 15 aa, Artificial Sequence
  Description of Artificial Sequence: Synthetic peptide
  XENP020545 vlCDR1
KASQSVDYDGDSYMN

SEQ ID NO: 19143 - protein, 7 aa, Artificial Sequence
  Description of Artificial Sequence: Synthetic peptide
  XENP020545 vlCDR2
AASNLES

SEQ ID NO: 19144 - protein, 9 aa, Artificial Sequence
  Description of Artificial Sequence: Synthetic peptide
  XENP020545 vlCDR3
QQSNEDPFT

SEQ ID NO: 19145 - protein, 450 aa, Artificial Sequence
  Description of Artificial Sequence: Synthetic polypeptide
  XENP020546 7G8_H0.94_L0_IgG1_PVA_/S267K Heavy Chain
EVKLEESGGGLVQPGGSMKLSCAASGFTFSDAWMDWVRQSPEKGLEWVAEIRTKANNHKTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19146 - protein, 121 aa, Artificial Sequence
  Description of Artificial Sequence: Synthetic polypeptide
  VH of XENP020546
EVKLEESGGGLVQPGGSMKLSCAASGFTFSDAWMDWVRQSPEKGLEWVAEIRTKANNHKTYYAESVKGRFTISRDDSKSSVYLQMNSLRAEDTGIYYCTRLANWDWYFDVWGAGTTVTVSS

SEQ ID NO: 19147 - protein, 5 aa, Artificial Sequence
  Description of Artificial Sequence: Synthetic peptide
  XENP020546 vhCDR1
DAWMD

SEQ ID NO: 19148 - protein, 19 aa, Artificial Sequence
  Description of Artificial Sequence: Synthetic peptide
  XENP020546 vhCDR2
EIRTKANNHKTYYAESVKG

SEQ ID NO: 19149 - protein, 10 aa, Artificial Sequence
  Description of Artificial Sequence: Synthetic peptide
  XENP020546 vhCDR3
LANWDWYFDV

SEQ ID NO: 19150 - protein, 218 aa, Artificial Sequence; identical to SEQ ID NO: 17590
  Description of Artificial Sequence: Synthetic polypeptide
  XENP020546 7G8_H0.94_L0_IgG1_PVA_/S267K Light Chain

SEQ ID NO: 19151 - protein, 111 aa, Artificial Sequence; identical to SEQ ID NO: 17591
  Description of Artificial Sequence: Synthetic polypeptide
  VL of XENP020546

SEQ ID NO: 19152 - protein, 15 aa, Artificial Sequence
  Description of Artificial Sequence: Synthetic peptide
  XENP020546 vlCDR1
KASQSVDYDGDSYMN

SEQ ID NO: 19153 - protein, 7 aa, Artificial Sequence
  Description of Artificial Sequence: Synthetic peptide
  XENP020546 vlCDR2
AASNLES

SEQ ID NO: 19154 - protein, 9 aa, Artificial Sequence
  Description of Artificial Sequence: Synthetic peptide
  XENP020546 vlCDR3
QQSNEDPFT

SEQ ID NO: 19155 - protein, 450 aa, Artificial Sequence
  Description of Artificial Sequence: Synthetic polypeptide
  XENP020547 7G8_H0.95_L0_IgG1_PVA_/S267K Heavy Chain
EVKLEESGGGLVQPGGSMKLSCAASGFTFSDAWMDWVRQSPEKGLEWVAEIRTKANNHYTYYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19156 - protein, 121 aa, Artificial Sequence
  Description of Artificial Sequence: Synthetic polypeptide
  VH of XENP020547
EVKLEESGGGLVQPGGSMKLSCAASGFTFSDAWMDWVRQSPEKGLEWVAEIRTKANNHYTYYAESVKGRFTISRDDSKSSVYLQMNSLRAEDTGIYYCTRLANWDWYFDVWGAGTTVTVSS

SEQ ID NO: 19157 - protein, 5 aa, Artificial Sequence
  Description of Artificial Sequence: Synthetic peptide
  XENP020547 vhCDR1
DAWMD

SEQ ID NO: 19158 - protein, 19 aa, Artificial Sequence
  Description of Artificial Sequence: Synthetic peptide
  XENP020547 vhCDR2
EIRTKANNHYTYYAESVKG

SEQ ID NO: 19159 - protein, 10 aa, Artificial Sequence
  Description of Artificial Sequence: Synthetic peptide
  XENP020547 vhCDR3
LANWDWYFDV

SEQ ID NO: 19160 - protein, 218 aa, Artificial Sequence; identical to SEQ ID NO: 17590
  Description of Artificial Sequence: Synthetic polypeptide
  XENP020547 7G8_H0.95_L0_IgG1_PVA_/S267K Light Chain

SEQ ID NO: 19161 - protein, 111 aa, Artificial Sequence; identical to SEQ ID NO: 17591
  Description of Artificial Sequence: Synthetic polypeptide
  VL of XENP020547

SEQ ID NO: 19162 - protein, 15 aa, Artificial Sequence
  Description of Artificial Sequence: Synthetic peptide
  XENP020547 vlCDR1
KASQSVDYDGDSYMN

SEQ ID NO: 19163 - protein, 7 aa, Artificial Sequence
  Description of Artificial Sequence: Synthetic peptide
  XENP020547 vlCDR2
AASNLES

SEQ ID NO: 19164 - protein, 9 aa, Artificial Sequence
  Description of Artificial Sequence: Synthetic peptide
  XENP020547 vlCDR3
QQSNEDPFT

SEQ ID NO: 19165 - protein, 450 aa, Artificial Sequence
  Description of Artificial Sequence: Synthetic polypeptide
  XENP020548 7G8_H0.96_L0_IgG1_PVA_/S267K Heavy Chain
EVKLEESGGGLVQPGGSMKLSCAASGFTFSDAWMDWVRQSPEKGLEWVAEIRTKANNHATFYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19166 - protein, 121 aa, Artificial Sequence
  Description of Artificial Sequence: Synthetic polypeptide
  VH of XENP020548
EVKLEESGGGLVQPGGSMKLSCAASGFTFSDAWMDWVRQSPEKGLEWVAEIRTKANNHATFYAESVKGRFTISRDDSKSSVYLQMNSLRAEDTGIYYCTRLANWDWYFDVWGAGTTVTVSS

SEQ ID NO: 19167 - protein, 5 aa, Artificial Sequence
  Description of Artificial Sequence: Synthetic peptide
  XENP020548 vhCDR1
DAWMD

SEQ ID NO: 19168 - protein, 19 aa, Artificial Sequence
  Description of Artificial Sequence: Synthetic peptide
  XENP020548 vhCDR2
EIRTKANNHATFYAESVKG

SEQ ID NO: 19169 - protein, 10 aa, Artificial Sequence
  Description of Artificial Sequence: Synthetic peptide
  XENP020548 vhCDR3
LANWDWYFDV

SEQ ID NO: 19170 - protein, 218 aa, Artificial Sequence; identical to SEQ ID NO: 17590
  Description of Artificial Sequence: Synthetic polypeptide
  XENP020548 7G8_H0.96_L0_IgG1_PVA_/S267K Light Chain

SEQ ID NO: 19171 - protein, 111 aa, Artificial Sequence; identical to SEQ ID NO: 17591
  Description of Artificial Sequence: Synthetic polypeptide
  VL of XENP020548

SEQ ID NO: 19172 - protein, 15 aa, Artificial Sequence
  Description of Artificial Sequence: Synthetic peptide
  XENP020548 vlCDR1
KASQSVDYDGDSYMN

SEQ ID NO: 19173 - protein, 7 aa, Artificial Sequence
  Description of Artificial Sequence: Synthetic peptide
  XENP020548 vlCDR2
AASNLES

SEQ ID NO: 19174 - protein, 9 aa, Artificial Sequence
  Description of Artificial Sequence: Synthetic peptide
  XENP020548 vlCDR3
QQSNEDPFT

SEQ ID NO: 19175 - protein, 450 aa, Artificial Sequence
  Description of Artificial Sequence: Synthetic polypeptide
  XENP020549 7G8_H0.97_L0_IgG1_PVA_/S267K Heavy Chain
EVKLEESGGGLVQPGGSMKLSCAASGFTFSDAWMDWVRQSPEKGLEWVAEIRTKANNHATHYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19176 - protein, 121 aa, Artificial Sequence
  Description of Artificial Sequence: Synthetic polypeptide
  VH of XENP020549
EVKLEESGGGLVQPGGSMKLSCAASGFTFSDAWMDWVRQSPEKGLEWVAEIRTKANNHATHYAESVKGRFTISRDDSKSSVYLQMNSLRAEDTGIYYCTRLANWDWYFDVWGAGTTVTVSS

SEQ ID NO: 19177 - protein, 5 aa, Artificial Sequence
  Description of Artificial Sequence: Synthetic peptide
  XENP020549 vhCDR1
DAWMD

SEQ ID NO: 19178 - protein, 19 aa, Artificial Sequence
  Description of Artificial Sequence: Synthetic peptide
  XENP020549 vhCDR2
EIRTKANNHATHYAESVKG

SEQ ID NO: 19179 - protein, 10 aa, Artificial Sequence
  Description of Artificial Sequence: Synthetic peptide
  XENP020549 vhCDR3
LANWDWYFDV

SEQ ID NO: 19180 - protein, 218 aa, Artificial Sequence; identical to SEQ ID NO: 17590
  Description of Artificial Sequence: Synthetic polypeptide
  XENP020549 7G8_H0.97_L0_IgG1_PVA_/S267K Light Chain

SEQ ID NO: 19181 - protein, 111 aa, Artificial Sequence; identical to SEQ ID NO: 17591
  Description of Artificial Sequence: Synthetic polypeptide
  VL of XENP020549

SEQ ID NO: 19182 - protein, 15 aa, Artificial Sequence
  Description of Artificial Sequence: Synthetic peptide
  XENP020549 vlCDR1
KASQSVDYDGDSYMN

SEQ ID NO: 19183 - protein, 7 aa, Artificial Sequence
  Description of Artificial Sequence: Synthetic peptide
  XENP020549 vlCDR2
AASNLES

SEQ ID NO: 19184 - protein, 9 aa, Artificial Sequence
  Description of Artificial Sequence: Synthetic peptide
  XENP020549 vlCDR3
QQSNEDPFT

SEQ ID NO: 19185 - protein, 450 aa, Artificial Sequence
  Description of Artificial Sequence: Synthetic polypeptide
  XENP020550 7G8_H0.98_L0_IgG1_PVA_/S267K Heavy Chain
EVKLEESGGGLVQPGGSMKLSCAASGFTFSDAWMDWVRQSPEKGLEWVAEIRTKANNHATLYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19186 - protein, 121 aa, Artificial Sequence
  Description of Artificial Sequence: Synthetic polypeptide
  VH of XENP020550
EVKLEESGGGLVQPGGSMKLSCAASGFTFSDAWMDWVRQSPEKGLEWVAEIRTKANNHATLYAESVKGRFTISRDDSKSSVYLQMNSLRAEDTGIYYCTRLANWDWYFDVWGAGTTVTVSS

SEQ ID NO: 19187 - protein, 5 aa, Artificial Sequence
  Description of Artificial Sequence: Synthetic peptide
  XENP020550 vhCDR1
DAWMD

SEQ ID NO: 19188 - protein, 19 aa, Artificial Sequence
  Description of Artificial Sequence: Synthetic peptide
  XENP020550 vhCDR2
EIRTKANNHATLYAESVKG

SEQ ID NO: 19189 - protein, 10 aa, Artificial Sequence
  Description of Artificial Sequence: Synthetic peptide
  XENP020550 vhCDR3
LANWDWYFDV

SEQ ID NO: 19190 - protein, 218 aa, Artificial Sequence; identical to SEQ ID NO: 17590
  Description of Artificial Sequence: Synthetic polypeptide
  XENP020550 7G8_H0.98_L0_IgG1_PVA_/S267K Light Chain

SEQ ID NO: 19191 - protein, 111 aa, Artificial Sequence; identical to SEQ ID NO: 17591
  Description of Artificial Sequence: Synthetic polypeptide
  VL of XENP020550

SEQ ID NO: 19192 - protein, 15 aa, Artificial Sequence
  Description of Artificial Sequence: Synthetic peptide
  XENP020550 vlCDR1
KASQSVDYDGDSYMN

SEQ ID NO: 19193 - protein, 7 aa, Artificial Sequence
  Description of Artificial Sequence: Synthetic peptide
  XENP020550 vlCDR2
AASNLES

SEQ ID NO: 19194 - protein, 9 aa, Artificial Sequence
  Description of Artificial Sequence: Synthetic peptide
  XENP020550 vlCDR3
QQSNEDPFT

SEQ ID NO: 19195 - protein, 450 aa, Artificial Sequence
  Description of Artificial Sequence: Synthetic polypeptide
  XENP020551 7G8_H0.99_L0_IgG1_PVA_/S267K Heavy Chain
EVKLEESGGGLVQPGGSMKLSCAASGFTFSDAWMDWVRQSPEKGLEWVAEIRTKANNHATWYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19196 - protein, 121 aa, Artificial Sequence
  Description of Artificial Sequence: Synthetic polypeptide
  VH of XENP020551
EVKLEESGGGLVQPGGSMKLSCAASGFTFSDAWMDWVRQSPEKGLEWVAEIRTKANNHATWYAESVKGRFTISRDDSKSSVYLQMNSLRAEDTGIYYCTRLANWDWYFDVWGAGTTVTVSS

SEQ ID NO: 19197 - protein, 5 aa, Artificial Sequence
  Description of Artificial Sequence: Synthetic peptide
  XENP020551 vhCDR1
DAWMD

SEQ ID NO: 19198 - protein, 19 aa, Artificial Sequence
  Description of Artificial Sequence: Synthetic peptide
  XENP020551 vhCDR2
EIRTKANNHATWYAESVKG

SEQ ID NO: 19199 - protein, 10 aa, Artificial Sequence
  Description of Artificial Sequence: Synthetic peptide
  XENP020551 vhCDR3
LANWDWYFDV

SEQ ID NO: 19200 - protein, 218 aa, Artificial Sequence; identical to SEQ ID NO: 17590
  Description of Artificial Sequence: Synthetic polypeptide
  XENP020551 7G8_H0.99_L0_IgG1_PVA_/S267K Light Chain

SEQ ID NO: 19201 - protein, 111 aa, Artificial Sequence; identical to SEQ ID NO: 17591
  Description of Artificial Sequence: Synthetic polypeptide
  VL of XENP020551

SEQ ID NO: 19202 - protein, 15 aa, Artificial Sequence
  Description of Artificial Sequence: Synthetic peptide
  XENP020551 vlCDR1
KASQSVDYDGDSYMN

SEQ ID NO: 19203 - protein, 7 aa, Artificial Sequence
  Description of Artificial Sequence: Synthetic peptide
  XENP020551 vlCDR2
AASNLES

SEQ ID NO: 19204 - protein, 9 aa, Artificial Sequence
  Description of Artificial Sequence: Synthetic peptide
  XENP020551 vlCDR3
QQSNEDPFT

SEQ ID NO: 19205 - protein, 450 aa, Artificial Sequence
  Description of Artificial Sequence: Synthetic polypeptide
  XENP020552 7G8_H0.100_L0_IgG1_PVA_/S267K Heavy Chain
EVKLEESGGGLVQPGGSMKLSCAASGFTFSDAWMDWVRQSPEKGLEWVAEIRTKANNHATVYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19206 - protein, 121 aa, Artificial Sequence
  Description of Artificial Sequence: Synthetic polypeptide
  VH of XENP020552
EVKLEESGGGLVQPGGSMKLSCAASGFTFSDAWMDWVRQSPEKGLEWVAEIRTKANNHATVYAESVKGRFTISRDDSKSSVYLQMNSLRAEDTGIYYCTRLANWDWYFDVWGAGTTVTVSS

SEQ ID NO: 19207 - protein, 5 aa, Artificial Sequence
  Description of Artificial Sequence: Synthetic peptide
  XENP020552 vhCDR1
DAWMD

SEQ ID NO: 19208 - protein, 19 aa, Artificial Sequence
  Description of Artificial Sequence: Synthetic peptide
  XENP020552 vhCDR2
EIRTKANNHATVYAESVKG

SEQ ID NO: 19209 - protein, 10 aa, Artificial Sequence
  Description of Artificial Sequence: Synthetic peptide
  XENP020552 vhCDR3
LANWDWYFDV

SEQ ID NO: 19210 - protein, 218 aa, Artificial Sequence; identical to SEQ ID NO: 17590
  Description of Artificial Sequence: Synthetic polypeptide
  XENP020552 7G8_H0.100_L0_IgG1_PVA_/S267K Light Chain

SEQ ID NO: 19211 - protein, 111 aa, Artificial Sequence; identical to SEQ ID NO: 17591
  Description of Artificial Sequence: Synthetic polypeptide
  VL of XENP020552

SEQ ID NO: 19212 - protein, 15 aa, Artificial Sequence
  Description of Artificial Sequence: Synthetic peptide
  XENP020552 vlCDR1
KASQSVDYDGDSYMN

SEQ ID NO: 19213 - protein, 7 aa, Artificial Sequence
  Description of Artificial Sequence: Synthetic peptide
  XENP020552 vlCDR2
AASNLES

SEQ ID NO: 19214 - protein, 9 aa, Artificial Sequence
  Description of Artificial Sequence: Synthetic peptide
  XENP020552 vlCDR3
QQSNEDPFT

SEQ ID NO: 19215 - protein, 450 aa, Artificial Sequence
  Description of Artificial Sequence: Synthetic polypeptide
  XENP020553 7G8_H0.101_L0_IgG1_PVA_/S267K Heavy Chain
EVKLEESGGGLVQPGGSMKLSCAASGFTFSDAWMDWVRQSPEKGLEWVAEIRTKANNHATAYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19216 - protein, 121 aa, Artificial Sequence
  Description of Artificial Sequence: Synthetic polypeptide
  VH of XENP020553
EVKLEESGGGLVQPGGSMKLSCAASGFTFSDAWMDWVRQSPEKGLEWVAEIRTKANNHATAYAESVKGRFTISRDDSKSSVYLQMNSLRAEDTGIYYCTRLANWDWYFDVWGAGTTVTVSS

SEQ ID NO: 19217 - protein, 5 aa, Artificial Sequence
  Description of Artificial Sequence: Synthetic peptide
  XENP020553 vhCDR1
DAWMD

SEQ ID NO: 19218 - protein, 19 aa, Artificial Sequence
  Description of Artificial Sequence: Synthetic peptide
  XENP020553 vhCDR2
EIRTKANNHATAYAESVKG

SEQ ID NO: 19219 - protein, 10 aa, Artificial Sequence
  Description of Artificial Sequence: Synthetic peptide
  XENP020553 vhCDR3
LANWDWYFDV

SEQ ID NO: 19220 - protein, 218 aa, Artificial Sequence; identical to SEQ ID NO: 17590
  Description of Artificial Sequence: Synthetic polypeptide
  XENP020553 7G8_H0.101_L0_IgG1_PVA_/S267K Light Chain

SEQ ID NO: 19221 - protein, 111 aa, Artificial Sequence; identical to SEQ ID NO: 17591
  Description of Artificial Sequence: Synthetic polypeptide
  VL of XENP020553

SEQ ID NO: 19222 - protein, 15 aa, Artificial Sequence
  Description of Artificial Sequence: Synthetic peptide
  XENP020553 vlCDR1
KASQSVDYDGDSYMN

SEQ ID NO: 19223 - protein, 7 aa, Artificial Sequence
  Description of Artificial Sequence: Synthetic peptide
  XENP020553 vlCDR2
AASNLES

SEQ ID NO: 19224 - protein, 9 aa, Artificial Sequence
  Description of Artificial Sequence: Synthetic peptide
  XENP020553 vlCDR3
QQSNEDPFT

SEQ ID NO: 19225 - protein, 450 aa, Artificial Sequence
  Description of Artificial Sequence: Synthetic polypeptide
  XENP020554 7G8_H0.102_L0_IgG1_PVA_/S267K Heavy Chain
EVKLEESGGGLVQPGGSMKLSCAASGFTFSDAWMDWVRQSPEKGLEWVAEIRTKANNHATQYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19226 - protein, 121 aa, Artificial Sequence
  Description of Artificial Sequence: Synthetic polypeptide
  VH of XENP020554
EVKLEESGGGLVQPGGSMKLSCAASGFTFSDAWMDWVRQSPEKGLEWVAEIRTKANNHATQYAESVKGRFTISRDDSKSSVYLQMNSLRAEDTGIYYCTRLANWDWYFDVWGAGTTVTVSS

SEQ ID NO: 19227 - protein, 5 aa, Artificial Sequence
  Description of Artificial Sequence: Synthetic peptide
  XENP020554 vhCDR1
DAWMD

SEQ ID NO: 19228 - protein, 19 aa, Artificial Sequence
  Description of Artificial Sequence: Synthetic peptide
  XENP020554 vhCDR2
EIRTKANNHATQYAESVKG

SEQ ID NO: 19229 - protein, 10 aa, Artificial Sequence
  Description of Artificial Sequence: Synthetic peptide
  XENP020554 vhCDR3
LANWDWYFDV

SEQ ID NO: 19230 - protein, 218 aa, Artificial Sequence; identical to SEQ ID NO: 17590
  Description of Artificial Sequence: Synthetic polypeptide
  XENP020554 7G8_H0.102_L0_IgG1_PVA_/S267K Light Chain

SEQ ID NO: 19231 - protein, 111 aa, Artificial Sequence; identical to SEQ ID NO: 17591
  Description of Artificial Sequence: Synthetic polypeptide
  VL of XENP020554

SEQ ID NO: 19232 - protein, 15 aa, Artificial Sequence
  Description of Artificial Sequence: Synthetic peptide
  XENP020554 vlCDR1
KASQSVDYDGDSYMN

SEQ ID NO: 19233 - protein, 7 aa, Artificial Sequence
  Description of Artificial Sequence: Synthetic peptide
  XENP020554 vlCDR2
AASNLES

SEQ ID NO: 19234 - protein, 9 aa, Artificial Sequence
  Description of Artificial Sequence: Synthetic peptide
  XENP020554 vlCDR3
QQSNEDPFT

SEQ ID NO: 19235 - protein, 450 aa, Artificial Sequence
  Description of Artificial Sequence: Synthetic polypeptide
  XENP020555 7G8_H0.103_L0_IgG1_PVA_/S267K Heavy Chain
EVKLEESGGGLVQPGGSMKLSCAASGFTFSDAWMDWVRQSPEKGLEWVAEIRTKANNHATDYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19236 - protein, 121 aa, Artificial Sequence
  Description of Artificial Sequence: Synthetic polypeptide
  VH of XENP020555
EVKLEESGGGLVQPGGSMKLSCAASGFTFSDAWMDWVRQSPEKGLEWVAEIRTKANNHATDYAESVKGRFTISRDDSKSSVYLQMNSLRAEDTGIYYCTRLANWDWYFDVWGAGTTVTVSS

SEQ ID NO: 19237 - protein, 5 aa, Artificial Sequence
  Description of Artificial Sequence: Synthetic peptide
  XENP020555 vhCDR1
DAWMD

SEQ ID NO: 19238 - protein, 19 aa, Artificial Sequence
  Description of Artificial Sequence: Synthetic peptide
  XENP020555 vhCDR2
EIRTKANNHATDYAESVKG

SEQ ID NO: 19239 - protein, 10 aa, Artificial Sequence
  Description of Artificial Sequence: Synthetic peptide
  XENP020555 vhCDR3
LANWDWYFDV

SEQ ID NO: 19240 - protein, 218 aa, Artificial Sequence; identical to SEQ ID NO: 17590
  Description of Artificial Sequence: Synthetic polypeptide
  XENP020555 7G8_H0.103_L0_IgG1_PVA_/S267K Light Chain

SEQ ID NO: 19241 - protein, 111 aa, Artificial Sequence; identical to SEQ ID NO: 17591
  Description of Artificial Sequence: Synthetic polypeptide
  VL of XENP020555

SEQ ID NO: 19242 - protein, 15 aa, Artificial Sequence
  Description of Artificial Sequence: Synthetic peptide
  XENP020555 vlCDR1
KASQSVDYDGDSYMN

SEQ ID NO: 19243 - protein, 7 aa, Artificial Sequence
  Description of Artificial Sequence: Synthetic peptide
  XENP020555 vlCDR2
AASNLES

SEQ ID NO: 19244 - protein, 9 aa, Artificial Sequence
  Description of Artificial Sequence: Synthetic peptide
  XENP020555 vlCDR3
QQSNEDPFT

SEQ ID NO: 19245 - protein, 450 aa, Artificial Sequence
  Description of Artificial Sequence: Synthetic polypeptide
  XENP020556 7G8_H0.104_L0_IgG1_PVA_/S267K Heavy Chain
EVKLEESGGGLVQPGGSMKLSCAASGFTFSDAWMDWVRQSPEKGLEWVAEIRTKANNHATKYAESVKGRFTISRDDSKSSVYLQMNSLRAEDTGIYYCTRLANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19246 - protein, 121 aa, Artificial Sequence
  Description of Artificial Sequence: Synthetic polypeptide
  VH of XENP020556
EVKLEESGGGLVQPGGSMKLSCAASGFTFSDAWMDWVRQSPEKGLEWVAEIRTKANNHATKYAESVKGRFTISRDDSKSSVYLQMNSLRAEDTGIYYCTRLANWDWYFDVWGAGTTVTVSS

SEQ ID NO: 19247 - protein, 5 aa, Artificial Sequence
  Description of Artificial Sequence: Synthetic peptide
  XENP020556 vhCDR1
DAWMD

SEQ ID NO: 19248 - protein, 19 aa, Artificial Sequence
  Description of Artificial Sequence: Synthetic peptide
  XENP020556 vhCDR2
EIRTKANNHATKYAESVKG

SEQ ID NO: 19249 - protein, 10 aa, Artificial Sequence
  Description of Artificial Sequence: Synthetic peptide
  XENP020556 vhCDR3
LANWDWYFDV

SEQ ID NO: 19250 - protein, 218 aa, Artificial Sequence; identical to SEQ ID NO: 17590
  Description of Artificial Sequence: Synthetic polypeptide
  XENP020556 7G8_H0.104_L0_IgG1_PVA_/S267K Light Chain

SEQ ID NO: 19251 - protein, 111 aa, Artificial Sequence; identical to SEQ ID NO: 17591
  Description of Artificial Sequence: Synthetic polypeptide
  VL of XENP020556

SEQ ID NO: 19252 - protein, 15 aa, Artificial Sequence
  Description of Artificial Sequence: Synthetic peptide
  XENP020556 vlCDR1
KASQSVDYDGDSYMN

SEQ ID NO: 19253 - protein, 7 aa, Artificial Sequence
  Description of Artificial Sequence: Synthetic peptide
  XENP020556 vlCDR2
AASNLES

SEQ ID NO: 19254 - protein, 9 aa, Artificial Sequence
  Description of Artificial Sequence: Synthetic peptide
  XENP020556 vlCDR3
QQSNEDPFT

SEQ ID NO: 19255 - protein, 450 aa, Artificial Sequence
  Description of Artificial Sequence: Synthetic polypeptide
  XENP020557 7G8_H0.105_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRIANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19256 - protein, 121 aa, Artificial Sequence
  Description of Artificial Sequence: Synthetic polypeptide
  VH of XENP020557
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRIANWDWYFDVWGAGTTVTVSS

SEQ ID NO: 19257 - protein, 5 aa, Artificial Sequence
  Description of Artificial Sequence: Synthetic peptide
  XENP020557 vhCDR1
DAWMD

SEQ ID NO: 19258 - protein, 19 aa, Artificial Sequence
  Description of Artificial Sequence: Synthetic peptide
  XENP020557 vhCDR2
EIRTKANNHATYYAESVKG

SEQ ID NO: 19259 - protein, 10 aa, Artificial Sequence
  Description of Artificial Sequence: Synthetic peptide
  XENP020557 vhCDR3
IANWDWYFDV

SEQ ID NO: 19260 - protein, 218 aa, Artificial Sequence; identical to SEQ ID NO: 17590
  Description of Artificial Sequence: Synthetic polypeptide
  XENP020557 7G8_H0.105_L0_IgG1_PVA_/S267K Light Chain

SEQ ID NO: 19261 - protein, 111 aa, Artificial Sequence; identical to SEQ ID NO: 17591
  Description of Artificial Sequence: Synthetic polypeptide
  VL of XENP020557

SEQ ID NO: 19262 - protein, 15 aa, Artificial Sequence
  Description of Artificial Sequence: Synthetic peptide
  XENP020557 vlCDR1
KASQSVDYDGDSYMN

SEQ ID NO: 19263 - protein, 7 aa, Artificial Sequence
  Description of Artificial Sequence: Synthetic peptide
  XENP020557 vlCDR2
AASNLES

SEQ ID NO: 19264 - protein, 9 aa, Artificial Sequence
  Description of Artificial Sequence: Synthetic peptide
  XENP020557 vlCDR3
QQSNEDPFT

SEQ ID NO: 19265 - protein, 450 aa, Artificial Sequence
  Description of Artificial Sequence: Synthetic polypeptide
  XENP020558 7G8_H0.106_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRFANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19266 - protein, 121 aa, Artificial Sequence
  Description of Artificial Sequence: Synthetic polypeptide
  VH of XENP020558
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRFANWDWYFDVWGAGTTVTVSS

SEQ ID NO: 19267 - protein, 5 aa, Artificial Sequence
  Description of Artificial Sequence: Synthetic peptide
  XENP020558 vhCDR1
DAWMD

SEQ ID NO: 19268 - protein, 19 aa, Artificial Sequence
  Description of Artificial Sequence: Synthetic peptide
  XENP020558 vhCDR2
EIRTKANNHATYYAESVKG

SEQ ID NO: 19269 - protein, 10 aa, Artificial Sequence
  Description of Artificial Sequence: Synthetic peptide
  XENP020558 vhCDR3
FANWDWYFDV

SEQ ID NO: 19270 - protein, 218 aa, Artificial Sequence; identical to SEQ ID NO: 17590
  Description of Artificial Sequence: Synthetic polypeptide
  XENP020558 7G8_H0.106_L0_IgG1_PVA_/S267K Light Chain

SEQ ID NO: 19271 - protein, 111 aa, Artificial Sequence; identical to SEQ ID NO: 17591
  Description of Artificial Sequence: Synthetic polypeptide
  VL of XENP020558

SEQ ID NO: 19272 - protein, 15 aa, Artificial Sequence
  Description of Artificial Sequence: Synthetic peptide
  XENP020558 vlCDR1
KASQSVDYDGDSYMN

SEQ ID NO: 19273 - protein, 7 aa, Artificial Sequence
  Description of Artificial Sequence: Synthetic peptide
  XENP020558 vlCDR2
AASNLES

SEQ ID NO: 19274 - protein, 9 aa, Artificial Sequence
  Description of Artificial Sequence: Synthetic peptide
  XENP020558 vlCDR3
QQSNEDPFT

SEQ ID NO: 19275 - protein, 450 aa, Artificial Sequence
  Description of Artificial Sequence: Synthetic polypeptide
  XENP020559 7G8_H0.107_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRVANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19276 - protein, 121 aa, Artificial Sequence
  Description of Artificial Sequence: Synthetic polypeptide
  VH of XENP020559
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRVANWDWYFDVWGAGTTVTVSS

SEQ ID NO: 19277 - protein, 5 aa, Artificial Sequence
  Description of Artificial Sequence: Synthetic peptide
  XENP020559 vhCDR1
DAWMD

SEQ ID NO: 19278 - protein, 19 aa, Artificial Sequence
  Description of Artificial Sequence: Synthetic peptide
  XENP020559 vhCDR2
EIRTKANNHATYYAESVKG

SEQ ID NO: 19279 - protein, 10 aa, Artificial Sequence
  Description of Artificial Sequence: Synthetic peptide
  XENP020559 vhCDR3
VANWDWYFDV

SEQ ID NO: 19280 - protein, 218 aa, Artificial Sequence; identical to SEQ ID NO: 17590
  Description of Artificial Sequence: Synthetic polypeptide
  XENP020559 7G8_H0.107_L0_IgG1_PVA_/S267K Light Chain

SEQ ID NO: 19281 - protein, 111 aa, Artificial Sequence; identical to SEQ ID NO: 17591
  Description of Artificial Sequence: Synthetic polypeptide
  VL of XENP020559

SEQ ID NO: 19282 - protein, 15 aa, Artificial Sequence
  Description of Artificial Sequence: Synthetic peptide
  XENP020559 vlCDR1
KASQSVDYDGDSYMN

SEQ ID NO: 19283 - protein, 7 aa, Artificial Sequence
  Description of Artificial Sequence: Synthetic peptide
  XENP020559 vlCDR2
AASNLES

SEQ ID NO: 19284 - protein, 9 aa, Artificial Sequence
  Description of Artificial Sequence: Synthetic peptide
  XENP020559 vlCDR3
QQSNEDPFT

SEQ ID NO: 19285 - protein, 450 aa, Artificial Sequence
  Description of Artificial Sequence: Synthetic polypeptide
  XENP020560 7G8_H0.108_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRYANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19286 - protein, 121 aa, Artificial Sequence
  Description of Artificial Sequence: Synthetic polypeptide
  VH of XENP020560
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRYANWDWYFDVWGAGTTVTVSS

SEQ ID NO: 19287 - protein, 5 aa, Artificial Sequence
  Description of Artificial Sequence: Synthetic peptide
  XENP020560 vhCDR1
DAWMD

SEQ ID NO: 19288 - protein, 19 aa, Artificial Sequence
  Description of Artificial Sequence: Synthetic peptide
  XENP020560 vhCDR2
EIRTKANNHATYYAESVKG

SEQ ID NO: 19289 - protein, 10 aa, Artificial Sequence
  Description of Artificial Sequence: Synthetic peptide
  XENP020560 vhCDR3
YANWDWYFDV

SEQ ID NO: 19290 - protein, 218 aa, Artificial Sequence; identical to SEQ ID NO: 17590
  Description of Artificial Sequence: Synthetic polypeptide
  XENP020560 7G8_H0.108_L0_IgG1_PVA_/S267K Light Chain

SEQ ID NO: 19291 - protein, 111 aa, Artificial Sequence; identical to SEQ ID NO: 17591
  Description of Artificial Sequence: Synthetic polypeptide
  VL of XENP020560

SEQ ID NO: 19292 - protein, 15 aa, Artificial Sequence
  Description of Artificial Sequence: Synthetic peptide
  XENP020560 vlCDR1
KASQSVDYDGDSYMN

SEQ ID NO: 19293 - protein, 7 aa, Artificial Sequence
  Description of Artificial Sequence: Synthetic peptide
  XENP020560 vlCDR2
AASNLES

SEQ ID NO: 19294 - protein, 9 aa, Artificial Sequence
  Description of Artificial Sequence: Synthetic peptide
  XENP020560 vlCDR3
QQSNEDPFT

SEQ ID NO: 19295 - protein, 450 aa, Artificial Sequence
  Description of Artificial Sequence: Synthetic polypeptide
  XENP020561 7G8_H0.109_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRWANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19296 - protein, 121 aa, Artificial Sequence
  Description of Artificial Sequence: Synthetic polypeptide
  VH of XENP020561
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRWANWDWYFDVWGAGTTVTVSS

SEQ ID NO: 19297 - protein, 5 aa, Artificial Sequence
  Description of Artificial Sequence: Synthetic peptide
  XENP020561 vhCDR1
DAWMD

SEQ ID NO: 19298 - protein, 19 aa, Artificial Sequence
  Description of Artificial Sequence: Synthetic peptide
  XENP020561 vhCDR2
EIRTKANNHATYYAESVKG

SEQ ID NO: 19299 - protein, 10 aa, Artificial Sequence
  Description of Artificial Sequence: Synthetic peptide
  XENP020561 vhCDR3
WANWDWYFDV

SEQ ID NO: 19300 - protein, 218 aa, Artificial Sequence; identical to SEQ ID NO: 17590
  Description of Artificial Sequence: Synthetic polypeptide
  XENP020561 7G8_H0.109_L0_IgG1_PVA_/S267K Light Chain

SEQ ID NO: 19301 - protein, 111 aa, Artificial Sequence; identical to SEQ ID NO: 17591
  Description of Artificial Sequence: Synthetic polypeptide
  VL of XENP020561

SEQ ID NO: 19302 - protein, 15 aa, Artificial Sequence
  Description of Artificial Sequence: Synthetic peptide
  XENP020561 vlCDR1
KASQSVDYDGDSYMN

SEQ ID NO: 19303 - protein, 7 aa, Artificial Sequence
  Description of Artificial Sequence: Synthetic peptide
  XENP020561 vlCDR2
AASNLES

SEQ ID NO: 19304 - protein, 9 aa, Artificial Sequence
  Description of Artificial Sequence: Synthetic peptide
  XENP020561 vlCDR3
QQSNEDPFT

SEQ ID NO: 19305 - protein, 450 aa, Artificial Sequence
  Description of Artificial Sequence: Synthetic polypeptide
  XENP020562 7G8_H0.110_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRDANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19306 - protein, 121 aa, Artificial Sequence
  Description of Artificial Sequence: Synthetic polypeptide
  VH of XENP020562
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRDANWDWYFDVWGAGTTVTVSS

SEQ ID NO: 19307 - protein, 5 aa, Artificial Sequence
  Description of Artificial Sequence: Synthetic peptide
  XENP020562 vhCDR1
DAWMD

SEQ ID NO: 19308 - protein, 19 aa, Artificial Sequence
  Description of Artificial Sequence: Synthetic peptide
  XENP020562 vhCDR2
EIRTKANNHATYYAESVKG

SEQ ID NO: 19309 - protein, 10 aa, Artificial Sequence
  Description of Artificial Sequence: Synthetic peptide
  XENP020562 vhCDR3
DANWDWYFDV

SEQ ID NO: 19310 - protein, 218 aa, Artificial Sequence; identical to SEQ ID NO: 17590
  Description of Artificial Sequence: Synthetic polypeptide
  XENP020562 7G8_H0.110_L0_IgG1_PVA_/S267K Light Chain

SEQ ID NO: 19311 - protein, 111 aa, Artificial Sequence; identical to SEQ ID NO: 17591
  Description of Artificial Sequence: Synthetic polypeptide
  VL of XENP020562

SEQ ID NO: 19312 - protein, 15 aa, Artificial Sequence
  Description of Artificial Sequence: Synthetic peptide
  XENP020562 vlCDR1
KASQSVDYDGDSYMN

SEQ ID NO: 19313 - protein, 7 aa, Artificial Sequence
  Description of Artificial Sequence: Synthetic peptide
  XENP020562 vlCDR2
AASNLES

SEQ ID NO: 19314 - protein, 9 aa, Artificial Sequence
  Description of Artificial Sequence: Synthetic peptide
  XENP020562 vlCDR3
QQSNEDPFT

SEQ ID NO: 19315 - protein, 450 aa, Artificial Sequence
  Description of Artificial Sequence: Synthetic polypeptide
  XENP020563 7G8_H0.111_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRAANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19316 - protein, 121 aa, Artificial Sequence
  Description of Artificial Sequence: Synthetic polypeptide
  VH of XENP020563
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRAANWDWYFDVWGAGTTVTVSS

SEQ ID NO: 19317 - protein, 5 aa, Artificial Sequence
  Description of Artificial Sequence: Synthetic peptide
  XENP020563 vhCDR1
DAWMD

SEQ ID NO: 19318 - protein, 19 aa, Artificial Sequence
  Description of Artificial Sequence: Synthetic peptide
  XENP020563 vhCDR2
EIRTKANNHATYYAESVKG

SEQ ID NO: 19319 - protein, 10 aa, Artificial Sequence
  Description of Artificial Sequence: Synthetic peptide
  XENP020563 vhCDR3
AANWDWYFDV

SEQ ID NO: 19320 - protein, 218 aa, Artificial Sequence; identical to SEQ ID NO: 17590
  Description of Artificial Sequence: Synthetic polypeptide
  XENP020563 7G8_H0.111_L0_IgG1_PVA_/S267K Light Chain

SEQ ID NO: 19321 - protein, 111 aa, Artificial Sequence; identical to SEQ ID NO: 17591
  Description of Artificial Sequence: Synthetic polypeptide
  VL of XENP020563

SEQ ID NO: 19322 - protein, 15 aa, Artificial Sequence
  Description of Artificial Sequence: Synthetic peptide
  XENP020563 vlCDR1
KASQSVDYDGDSYMN

SEQ ID NO: 19323 - protein, 7 aa, Artificial Sequence
  Description of Artificial Sequence: Synthetic peptide
  XENP020563 vlCDR2
AASNLES

SEQ ID NO: 19324 - protein, 9 aa, Artificial Sequence
  Description of Artificial Sequence: Synthetic peptide
  XENP020563 vlCDR3
QQSNEDPFT

SEQ ID NO: 19325 - protein, 450 aa, Artificial Sequence
  Description of Artificial Sequence: Synthetic polypeptide
  XENP020564 7G8_H0.112_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRQANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19326 - protein, 121 aa, Artificial Sequence
  Description of Artificial Sequence: Synthetic polypeptide
  VH of XENP020564
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRQANWDWYFDVWGAGTTVTVSS

SEQ ID NO: 19327 - protein, 5 aa, Artificial Sequence
  Description of Artificial Sequence: Synthetic peptide
  XENP020564 vhCDR1
DAWMD

SEQ ID NO: 19328 - protein, 19 aa, Artificial Sequence
  Description of Artificial Sequence: Synthetic peptide
  XENP020564 vhCDR2
EIRTKANNHATYYAESVKG

SEQ ID NO: 19329 - protein, 10 aa, Artificial Sequence
  Description of Artificial Sequence: Synthetic peptide
  XENP020564 vhCDR3
QANWDWYFDV

SEQ ID NO: 19330 - protein, 218 aa, Artificial Sequence; identical to SEQ ID NO: 17590
  Description of Artificial Sequence: Synthetic polypeptide
  XENP020564 7G8_H0.112_L0_IgG1_PVA_/S267K Light Chain

SEQ ID NO: 19331 - protein, 111 aa, Artificial Sequence; identical to SEQ ID NO: 17591
  Description of Artificial Sequence: Synthetic polypeptide
  VL of XENP020564

SEQ ID NO: 19332 - protein, 15 aa, Artificial Sequence
  Description of Artificial Sequence: Synthetic peptide
  XENP020564 vlCDR1
KASQSVDYDGDSYMN

SEQ ID NO: 19333 - protein, 7 aa, Artificial Sequence
  Description of Artificial Sequence: Synthetic peptide
  XENP020564 vlCDR2
AASNLES

SEQ ID NO: 19334 - protein, 9 aa, Artificial Sequence
  Description of Artificial Sequence: Synthetic peptide
  XENP020564 vlCDR3
QQSNEDPFT

SEQ ID NO: 19335 - protein, 450 aa, Artificial Sequence
  Description of Artificial Sequence: Synthetic polypeptide
  XENP020565 7G8_H0.113_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRKANWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19336 - protein, 121 aa, Artificial Sequence
  Description of Artificial Sequence: Synthetic polypeptide
  VH of XENP020565
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRKANWDWYFDVWGAGTTVTVSS

SEQ ID NO: 19337 - protein, 5 aa, Artificial Sequence
  Description of Artificial Sequence: Synthetic peptide
  XENP020565 vhCDR1
DAWMD

SEQ ID NO: 19338 - protein, 19 aa, Artificial Sequence
  Description of Artificial Sequence: Synthetic peptide
  XENP020565 vhCDR2
EIRTKANNHATYYAESVKG

SEQ ID NO: 19339 - protein, 10 aa, Artificial Sequence
  Description of Artificial Sequence: Synthetic peptide
  XENP020565 vhCDR3
KANWDWYFDV

SEQ ID NO: 19340 - protein, 218 aa, Artificial Sequence; identical to SEQ ID NO: 17590
  Description of Artificial Sequence: Synthetic polypeptide
  XENP020565 7G8_H0.113_L0_IgG1_PVA_/S267K Light Chain

SEQ ID NO: 19341 - protein, 111 aa, Artificial Sequence; identical to SEQ ID NO: 17591
  Description of Artificial Sequence: Synthetic polypeptide
  VL of XENP020565

SEQ ID NO: 19342 - protein, 15 aa, Artificial Sequence
  Description of Artificial Sequence: Synthetic peptide
  XENP020565 vlCDR1
KASQSVDYDGDSYMN

SEQ ID NO: 19343 - protein, 7 aa, Artificial Sequence
  Description of Artificial Sequence: Synthetic peptide
  XENP020565 vlCDR2
AASNLES

SEQ ID NO: 19344 - protein, 9 aa, Artificial Sequence
  Description of Artificial Sequence: Synthetic peptide
  XENP020565 vlCDR3
QQSNEDPFT

SEQ ID NO: 19345 - protein, 450 aa, Artificial Sequence
  Description of Artificial Sequence: Synthetic polypeptide
  XENP020566 7G8_H0.114_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLSNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19346 - protein, 121 aa, Artificial Sequence
  Description of Artificial Sequence: Synthetic polypeptide
  VH of XENP020566
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLSNWDWYFDVWGAGTTVTVSS

SEQ ID NO: 19347 - protein, 5 aa, Artificial Sequence
  Description of Artificial Sequence: Synthetic peptide
  XENP020566 vhCDR1
DAWMD

SEQ ID NO: 19348 - protein, 19 aa, Artificial Sequence
  Description of Artificial Sequence: Synthetic peptide
  XENP020566 vhCDR2
EIRTKANNHATYYAESVKG

SEQ ID NO: 19349 - protein, 10 aa, Artificial Sequence
  Description of Artificial Sequence: Synthetic peptide
  XENP020566 vhCDR3
LSNWDWYFDV

SEQ ID NO: 19350 - protein, 218 aa, Artificial Sequence; identical to SEQ ID NO: 17590
  Description of Artificial Sequence: Synthetic polypeptide
  XENP020566 7G8_H0.114_L0_IgG1_PVA_/S267K Light Chain

SEQ ID NO: 19351 - protein, 111 aa, Artificial Sequence; identical to SEQ ID NO: 17591
  Description of Artificial Sequence: Synthetic polypeptide
  VL of XENP020566

SEQ ID NO: 19352 - protein, 15 aa, Artificial Sequence
  Description of Artificial Sequence: Synthetic peptide
  XENP020566 vlCDR1
KASQSVDYDGDSYMN

SEQ ID NO: 19353 - protein, 7 aa, Artificial Sequence
  Description of Artificial Sequence: Synthetic peptide
  XENP020566 vlCDR2
AASNLES

SEQ ID NO: 19354 - protein, 9 aa, Artificial Sequence
  Description of Artificial Sequence: Synthetic peptide
  XENP020566 vlCDR3
QQSNEDPFT

SEQ ID NO: 19355 - protein, 450 aa, Artificial Sequence
  Description of Artificial Sequence: Synthetic polypeptide
  XENP020567 7G8_H0.115_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLTNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19356 - protein, 121 aa, Artificial Sequence
  Description of Artificial Sequence: Synthetic polypeptide
  VH of XENP020567
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLTNWDWYFDVWGAGTTVTVSS

SEQ ID NO: 19357 - protein, 5 aa, Artificial Sequence
  Description of Artificial Sequence: Synthetic peptide
  XENP020567 vhCDR1
DAWMD

SEQ ID NO: 19358 - protein, 19 aa, Artificial Sequence
  Description of Artificial Sequence: Synthetic peptide
  XENP020567 vhCDR2
EIRTKANNHATYYAESVKG

SEQ ID NO: 19359 - protein, 10 aa, Artificial Sequence
  Description of Artificial Sequence: Synthetic peptide
  XENP020567 vhCDR3
LTNWDWYFDV

SEQ ID NO: 19360 - protein, 218 aa, Artificial Sequence; identical to SEQ ID NO: 17590
  Description of Artificial Sequence: Synthetic polypeptide
  XENP020567 7G8_H0.115_L0_IgG1_PVA_/S267K Light Chain

SEQ ID NO: 19361 - protein, 111 aa, Artificial Sequence; identical to SEQ ID NO: 17591
  Description of Artificial Sequence: Synthetic polypeptide
  VL of XENP020567

SEQ ID NO: 19362 - protein, 15 aa, Artificial Sequence
  Description of Artificial Sequence: Synthetic peptide
  XENP020567 vlCDR1
KASQSVDYDGDSYMN

SEQ ID NO: 19363 - protein, 7 aa, Artificial Sequence
  Description of Artificial Sequence: Synthetic peptide
  XENP020567 vlCDR2
AASNLES

SEQ ID NO: 19364 - protein, 9 aa, Artificial Sequence
  Description of Artificial Sequence: Synthetic peptide
  XENP020567 vlCDR3
QQSNEDPFT

SEQ ID NO: 19365 - protein, 450 aa, Artificial Sequence
  Description of Artificial Sequence: Synthetic polypeptide
  XENP020568 7G8_H0.116_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLGNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19366 - protein, 121 aa, Artificial Sequence
  Description of Artificial Sequence: Synthetic polypeptide
  VH of XENP020568
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLGNWDWYFDVWGAGTTVTVSS

SEQ ID NO: 19367 - protein, 5 aa, Artificial Sequence
  Description of Artificial Sequence: Synthetic peptide
  XENP020568 vhCDR1
DAWMD

SEQ ID NO: 19368 - protein, 19 aa, Artificial Sequence
  Description of Artificial Sequence: Synthetic peptide
  XENP020568 vhCDR2
EIRTKANNHATYYAESVKG

SEQ ID NO: 19369 - protein, 10 aa, Artificial Sequence
  Description of Artificial Sequence: Synthetic peptide
  XENP020568 vhCDR3
LGNWDWYFDV

SEQ ID NO: 19370 - protein, 218 aa, Artificial Sequence; identical to SEQ ID NO: 17590
  Description of Artificial Sequence: Synthetic polypeptide
  XENP020568 7G8_H0.116_L0_IgG1_PVA_/S267K Light Chain

SEQ ID NO: 19371 - protein, 111 aa, Artificial Sequence; identical to SEQ ID NO: 17591
  Description of Artificial Sequence: Synthetic polypeptide
  VL of XENP020568

SEQ ID NO: 19372 - protein, 15 aa, Artificial Sequence
  Description of Artificial Sequence: Synthetic peptide
  XENP020568 vlCDR1
KASQSVDYDGDSYMN

SEQ ID NO: 19373 - protein, 7 aa, Artificial Sequence
  Description of Artificial Sequence: Synthetic peptide
  XENP020568 vlCDR2
AASNLES

SEQ ID NO: 19374 - protein, 9 aa, Artificial Sequence
  Description of Artificial Sequence: Synthetic peptide
  XENP020568 vlCDR3
QQSNEDPFT

SEQ ID NO: 19375 - protein, 450 aa, Artificial Sequence
  Description of Artificial Sequence: Synthetic polypeptide
  XENP020569 7G8_H0.117_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLHNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19376 - protein, 121 aa, Artificial Sequence
  Description of Artificial Sequence: Synthetic polypeptide
  VH of XENP020569
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLHNWDWYFDVWGAGTTVTVSS

SEQ ID NO: 19377 - protein, 5 aa, Artificial Sequence
  Description of Artificial Sequence: Synthetic peptide
  XENP020569 vhCDR1
DAWMD

SEQ ID NO: 19378 - protein, 19 aa, Artificial Sequence
  Description of Artificial Sequence: Synthetic peptide
  XENP020569 vhCDR2
EIRTKANNHATYYAESVKG

SEQ ID NO: 19379 - protein, 10 aa, Artificial Sequence
  Description of Artificial Sequence: Synthetic peptide
  XENP020569 vhCDR3
LHNWDWYFDV

SEQ ID NO: 19380 - protein, 218 aa, Artificial Sequence; identical to SEQ ID NO: 17590
  Description of Artificial Sequence: Synthetic polypeptide
  XENP020569 7G8_H0.117_L0_IgG1_PVA_/S267K Light Chain

SEQ ID NO: 19381 - protein, 111 aa, Artificial Sequence; identical to SEQ ID NO: 17591
  Description of Artificial Sequence: Synthetic polypeptide
  VL of XENP020569

SEQ ID NO: 19382 - protein, 15 aa, Artificial Sequence
  Description of Artificial Sequence: Synthetic peptide
  XENP020569 vlCDR1
KASQSVDYDGDSYMN

SEQ ID NO: 19383 - protein, 7 aa, Artificial Sequence
  Description of Artificial Sequence: Synthetic peptide
  XENP020569 vlCDR2
AASNLES

SEQ ID NO: 19384 - protein, 9 aa, Artificial Sequence
  Description of Artificial Sequence: Synthetic peptide
  XENP020569 vlCDR3
QQSNEDPFT

SEQ ID NO: 19385 - protein, 450 aa, Artificial Sequence
  Description of Artificial Sequence: Synthetic polypeptide
  XENP020570 7G8_H0.118_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLQNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19386 - protein, 121 aa, Artificial Sequence
  Description of Artificial Sequence: Synthetic polypeptide
  VH of XENP020570
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLQNWDWYFDVWGAGTTVTVSS

SEQ ID NO: 19387 - protein, 5 aa, Artificial Sequence
  Description of Artificial Sequence: Synthetic peptide
  XENP020570 vhCDR1
DAWMD

SEQ ID NO: 19388 - protein, 19 aa, Artificial Sequence
  Description of Artificial Sequence: Synthetic peptide
  XENP020570 vhCDR2
EIRTKANNHATYYAESVKG

SEQ ID NO: 19389 - protein, 10 aa, Artificial Sequence
  Description of Artificial Sequence: Synthetic peptide
  XENP020570 vhCDR3
LQNWDWYFDV

SEQ ID NO: 19390 - protein, 218 aa, Artificial Sequence; identical to SEQ ID NO: 17590
  Description of Artificial Sequence: Synthetic polypeptide
  XENP020570 7G8_H0.118_L0_IgG1_PVA_/S267K Light Chain

SEQ ID NO: 19391 - protein, 111 aa, Artificial Sequence; identical to SEQ ID NO: 17591
  Description of Artificial Sequence: Synthetic polypeptide
  VL of XENP020570

SEQ ID NO: 19392 - protein, 15 aa, Artificial Sequence
  Description of Artificial Sequence: Synthetic peptide
  XENP020570 vlCDR1
KASQSVDYDGDSYMN

SEQ ID NO: 19393 - protein, 7 aa, Artificial Sequence
  Description of Artificial Sequence: Synthetic peptide
  XENP020570 vlCDR2
AASNLES

SEQ ID NO: 19394 - protein, 9 aa, Artificial Sequence
  Description of Artificial Sequence: Synthetic peptide
  XENP020570 vlCDR3
QQSNEDPFT

SEQ ID NO: 19395 - protein, 450 aa, Artificial Sequence
  Description of Artificial Sequence: Synthetic polypeptide
  XENP020571 7G8_H0.119_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLDNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19396 - protein, 121 aa, Artificial Sequence
  Description of Artificial Sequence: Synthetic polypeptide
  VH of XENP020571
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLDNWDWYFDVWGAGTTVTVSS

SEQ ID NO: 19397 - protein, 5 aa, Artificial Sequence
  Description of Artificial Sequence: Synthetic peptide
  XENP020571 vhCDR1
DAWMD

SEQ ID NO: 19398 - protein, 19 aa, Artificial Sequence
  Description of Artificial Sequence: Synthetic peptide
  XENP020571 vhCDR2
EIRTKANNHATYYAESVKG

SEQ ID NO: 19399 - protein, 10 aa, Artificial Sequence
  Description of Artificial Sequence: Synthetic peptide
  XENP020571 vhCDR3
LDNWDWYFDV

SEQ ID NO: 19400 - protein, 218 aa, Artificial Sequence; identical to SEQ ID NO: 17590
  Description of Artificial Sequence: Synthetic polypeptide
  XENP020571 7G8_H0.119_L0_IgG1_PVA_/S267K Light Chain

SEQ ID NO: 19401 - protein, 111 aa, Artificial Sequence; identical to SEQ ID NO: 17591
  Description of Artificial Sequence: Synthetic polypeptide
  VL of XENP020571

SEQ ID NO: 19402 - protein, 15 aa, Artificial Sequence
  Description of Artificial Sequence: Synthetic peptide
  XENP020571 vlCDR1
KASQSVDYDGDSYMN

SEQ ID NO: 19403 - protein, 7 aa, Artificial Sequence
  Description of Artificial Sequence: Synthetic peptide
  XENP020571 vlCDR2
AASNLES

SEQ ID NO: 19404 - protein, 9 aa, Artificial Sequence
  Description of Artificial Sequence: Synthetic peptide
  XENP020571 vlCDR3
QQSNEDPFT

SEQ ID NO: 19405 - protein, 450 aa, Artificial Sequence
  Description of Artificial Sequence: Synthetic polypeptide
  XENP020572 7G8_H0.120_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLLNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19406 - protein, 121 aa, Artificial Sequence
  Description of Artificial Sequence: Synthetic polypeptide
  VH of XENP020572
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLLNWDWYFDVWGAGTTVTVSS

SEQ ID NO: 19407 - protein, 5 aa, Artificial Sequence
  Description of Artificial Sequence: Synthetic peptide
  XENP020572 vhCDR1
DAWMD

SEQ ID NO: 19408 - protein, 19 aa, Artificial Sequence
  Description of Artificial Sequence: Synthetic peptide
  XENP020572 vhCDR2
EIRTKANNHATYYAESVKG

SEQ ID NO: 19409 - protein, 10 aa, Artificial Sequence
  Description of Artificial Sequence: Synthetic peptide
  XENP020572 vhCDR3
LLNWDWYFDV

SEQ ID NO: 19410 - protein, 218 aa, Artificial Sequence; identical to SEQ ID NO: 17590
  Description of Artificial Sequence: Synthetic polypeptide
  XENP020572 7G8_H0.120_L0_IgG1_PVA_/S267K Light Chain

SEQ ID NO: 19411 - protein, 111 aa, Artificial Sequence; identical to SEQ ID NO: 17591
  Description of Artificial Sequence: Synthetic polypeptide
  VL of XENP020572

SEQ ID NO: 19412 - protein, 15 aa, Artificial Sequence
  Description of Artificial Sequence: Synthetic peptide
  XENP020572 vlCDR1
KASQSVDYDGDSYMN

SEQ ID NO: 19413 - protein, 7 aa, Artificial Sequence
  Description of Artificial Sequence: Synthetic peptide
  XENP020572 vlCDR2
AASNLES

SEQ ID NO: 19414 - protein, 9 aa, Artificial Sequence
  Description of Artificial Sequence: Synthetic peptide
  XENP020572 vlCDR3
QQSNEDPFT

SEQ ID NO: 19415 - protein, 450 aa, Artificial Sequence
  Description of Artificial Sequence: Synthetic polypeptide
  XENP020573 7G8_H0.121_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLKNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19416 - protein, 121 aa, Artificial Sequence
  Description of Artificial Sequence: Synthetic polypeptide
  VH of XENP020573
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLKNWDWYFDVWGAGTTVTVSS

SEQ ID NO: 19417 - protein, 5 aa, Artificial Sequence
  Description of Artificial Sequence: Synthetic peptide
  XENP020573 vhCDR1
DAWMD

SEQ ID NO: 19418 - protein, 19 aa, Artificial Sequence
  Description of Artificial Sequence: Synthetic peptide
  XENP020573 vhCDR2
EIRTKANNHATYYAESVKG

SEQ ID NO: 19419 - protein, 10 aa, Artificial Sequence
  Description of Artificial Sequence: Synthetic peptide
  XENP020573 vhCDR3
LKNWDWYFDV

SEQ ID NO: 19420 - protein, 218 aa, Artificial Sequence; identical to SEQ ID NO: 17590
  Description of Artificial Sequence: Synthetic polypeptide
  XENP020573 7G8_H0.121_L0_IgG1_PVA_/S267K Light Chain

SEQ ID NO: 19421 - protein, 111 aa, Artificial Sequence; identical to SEQ ID NO: 17591
  Description of Artificial Sequence: Synthetic polypeptide
  VL of XENP020573

SEQ ID NO: 19422 - protein, 15 aa, Artificial Sequence
  Description of Artificial Sequence: Synthetic peptide
  XENP020573 vlCDR1
KASQSVDYDGDSYMN

SEQ ID NO: 19423 - protein, 7 aa, Artificial Sequence
  Description of Artificial Sequence: Synthetic peptide
  XENP020573 vlCDR2
AASNLES

SEQ ID NO: 19424 - protein, 9 aa, Artificial Sequence
  Description of Artificial Sequence: Synthetic peptide
  XENP020573 vlCDR3
QQSNEDPFT

SEQ ID NO: 19425 - protein, 450 aa, Artificial Sequence
  Description of Artificial Sequence: Synthetic polypeptide
  XENP020574 7G8_H0.122_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLYNWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19426 - protein, 121 aa, Artificial Sequence
  Description of Artificial Sequence: Synthetic polypeptide
  VH of XENP020574
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLYNWDWYFDVWGAGTTVTVSS

SEQ ID NO: 19427 - protein, 5 aa, Artificial Sequence
  Description of Artificial Sequence: Synthetic peptide
  XENP020574 vhCDR1
DAWMD

SEQ ID NO: 19428 - protein, 19 aa, Artificial Sequence
  Description of Artificial Sequence: Synthetic peptide
  XENP020574 vhCDR2
EIRTKANNHATYYAESVKG

SEQ ID NO: 19429 - protein, 10 aa, Artificial Sequence
  Description of Artificial Sequence: Synthetic peptide
  XENP020574 vhCDR3
LYNWDWYFDV

SEQ ID NO: 19430 - protein, 218 aa, Artificial Sequence; identical to SEQ ID NO: 17590
  Description of Artificial Sequence: Synthetic polypeptide
  XENP020574 7G8_H0.122_L0_IgG1_PVA_/S267K Light Chain

SEQ ID NO: 19431 - protein, 111 aa, Artificial Sequence; identical to SEQ ID NO: 17591
  Description of Artificial Sequence: Synthetic polypeptide
  VL of XENP020574

SEQ ID NO: 19432 - protein, 15 aa, Artificial Sequence
  Description of Artificial Sequence: Synthetic peptide
  XENP020574 vlCDR1
KASQSVDYDGDSYMN

SEQ ID NO: 19433 - protein, 7 aa, Artificial Sequence
  Description of Artificial Sequence: Synthetic peptide
  XENP020574 vlCDR2
AASNLES

SEQ ID NO: 19434 - protein, 9 aa, Artificial Sequence
  Description of Artificial Sequence: Synthetic peptide
  XENP020574 vlCDR3
QQSNEDPFT

SEQ ID NO: 19435 - protein, 450 aa, Artificial Sequence
  Description of Artificial Sequence: Synthetic polypeptide
  XENP020575 7G8_H0.123_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLADWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19436 - protein, 121 aa, Artificial Sequence
  Description of Artificial Sequence: Synthetic polypeptide
  VH of XENP020575
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLADWDWYFDVWGAGTTVTVSS

SEQ ID NO: 19437 - protein, 5 aa, Artificial Sequence
  Description of Artificial Sequence: Synthetic peptide
  XENP020575 vhCDR1
DAWMD

SEQ ID NO: 19438 - protein, 19 aa, Artificial Sequence
  Description of Artificial Sequence: Synthetic peptide
  XENP020575 vhCDR2
EIRTKANNHATYYAESVKG

SEQ ID NO: 19439 - protein, 10 aa, Artificial Sequence
  Description of Artificial Sequence: Synthetic peptide
  XENP020575 vhCDR3
LADWDWYFDV

SEQ ID NO: 19440 - protein, 218 aa, Artificial Sequence; identical to SEQ ID NO: 17590
  Description of Artificial Sequence: Synthetic polypeptide
  XENP020575 7G8_H0.123_L0_IgG1_PVA_/S267K Light Chain

SEQ ID NO: 19441 - protein, 111 aa, Artificial Sequence; identical to SEQ ID NO: 17591
  Description of Artificial Sequence: Synthetic polypeptide
  VL of XENP020575

SEQ ID NO: 19442 - protein, 15 aa, Artificial Sequence
  Description of Artificial Sequence: Synthetic peptide
  XENP020575 vlCDR1
KASQSVDYDGDSYMN

SEQ ID NO: 19443 - protein, 7 aa, Artificial Sequence
  Description of Artificial Sequence: Synthetic peptide
  XENP020575 vlCDR2
AASNLES

SEQ ID NO: 19444 - protein, 9 aa, Artificial Sequence
  Description of Artificial Sequence: Synthetic peptide
  XENP020575 vlCDR3
QQSNEDPFT

SEQ ID NO: 19445 - protein, 450 aa, Artificial Sequence
  Description of Artificial Sequence: Synthetic polypeptide
  XENP020576 7G8_H0.124_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAHWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19446 - protein, 121 aa, Artificial Sequence
  Description of Artificial Sequence: Synthetic polypeptide
  VH of XENP020576
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAHWDWYFDVWGAGTTVTVSS

SEQ ID NO: 19447 - protein, 5 aa, Artificial Sequence
  Description of Artificial Sequence: Synthetic peptide
  XENP020576 vhCDR1
DAWMD

SEQ ID NO: 19448 - protein, 19 aa, Artificial Sequence
  Description of Artificial Sequence: Synthetic peptide
  XENP020576 vhCDR2
EIRTKANNHATYYAESVKG

SEQ ID NO: 19449 - protein, 10 aa, Artificial Sequence
  Description of Artificial Sequence: Synthetic peptide
  XENP020576 vhCDR3
LAHWDWYFDV

SEQ ID NO: 19450 - protein, 218 aa, Artificial Sequence; identical to SEQ ID NO: 17590
  Description of Artificial Sequence: Synthetic polypeptide
  XENP020576 7G8_H0.124_L0_IgG1_PVA_/S267K Light Chain

SEQ ID NO: 19451 - protein, 111 aa, Artificial Sequence; identical to SEQ ID NO: 17591
  Description of Artificial Sequence: Synthetic polypeptide
  VL of XENP020576

SEQ ID NO: 19452 - protein, 15 aa, Artificial Sequence
  Description of Artificial Sequence: Synthetic peptide
  XENP020576 vlCDR1
KASQSVDYDGDSYMN

SEQ ID NO: 19453 - protein, 7 aa, Artificial Sequence
  Description of Artificial Sequence: Synthetic peptide
  XENP020576 vlCDR2
AASNLES

SEQ ID NO: 19454 - protein, 9 aa, Artificial Sequence
  Description of Artificial Sequence: Synthetic peptide
  XENP020576 vlCDR3
QQSNEDPFT

SEQ ID NO: 19455 - protein, 450 aa, Artificial Sequence
  Description of Artificial Sequence: Synthetic polypeptide
  XENP020577 7G8_H0.125_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAEWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19456 - protein, 121 aa, Artificial Sequence
  Description of Artificial Sequence: Synthetic polypeptide
  VH of XENP020577
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAEWDWYFDVWGAGTTVTVSS

SEQ ID NO: 19457 - protein, 5 aa, Artificial Sequence
  Description of Artificial Sequence: Synthetic peptide
  XENP020577 vhCDR1
DAWMD

SEQ ID NO: 19458 - protein, 19 aa, Artificial Sequence
  Description of Artificial Sequence: Synthetic peptide
  XENP020577 vhCDR2
EIRTKANNHATYYAESVKG

SEQ ID NO: 19459 - protein, 10 aa, Artificial Sequence
  Description of Artificial Sequence: Synthetic peptide
  XENP020577 vhCDR3
LAEWDWYFDV

SEQ ID NO: 19460 - protein, 218 aa, Artificial Sequence; identical to SEQ ID NO: 17590
  Description of Artificial Sequence: Synthetic polypeptide
  XENP020577 7G8_H0.125_L0_IgG1_PVA_/S267K Light Chain

SEQ ID NO: 19461 - protein, 111 aa, Artificial Sequence; identical to SEQ ID NO: 17591
  Description of Artificial Sequence: Synthetic polypeptide
  VL of XENP020577

SEQ ID NO: 19462 - protein, 15 aa, Artificial Sequence
  Description of Artificial Sequence: Synthetic peptide
  XENP020577 vlCDR1
KASQSVDYDGDSYMN

SEQ ID NO: 19463 - protein, 7 aa, Artificial Sequence
  Description of Artificial Sequence: Synthetic peptide
  XENP020577 vlCDR2
AASNLES

SEQ ID NO: 19464 - protein, 9 aa, Artificial Sequence
  Description of Artificial Sequence: Synthetic peptide
  XENP020577 vlCDR3
QQSNEDPFT

SEQ ID NO: 19465 - protein, 450 aa, Artificial Sequence
  Description of Artificial Sequence: Synthetic polypeptide
  XENP020578 7G8_H0.126_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLASWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19466 - protein, 121 aa, Artificial Sequence
  Description of Artificial Sequence: Synthetic polypeptide
  VH of XENP020578
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLASWDWYFDVWGAGTTVTVSS

SEQ ID NO: 19467 - protein, 5 aa, Artificial Sequence
  Description of Artificial Sequence: Synthetic peptide
  XENP020578 vhCDR1
DAWMD

SEQ ID NO: 19468 - protein, 19 aa, Artificial Sequence
  Description of Artificial Sequence: Synthetic peptide
  XENP020578 vhCDR2
EIRTKANNHATYYAESVKG

SEQ ID NO: 19469 - protein, 10 aa, Artificial Sequence
  Description of Artificial Sequence: Synthetic peptide
  XENP020578 vhCDR3
LASWDWYFDV

SEQ ID NO: 19470 - protein, 218 aa, Artificial Sequence; identical to SEQ ID NO: 17590
  Description of Artificial Sequence: Synthetic polypeptide
  XENP020578 7G8_H0.126_L0_IgG1_PVA_/S267K Light Chain

SEQ ID NO: 19471 - protein, 111 aa, Artificial Sequence; identical to SEQ ID NO: 17591
  Description of Artificial Sequence: Synthetic polypeptide
  VL of XENP020578

SEQ ID NO: 19472 - protein, 15 aa, Artificial Sequence
  Description of Artificial Sequence: Synthetic peptide
  XENP020578 vlCDR1
KASQSVDYDGDSYMN

SEQ ID NO: 19473 - protein, 7 aa, Artificial Sequence
  Description of Artificial Sequence: Synthetic peptide
  XENP020578 vlCDR2
AASNLES

SEQ ID NO: 19474 - protein, 9 aa, Artificial Sequence
  Description of Artificial Sequence: Synthetic peptide
  XENP020578 vlCDR3
QQSNEDPFT

SEQ ID NO: 19475 - protein, 450 aa, Artificial Sequence
  Description of Artificial Sequence: Synthetic polypeptide
  XENP020579 7G8_H0.127_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLARWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19476 - protein, 121 aa, Artificial Sequence
  Description of Artificial Sequence: Synthetic polypeptide
  VH of XENP020579
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLARWDWYFDVWGAGTTVTVSS

SEQ ID NO: 19477 - protein, 5 aa, Artificial Sequence
  Description of Artificial Sequence: Synthetic peptide
  XENP020579 vhCDR1
DAWMD

SEQ ID NO: 19478 - protein, 19 aa, Artificial Sequence
  Description of Artificial Sequence: Synthetic peptide
  XENP020579 vhCDR2
EIRTKANNHATYYAESVKG

SEQ ID NO: 19479 - protein, 10 aa, Artificial Sequence
  Description of Artificial Sequence: Synthetic peptide
  XENP020579 vhCDR3
LARWDWYFDV

SEQ ID NO: 19480 - protein, 218 aa, Artificial Sequence; identical to SEQ ID NO: 17590
  Description of Artificial Sequence: Synthetic polypeptide
  XENP020579 7G8_H0.127_L0_IgG1_PVA_/S267K Light Chain

SEQ ID NO: 19481 - protein, 111 aa, Artificial Sequence; identical to SEQ ID NO: 17591
  Description of Artificial Sequence: Synthetic polypeptide
  VL of XENP020579

SEQ ID NO: 19482 - protein, 15 aa, Artificial Sequence
  Description of Artificial Sequence: Synthetic peptide
  XENP020579 vlCDR1
KASQSVDYDGDSYMN

SEQ ID NO: 19483 - protein, 7 aa, Artificial Sequence
  Description of Artificial Sequence: Synthetic peptide
  XENP020579 vlCDR2
AASNLES

SEQ ID NO: 19484 - protein, 9 aa, Artificial Sequence
  Description of Artificial Sequence: Synthetic peptide
  XENP020579 vlCDR3
QQSNEDPFT

SEQ ID NO: 19485 - protein, 450 aa, Artificial Sequence
  Description of Artificial Sequence: Synthetic polypeptide
  XENP020580 7G8_H0.128_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLALWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19486 - protein, 121 aa, Artificial Sequence
  Description of Artificial Sequence: Synthetic polypeptide
  VH of XENP020580
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLALWDWYFDVWGAGTTVTVSS

SEQ ID NO: 19487 - protein, 5 aa, Artificial Sequence
  Description of Artificial Sequence: Synthetic peptide
  XENP020580 vhCDR1
DAWMD

SEQ ID NO: 19488 - protein, 19 aa, Artificial Sequence
  Description of Artificial Sequence: Synthetic peptide
  XENP020580 vhCDR2
EIRTKANNHATYYAESVKG

SEQ ID NO: 19489 - protein, 10 aa, Artificial Sequence
  Description of Artificial Sequence: Synthetic peptide
  XENP020580 vhCDR3
LALWDWYFDV

SEQ ID NO: 19490 - protein, 218 aa, Artificial Sequence; identical to SEQ ID NO: 17590
  Description of Artificial Sequence: Synthetic polypeptide
  XENP020580 7G8_H0.128_L0_IgG1_PVA_/S267K Light Chain

SEQ ID NO: 19491 - protein, 111 aa, Artificial Sequence; identical to SEQ ID NO: 17591
  Description of Artificial Sequence: Synthetic polypeptide
  VL of XENP020580

SEQ ID NO: 19492 - protein, 15 aa, Artificial Sequence
  Description of Artificial Sequence: Synthetic peptide
  XENP020580 vlCDR1
KASQSVDYDGDSYMN

SEQ ID NO: 19493 - protein, 7 aa, Artificial Sequence
  Description of Artificial Sequence: Synthetic peptide
  XENP020580 vlCDR2
AASNLES

SEQ ID NO: 19494 - protein, 9 aa, Artificial Sequence
  Description of Artificial Sequence: Synthetic peptide
  XENP020580 vlCDR3
QQSNEDPFT

SEQ ID NO: 19495 - protein, 450 aa, Artificial Sequence
  Description of Artificial Sequence: Synthetic polypeptide
  XENP020581 7G8_H0.129_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLATWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19496 - protein, 121 aa, Artificial Sequence
  Description of Artificial Sequence: Synthetic polypeptide
  VH of XENP020581
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLATWDWYFDVWGAGTTVTVSS

SEQ ID NO: 19497 - protein, 5 aa, Artificial Sequence
  Description of Artificial Sequence: Synthetic peptide
  XENP020581 vhCDR1
DAWMD

SEQ ID NO: 19498 - protein, 19 aa, Artificial Sequence
  Description of Artificial Sequence: Synthetic peptide
  XENP020581 vhCDR2
EIRTKANNHATYYAESVKG

SEQ ID NO: 19499 - protein, 10 aa, Artificial Sequence
  Description of Artificial Sequence: Synthetic peptide
  XENP020581 vhCDR3
LATWDWYFDV

SEQ ID NO: 19500 - protein, 218 aa, Artificial Sequence; identical to SEQ ID NO: 17590
  Description of Artificial Sequence: Synthetic polypeptide
  XENP020581 7G8_H0.129_L0_IgG1_PVA_/S267K Light Chain

SEQ ID NO: 19501 - protein, 111 aa, Artificial Sequence; identical to SEQ ID NO: 17591
  Description of Artificial Sequence: Synthetic polypeptide
  VL of XENP020581

SEQ ID NO: 19502 - protein, 15 aa, Artificial Sequence
  Description of Artificial Sequence: Synthetic peptide
  XENP020581 vlCDR1
KASQSVDYDGDSYMN

SEQ ID NO: 19503 - protein, 7 aa, Artificial Sequence
  Description of Artificial Sequence: Synthetic peptide
  XENP020581 vlCDR2
AASNLES

SEQ ID NO: 19504 - protein, 9 aa, Artificial Sequence
  Description of Artificial Sequence: Synthetic peptide
  XENP020581 vlCDR3
QQSNEDPFT

SEQ ID NO: 19505 - protein, 450 aa, Artificial Sequence
  Description of Artificial Sequence: Synthetic polypeptide
  XENP020582 7G8_H0.130_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAGWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19506 - protein, 121 aa, Artificial Sequence
  Description of Artificial Sequence: Synthetic polypeptide
  VH of XENP020582
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAGWDWYFDVWGAGTTVTVSS

SEQ ID NO: 19507 - protein, 5 aa, Artificial Sequence
  Description of Artificial Sequence: Synthetic peptide
  XENP020582 vhCDR1
DAWMD

SEQ ID NO: 19508 - protein, 19 aa, Artificial Sequence
  Description of Artificial Sequence: Synthetic peptide
  XENP020582 vhCDR2
EIRTKANNHATYYAESVKG

SEQ ID NO: 19509 - protein, 10 aa, Artificial Sequence
  Description of Artificial Sequence: Synthetic peptide
  XENP020582 vhCDR3
LAGWDWYFDV

SEQ ID NO: 19510 - protein, 218 aa, Artificial Sequence; identical to SEQ ID NO: 17590
  Description of Artificial Sequence: Synthetic polypeptide
  XENP020582 7G8_H0.130_L0_IgG1_PVA_/S267K Light Chain

SEQ ID NO: 19511 - protein, 111 aa, Artificial Sequence; identical to SEQ ID NO: 17591
  Description of Artificial Sequence: Synthetic polypeptide
  VL of XENP020582

SEQ ID NO: 19512 - protein, 15 aa, Artificial Sequence
  Description of Artificial Sequence: Synthetic peptide
  XENP020582 vlCDR1
KASQSVDYDGDSYMN

SEQ ID NO: 19513 - protein, 7 aa, Artificial Sequence
  Description of Artificial Sequence: Synthetic peptide
  XENP020582 vlCDR2
AASNLES

SEQ ID NO: 19514 - protein, 9 aa, Artificial Sequence
  Description of Artificial Sequence: Synthetic peptide
  XENP020582 vlCDR3
QQSNEDPFT

SEQ ID NO: 19515 - protein, 450 aa, Artificial Sequence
  Description of Artificial Sequence: Synthetic polypeptide
  XENP020583 7G8_H0.131_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAYWDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19516 - protein, 121 aa, Artificial Sequence
  Description of Artificial Sequence: Synthetic polypeptide
  VH of XENP020583
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLAYWDWYFDVWGAGTTVTVSS

SEQ ID NO: 19517 - protein, 5 aa, Artificial Sequence
  Description of Artificial Sequence: Synthetic peptide
  XENP020583 vhCDR1
DAWMD

SEQ ID NO: 19518 - protein, 19 aa, Artificial Sequence
  Description of Artificial Sequence: Synthetic peptide
  XENP020583 vhCDR2
EIRTKANNHATYYAESVKG

SEQ ID NO: 19519 - protein, 10 aa, Artificial Sequence
  Description of Artificial Sequence: Synthetic peptide
  XENP020583 vhCDR3
LAYWDWYFDV

SEQ ID NO: 19520 - protein, 218 aa, Artificial Sequence; identical to SEQ ID NO: 17590
  Description of Artificial Sequence: Synthetic polypeptide
  XENP020583 7G8_H0.131_L0_IgG1_PVA_/S267K Light Chain

SEQ ID NO: 19521 - protein, 111 aa, Artificial Sequence; identical to SEQ ID NO: 17591
  Description of Artificial Sequence: Synthetic polypeptide
  VL of XENP020583

SEQ ID NO: 19522 - protein, 15 aa, Artificial Sequence
  Description of Artificial Sequence: Synthetic peptide
  XENP020583 vlCDR1
KASQSVDYDGDSYMN

SEQ ID NO: 19523 - protein, 7 aa, Artificial Sequence
  Description of Artificial Sequence: Synthetic peptide
  XENP020583 vlCDR2
AASNLES

SEQ ID NO: 19524 - protein, 9 aa, Artificial Sequence
  Description of Artificial Sequence: Synthetic peptide
  XENP020583 vlCDR3
QQSNEDPFT

SEQ ID NO: 19525 - protein, 450 aa, Artificial Sequence
  Description of Artificial Sequence: Synthetic polypeptide
  XENP020584 7G8_H0.132_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANFDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19526 - protein, 121 aa, Artificial Sequence
  Description of Artificial Sequence: Synthetic polypeptide
  VH of XENP020584
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANFDWYFDVWGAGTTVTVSS

SEQ ID NO: 19527 - protein, 5 aa, Artificial Sequence
  Description of Artificial Sequence: Synthetic peptide
  XENP020584 vhCDR1
DAWMD

SEQ ID NO: 19528 - protein, 19 aa, Artificial Sequence
  Description of Artificial Sequence: Synthetic peptide
  XENP020584 vhCDR2
EIRTKANNHATYYAESVKG

SEQ ID NO: 19529 - protein, 10 aa, Artificial Sequence
  Description of Artificial Sequence: Synthetic peptide
  XENP020584 vhCDR3
LANFDWYFDV

SEQ ID NO: 19530 - protein, 218 aa, Artificial Sequence; identical to SEQ ID NO: 17590
  Description of Artificial Sequence: Synthetic polypeptide
  XENP020584 7G8_H0.132_L0_IgG1_PVA_/S267K Light Chain

SEQ ID NO: 19531 - protein, 111 aa, Artificial Sequence; identical to SEQ ID NO: 17591
  Description of Artificial Sequence: Synthetic polypeptide
  VL of XENP020584

SEQ ID NO: 19532 - protein, 15 aa, Artificial Sequence
  Description of Artificial Sequence: Synthetic peptide
  XENP020584 vlCDR1
KASQSVDYDGDSYMN

SEQ ID NO: 19533 - protein, 7 aa, Artificial Sequence
  Description of Artificial Sequence: Synthetic peptide
  XENP020584 vlCDR2
AASNLES

SEQ ID NO: 19534 - protein, 9 aa, Artificial Sequence
  Description of Artificial Sequence: Synthetic peptide
  XENP020584 vlCDR3
QQSNEDPFT

SEQ ID NO: 19535 - protein, 450 aa, Artificial Sequence
  Description of Artificial Sequence: Synthetic polypeptide
  XENP020585 7G8_H0.133_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANLDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19536 - protein, 121 aa, Artificial Sequence
  Description of Artificial Sequence: Synthetic polypeptide
  VH of XENP020585
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANLDWYFDVWGAGTTVTVSS

SEQ ID NO: 19537 - protein, 5 aa, Artificial Sequence
  Description of Artificial Sequence: Synthetic peptide
  XENP020585 vhCDR1
DAWMD

SEQ ID NO: 19538 - protein, 19 aa, Artificial Sequence
  Description of Artificial Sequence: Synthetic peptide
  XENP020585 vhCDR2
EIRTKANNHATYYAESVKG

SEQ ID NO: 19539 - protein, 10 aa, Artificial Sequence
  Description of Artificial Sequence: Synthetic peptide
  XENP020585 vhCDR3
LANLDWYFDV

SEQ ID NO: 19540 - protein, 218 aa, Artificial Sequence; identical to SEQ ID NO: 17590
  Description of Artificial Sequence: Synthetic polypeptide
  XENP020585 7G8_H0.133_L0_IgG1_PVA_/S267K Light Chain

SEQ ID NO: 19541 - protein, 111 aa, Artificial Sequence; identical to SEQ ID NO: 17591
  Description of Artificial Sequence: Synthetic polypeptide
  VL of XENP020585

SEQ ID NO: 19542 - protein, 15 aa, Artificial Sequence
  Description of Artificial Sequence: Synthetic peptide
  XENP020585 vlCDR1
KASQSVDYDGDSYMN

SEQ ID NO: 19543 - protein, 7 aa, Artificial Sequence
  Description of Artificial Sequence: Synthetic peptide
  XENP020585 vlCDR2
AASNLES

SEQ ID NO: 19544 - protein, 9 aa, Artificial Sequence
  Description of Artificial Sequence: Synthetic peptide
  XENP020585 vlCDR3
QQSNEDPFT

SEQ ID NO: 19545 - protein, 450 aa, Artificial Sequence
  Description of Artificial Sequence: Synthetic polypeptide
  XENP020586 7G8_H0.134_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANYDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19546 - protein, 121 aa, Artificial Sequence
  Description of Artificial Sequence: Synthetic polypeptide
  VH of XENP020586
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANYDWYFDVWGAGTTVTVSS

SEQ ID NO: 19547 - protein, 5 aa, Artificial Sequence
  Description of Artificial Sequence: Synthetic peptide
  XENP020586 vhCDR1
DAWMD

SEQ ID NO: 19548 - protein, 19 aa, Artificial Sequence
  Description of Artificial Sequence: Synthetic peptide
  XENP020586 vhCDR2
EIRTKANNHATYYAESVKG

SEQ ID NO: 19549 - protein, 10 aa, Artificial Sequence
  Description of Artificial Sequence: Synthetic peptide
  XENP020586 vhCDR3
LANYDWYFDV

SEQ ID NO: 19550 - protein, 218 aa, Artificial Sequence; identical to SEQ ID NO: 17590
  Description of Artificial Sequence: Synthetic polypeptide
  XENP020586 7G8_H0.134_L0_IgG1_PVA_/S267K Light Chain

SEQ ID NO: 19551 - protein, 111 aa, Artificial Sequence; identical to SEQ ID NO: 17591
  Description of Artificial Sequence: Synthetic polypeptide
  VL of XENP020586

SEQ ID NO: 19552 - protein, 15 aa, Artificial Sequence
  Description of Artificial Sequence: Synthetic peptide
  XENP020586 vlCDR1
KASQSVDYDGDSYMN

SEQ ID NO: 19553 - protein, 7 aa, Artificial Sequence
  Description of Artificial Sequence: Synthetic peptide
  XENP020586 vlCDR2
AASNLES

SEQ ID NO: 19554 - protein, 9 aa, Artificial Sequence
  Description of Artificial Sequence: Synthetic peptide
  XENP020586 vlCDR3
QQSNEDPFT

SEQ ID NO: 19555 - protein, 450 aa, Artificial Sequence
  Description of Artificial Sequence: Synthetic polypeptide
  XENP020587 7G8_H0.135_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANIDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19556 - protein, 121 aa, Artificial Sequence
  Description of Artificial Sequence: Synthetic polypeptide
  VH of XENP020587
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANIDWYFDVWGAGTTVTVSS

SEQ ID NO: 19557 - protein, 5 aa, Artificial Sequence
  Description of Artificial Sequence: Synthetic peptide
  XENP020587 vhCDR1
DAWMD

SEQ ID NO: 19558 - protein, 19 aa, Artificial Sequence
  Description of Artificial Sequence: Synthetic peptide
  XENP020587 vhCDR2
EIRTKANNHATYYAESVKG

SEQ ID NO: 19559 - protein, 10 aa, Artificial Sequence
  Description of Artificial Sequence: Synthetic peptide
  XENP020587 vhCDR3
LANIDWYFDV

SEQ ID NO: 19560 - protein, 218 aa, Artificial Sequence; identical to SEQ ID NO: 17590
  Description of Artificial Sequence: Synthetic polypeptide
  XENP020587 7G8_H0.135_L0_IgG1_PVA_/S267K Light Chain

SEQ ID NO: 19561 - protein, 111 aa, Artificial Sequence; identical to SEQ ID NO: 17591
  Description of Artificial Sequence: Synthetic polypeptide
  VL of XENP020587

SEQ ID NO: 19562 - protein, 15 aa, Artificial Sequence
  Description of Artificial Sequence: Synthetic peptide
  XENP020587 vlCDR1
KASQSVDYDGDSYMN

SEQ ID NO: 19563 - protein, 7 aa, Artificial Sequence
  Description of Artificial Sequence: Synthetic peptide
  XENP020587 vlCDR2
AASNLES

SEQ ID NO: 19564 - protein, 9 aa, Artificial Sequence
  Description of Artificial Sequence: Synthetic peptide
  XENP020587 vlCDR3
QQSNEDPFT

SEQ ID NO: 19565 - protein, 450 aa, Artificial Sequence
  Description of Artificial Sequence: Synthetic polypeptide
  XENP020588 7G8_H0.136_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANHDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19566 - protein, 121 aa, Artificial Sequence
  Description of Artificial Sequence: Synthetic polypeptide
  VH of XENP020588
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANHDWYFDVWGAGTTVTVSS

SEQ ID NO: 19567 - protein, 5 aa, Artificial Sequence
  Description of Artificial Sequence: Synthetic peptide
  XENP020588 vhCDR1
DAWMD

SEQ ID NO: 19568 - protein, 19 aa, Artificial Sequence
  Description of Artificial Sequence: Synthetic peptide
  XENP020588 vhCDR2
EIRTKANNHATYYAESVKG

SEQ ID NO: 19569 - protein, 10 aa, Artificial Sequence
  Description of Artificial Sequence: Synthetic peptide
  XENP020588 vhCDR3
LANHDWYFDV

SEQ ID NO: 19570 - protein, 218 aa, Artificial Sequence; identical to SEQ ID NO: 17590
  Description of Artificial Sequence: Synthetic polypeptide
  XENP020588 7G8_H0.136_L0_IgG1_PVA_/S267K Light Chain

SEQ ID NO: 19571 - protein, 111 aa, Artificial Sequence; identical to SEQ ID NO: 17591
  Description of Artificial Sequence: Synthetic polypeptide
  VL of XENP020588

SEQ ID NO: 19572 - protein, 15 aa, Artificial Sequence
  Description of Artificial Sequence: Synthetic peptide
  XENP020588 vlCDR1
KASQSVDYDGDSYMN

SEQ ID NO: 19573 - protein, 7 aa, Artificial Sequence
  Description of Artificial Sequence: Synthetic peptide
  XENP020588 vlCDR2
AASNLES

SEQ ID NO: 19574 - protein, 9 aa, Artificial Sequence
  Description of Artificial Sequence: Synthetic peptide
  XENP020588 vlCDR3
QQSNEDPFT

SEQ ID NO: 19575 - protein, 450 aa, Artificial Sequence
  Description of Artificial Sequence: Synthetic polypeptide
  XENP020589 7G8_H0.137_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANQDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19576 - protein, 121 aa, Artificial Sequence
  Description of Artificial Sequence: Synthetic polypeptide
  VH of XENP020589
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANQDWYFDVWGAGTTVTVSS

SEQ ID NO: 19577 - protein, 5 aa, Artificial Sequence
  Description of Artificial Sequence: Synthetic peptide
  XENP020589 vhCDR1
DAWMD

SEQ ID NO: 19578 - protein, 19 aa, Artificial Sequence
  Description of Artificial Sequence: Synthetic peptide
  XENP020589 vhCDR2
EIRTKANNHATYYAESVKG

SEQ ID NO: 19579 - protein, 10 aa, Artificial Sequence
  Description of Artificial Sequence: Synthetic peptide
  XENP020589 vhCDR3
LANQDWYFDV

SEQ ID NO: 19580 - protein, 218 aa, Artificial Sequence; identical to SEQ ID NO: 17590
  Description of Artificial Sequence: Synthetic polypeptide
  XENP020589 7G8_H0.137_L0_IgG1_PVA_/S267K Light Chain

SEQ ID NO: 19581 - protein, 111 aa, Artificial Sequence; identical to SEQ ID NO: 17591
  Description of Artificial Sequence: Synthetic polypeptide
  VL of XENP020589

SEQ ID NO: 19582 - protein, 15 aa, Artificial Sequence
  Description of Artificial Sequence: Synthetic peptide
  XENP020589 vlCDR1
KASQSVDYDGDSYMN

SEQ ID NO: 19583 - protein, 7 aa, Artificial Sequence
  Description of Artificial Sequence: Synthetic peptide
  XENP020589 vlCDR2
AASNLES

SEQ ID NO: 19584 - protein, 9 aa, Artificial Sequence
  Description of Artificial Sequence: Synthetic peptide
  XENP020589 vlCDR3
QQSNEDPFT

SEQ ID NO: 19585 - protein, 450 aa, Artificial Sequence
  Description of Artificial Sequence: Synthetic polypeptide
  XENP020590 7G8_H0.138_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANSDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19586 - protein, 121 aa, Artificial Sequence
  Description of Artificial Sequence: Synthetic polypeptide
  VH of XENP020590
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANSDWYFDVWGAGTTVTVSS

SEQ ID NO: 19587 - protein, 5 aa, Artificial Sequence
  Description of Artificial Sequence: Synthetic peptide
  XENP020590 vhCDR1
DAWMD

SEQ ID NO: 19588 - protein, 19 aa, Artificial Sequence
  Description of Artificial Sequence: Synthetic peptide
  XENP020590 vhCDR2
EIRTKANNHATYYAESVKG

SEQ ID NO: 19589 - protein, 10 aa, Artificial Sequence
  Description of Artificial Sequence: Synthetic peptide
  XENP020590 vhCDR3
LANSDWYFDV

SEQ ID NO: 19590 - protein, 218 aa, Artificial Sequence; identical to SEQ ID NO: 17590
  Description of Artificial Sequence: Synthetic polypeptide
  XENP020590 7G8_H0.138_L0_IgG1_PVA_/S267K Light Chain

SEQ ID NO: 19591 - protein, 111 aa, Artificial Sequence; identical to SEQ ID NO: 17591
  Description of Artificial Sequence: Synthetic polypeptide
  VL of XENP020590

SEQ ID NO: 19592 - protein, 15 aa, Artificial Sequence
  Description of Artificial Sequence: Synthetic peptide
  XENP020590 vlCDR1
KASQSVDYDGDSYMN

SEQ ID NO: 19593 - protein, 7 aa, Artificial Sequence
  Description of Artificial Sequence: Synthetic peptide
  XENP020590 vlCDR2
AASNLES

SEQ ID NO: 19594 - protein, 9 aa, Artificial Sequence
  Description of Artificial Sequence: Synthetic peptide
  XENP020590 vlCDR3
QQSNEDPFT

SEQ ID NO: 19595 - protein, 450 aa, Artificial Sequence
  Description of Artificial Sequence: Synthetic polypeptide
  XENP020591 7G8_H0.139_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANDDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19596 - protein, 121 aa, Artificial Sequence
  Description of Artificial Sequence: Synthetic polypeptide
  VH of XENP020591
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANDDWYFDVWGAGTTVTVSS

SEQ ID NO: 19597 - protein, 5 aa, Artificial Sequence
  Description of Artificial Sequence: Synthetic peptide
  XENP020591 vhCDR1
DAWMD

SEQ ID NO: 19598 - protein, 19 aa, Artificial Sequence
  Description of Artificial Sequence: Synthetic peptide
  XENP020591 vhCDR2
EIRTKANNHATYYAESVKG

SEQ ID NO: 19599 - protein, 10 aa, Artificial Sequence
  Description of Artificial Sequence: Synthetic peptide
  XENP020591 vhCDR3
LANDDWYFDV

SEQ ID NO: 19600 - protein, 218 aa, Artificial Sequence; identical to SEQ ID NO: 17590
  Description of Artificial Sequence: Synthetic polypeptide
  XENP020591 7G8_H0.139_L0_IgG1_PVA_/S267K Light Chain

SEQ ID NO: 19601 - protein, 111 aa, Artificial Sequence; identical to SEQ ID NO: 17591
  Description of Artificial Sequence: Synthetic polypeptide
  VL of XENP020591

SEQ ID NO: 19602 - protein, 15 aa, Artificial Sequence
  Description of Artificial Sequence: Synthetic peptide
  XENP020591 vlCDR1
KASQSVDYDGDSYMN

SEQ ID NO: 19603 - protein, 7 aa, Artificial Sequence
  Description of Artificial Sequence: Synthetic peptide
  XENP020591 vlCDR2
AASNLES

SEQ ID NO: 19604 - protein, 9 aa, Artificial Sequence
  Description of Artificial Sequence: Synthetic peptide
  XENP020591 vlCDR3
QQSNEDPFT

SEQ ID NO: 19605 - protein, 450 aa, Artificial Sequence
  Description of Artificial Sequence: Synthetic polypeptide
  XENP020592 7G8_H0.140_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANRDWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19606 - protein, 121 aa, Artificial Sequence
  Description of Artificial Sequence: Synthetic polypeptide
  VH of XENP020592
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANRDWYFDVWGAGTTVTVSS

SEQ ID NO: 19607 - protein, 5 aa, Artificial Sequence
  Description of Artificial Sequence: Synthetic peptide
  XENP020592 vhCDR1
DAWMD

SEQ ID NO: 19608 - protein, 19 aa, Artificial Sequence
  Description of Artificial Sequence: Synthetic peptide
  XENP020592 vhCDR2
EIRTKANNHATYYAESVKG

SEQ ID NO: 19609 - protein, 10 aa, Artificial Sequence
  Description of Artificial Sequence: Synthetic peptide
  XENP020592 vhCDR3
LANRDWYFDV

SEQ ID NO: 19610 - protein, 218 aa, Artificial Sequence; identical to SEQ ID NO: 17590
  Description of Artificial Sequence: Synthetic polypeptide
  XENP020592 7G8_H0.140_L0_IgG1_PVA_/S267K Light Chain

SEQ ID NO: 19611 - protein, 111 aa, Artificial Sequence; identical to SEQ ID NO: 17591
  Description of Artificial Sequence: Synthetic polypeptide
  VL of XENP020592

SEQ ID NO: 19612 - protein, 15 aa, Artificial Sequence
  Description of Artificial Sequence: Synthetic peptide
  XENP020592 vlCDR1
KASQSVDYDGDSYMN

SEQ ID NO: 19613 - protein, 7 aa, Artificial Sequence
  Description of Artificial Sequence: Synthetic peptide
  XENP020592 vlCDR2
AASNLES

SEQ ID NO: 19614 - protein, 9 aa, Artificial Sequence
  Description of Artificial Sequence: Synthetic peptide
  XENP020592 vlCDR3
QQSNEDPFT

SEQ ID NO: 19615 - protein, 450 aa, Artificial Sequence
  Description of Artificial Sequence: Synthetic polypeptide
  XENP020593 7G8_H0.141_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19616 - protein, 121 aa, Artificial Sequence
  Description of Artificial Sequence: Synthetic polypeptide
  VH of XENP020593
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWNWYFDVWGAGTTVTVSS

SEQ ID NO: 19617 - protein, 5 aa, Artificial Sequence
  Description of Artificial Sequence: Synthetic peptide
  XENP020593 vhCDR1
DAWMD

SEQ ID NO: 19618 - protein, 19 aa, Artificial Sequence
  Description of Artificial Sequence: Synthetic peptide
  XENP020593 vhCDR2
EIRTKANNHATYYAESVKG

SEQ ID NO: 19619 - protein, 10 aa, Artificial Sequence
  Description of Artificial Sequence: Synthetic peptide
  XENP020593 vhCDR3
LANWNWYFDV

SEQ ID NO: 19620 - protein, 218 aa, Artificial Sequence; identical to SEQ ID NO: 17590
  Description of Artificial Sequence: Synthetic polypeptide
  XENP020593 7G8_H0.141_L0_IgG1_PVA_/S267K Light Chain

SEQ ID NO: 19621 - protein, 111 aa, Artificial Sequence; identical to SEQ ID NO: 17591
  Description of Artificial Sequence: Synthetic polypeptide
  VL of XENP020593

SEQ ID NO: 19622 - protein, 15 aa, Artificial Sequence
  Description of Artificial Sequence: Synthetic peptide
  XENP020593 vlCDR1
KASQSVDYDGDSYMN

SEQ ID NO: 19623 - protein, 7 aa, Artificial Sequence
  Description of Artificial Sequence: Synthetic peptide
  XENP020593 vlCDR2
AASNLES

SEQ ID NO: 19624 - protein, 9 aa, Artificial Sequence
  Description of Artificial Sequence: Synthetic peptide
  XENP020593 vlCDR3
QQSNEDPFT

SEQ ID NO: 19625 - protein, 450 aa, Artificial Sequence
  Description of Artificial Sequence: Synthetic polypeptide
  XENP020594 7G8_H0.142_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWEWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19626 - protein, 121 aa, Artificial Sequence
  Description of Artificial Sequence: Synthetic polypeptide
  VH of XENP020594
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWEWYFDVWGAGTTVTVSS

SEQ ID NO: 19627 - protein, 5 aa, Artificial Sequence
  Description of Artificial Sequence: Synthetic peptide
  XENP020594 vhCDR1
DAWMD

SEQ ID NO: 19628 - protein, 19 aa, Artificial Sequence
  Description of Artificial Sequence: Synthetic peptide
  XENP020594 vhCDR2
EIRTKANNHATYYAESVKG

SEQ ID NO: 19629 - protein, 10 aa, Artificial Sequence
  Description of Artificial Sequence: Synthetic peptide
  XENP020594 vhCDR3
LANWEWYFDV

SEQ ID NO: 19630 - protein, 218 aa, Artificial Sequence; identical to SEQ ID NO: 17590
  Description of Artificial Sequence: Synthetic polypeptide
  XENP020594 7G8_H0.142_L0_IgG1_PVA_/S267K Light Chain

SEQ ID NO: 19631 - protein, 111 aa, Artificial Sequence; identical to SEQ ID NO: 17591
  Description of Artificial Sequence: Synthetic polypeptide
  VL of XENP020594

SEQ ID NO: 19632 - protein, 15 aa, Artificial Sequence
  Description of Artificial Sequence: Synthetic peptide
  XENP020594 vlCDR1
KASQSVDYDGDSYMN

SEQ ID NO: 19633 - protein, 7 aa, Artificial Sequence
  Description of Artificial Sequence: Synthetic peptide
  XENP020594 vlCDR2
AASNLES

SEQ ID NO: 19634 - protein, 9 aa, Artificial Sequence
  Description of Artificial Sequence: Synthetic peptide
  XENP020594 vlCDR3
QQSNEDPFT

SEQ ID NO: 19635 - protein, 450 aa, Artificial Sequence
  Description of Artificial Sequence: Synthetic polypeptide
  XENP020595 7G8_H0.143_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19636 - protein, 121 aa, Artificial Sequence
  Description of Artificial Sequence: Synthetic polypeptide
  VH of XENP020595
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWHWYFDVWGAGTTVTVSS

SEQ ID NO: 19637 - protein, 5 aa, Artificial Sequence
  Description of Artificial Sequence: Synthetic peptide
  XENP020595 vhCDR1
DAWMD

SEQ ID NO: 19638 - protein, 19 aa, Artificial Sequence
  Description of Artificial Sequence: Synthetic peptide
  XENP020595 vhCDR2
EIRTKANNHATYYAESVKG

SEQ ID NO: 19639 - protein, 10 aa, Artificial Sequence
  Description of Artificial Sequence: Synthetic peptide
  XENP020595 vhCDR3
LANWHWYFDV

SEQ ID NO: 19640 - protein, 218 aa, Artificial Sequence; identical to SEQ ID NO: 17590
  Description of Artificial Sequence: Synthetic polypeptide
  XENP020595 7G8_H0.143_L0_IgG1_PVA_/S267K Light Chain

SEQ ID NO: 19641 - protein, 111 aa, Artificial Sequence; identical to SEQ ID NO: 17591
  Description of Artificial Sequence: Synthetic polypeptide
  VL of XENP020595

SEQ ID NO: 19642 - protein, 15 aa, Artificial Sequence
  Description of Artificial Sequence: Synthetic peptide
  XENP020595 vlCDR1
KASQSVDYDGDSYMN

SEQ ID NO: 19643 - protein, 7 aa, Artificial Sequence
  Description of Artificial Sequence: Synthetic peptide
  XENP020595 vlCDR2
AASNLES

SEQ ID NO: 19644 - protein, 9 aa, Artificial Sequence
  Description of Artificial Sequence: Synthetic peptide
  XENP020595 vlCDR3
QQSNEDPFT

SEQ ID NO: 19645 - protein, 450 aa, Artificial Sequence
  Description of Artificial Sequence: Synthetic polypeptide
  XENP020596 7G8_H0.144_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWRWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19646 - protein, 121 aa, Artificial Sequence
  Description of Artificial Sequence: Synthetic polypeptide
  VH of XENP020596
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWRWYFDVWGAGTTVTVSS

SEQ ID NO: 19647 - protein, 5 aa, Artificial Sequence
  Description of Artificial Sequence: Synthetic peptide
  XENP020596 vhCDR1
DAWMD

SEQ ID NO: 19648 - protein, 19 aa, Artificial Sequence
  Description of Artificial Sequence: Synthetic peptide
  XENP020596 vhCDR2
EIRTKANNHATYYAESVKG

SEQ ID NO: 19649 - protein, 10 aa, Artificial Sequence
  Description of Artificial Sequence: Synthetic peptide
  XENP020596 vhCDR3
LANWRWYFDV

SEQ ID NO: 19650 - protein, 218 aa, Artificial Sequence; identical to SEQ ID NO: 17590
  Description of Artificial Sequence: Synthetic polypeptide
  XENP020596 7G8_H0.144_L0_IgG1_PVA_/S267K Light Chain

SEQ ID NO: 19651 - protein, 111 aa, Artificial Sequence; identical to SEQ ID NO: 17591
  Description of Artificial Sequence: Synthetic polypeptide
  VL of XENP020596

SEQ ID NO: 19652 - protein, 15 aa, Artificial Sequence
  Description of Artificial Sequence: Synthetic peptide
  XENP020596 vlCDR1
KASQSVDYDGDSYMN

SEQ ID NO: 19653 - protein, 7 aa, Artificial Sequence
  Description of Artificial Sequence: Synthetic peptide
  XENP020596 vlCDR2
AASNLES

SEQ ID NO: 19654 - protein, 9 aa, Artificial Sequence
  Description of Artificial Sequence: Synthetic peptide
  XENP020596 vlCDR3
QQSNEDPFT

SEQ ID NO: 19655 - protein, 450 aa, Artificial Sequence
  Description of Artificial Sequence: Synthetic polypeptide
  XENP020601 7G8_H0.145_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWLWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19656 - protein, 121 aa, Artificial Sequence
  Description of Artificial Sequence: Synthetic polypeptide
  VH of XENP020601
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWLWYFDVWGAGTTVTVSS

SEQ ID NO: 19657 - protein, 5 aa, Artificial Sequence
  Description of Artificial Sequence: Synthetic peptide
  XENP020601 vhCDR1
DAWMD

SEQ ID NO: 19658 - protein, 19 aa, Artificial Sequence
  Description of Artificial Sequence: Synthetic peptide
  XENP020601 vhCDR2
EIRTKANNHATYYAESVKG

SEQ ID NO: 19659 - protein, 10 aa, Artificial Sequence
  Description of Artificial Sequence: Synthetic peptide
  XENP020601 vhCDR3
LANWLWYFDV

SEQ ID NO: 19660 - protein, 218 aa, Artificial Sequence; identical to SEQ ID NO: 17590
  Description of Artificial Sequence: Synthetic polypeptide
  XENP020601 7G8_H0.145_L0_IgG1_PVA_/S267K Light Chain

SEQ ID NO: 19661 - protein, 111 aa, Artificial Sequence; identical to SEQ ID NO: 17591
  Description of Artificial Sequence: Synthetic polypeptide
  VL of XENP020601

SEQ ID NO: 19662 - protein, 15 aa, Artificial Sequence
  Description of Artificial Sequence: Synthetic peptide
  XENP020601 vlCDR1
KASQSVDYDGDSYMN

SEQ ID NO: 19663 - protein, 7 aa, Artificial Sequence
  Description of Artificial Sequence: Synthetic peptide
  XENP020601 vlCDR2
AASNLES

SEQ ID NO: 19664 - protein, 9 aa, Artificial Sequence
  Description of Artificial Sequence: Synthetic peptide
  XENP020601 vlCDR3
QQSNEDPFT

SEQ ID NO: 19665 - protein, 450 aa, Artificial Sequence
  Description of Artificial Sequence: Synthetic polypeptide
  XENP020602 7G8_H0.146_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWGWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19666 - protein, 121 aa, Artificial Sequence
  Description of Artificial Sequence: Synthetic polypeptide
  VH of XENP020602
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWGWYFDVWGAGTTVTVSS

SEQ ID NO: 19667 - protein, 5 aa, Artificial Sequence
  Description of Artificial Sequence: Synthetic peptide
  XENP020602 vhCDR1
DAWMD

SEQ ID NO: 19668 - protein, 19 aa, Artificial Sequence
  Description of Artificial Sequence: Synthetic peptide
  XENP020602 vhCDR2
EIRTKANNHATYYAESVKG

SEQ ID NO: 19669 - protein, 10 aa, Artificial Sequence
  Description of Artificial Sequence: Synthetic peptide
  XENP020602 vhCDR3
LANWGWYFDV

SEQ ID NO: 19670 - protein, 218 aa, Artificial Sequence; identical to SEQ ID NO: 17590
  Description of Artificial Sequence: Synthetic polypeptide
  XENP020602 7G8_H0.146_L0_IgG1_PVA_/S267K Light Chain

SEQ ID NO: 19671 - protein, 111 aa, Artificial Sequence; identical to SEQ ID NO: 17591
  Description of Artificial Sequence: Synthetic polypeptide
  VL of XENP020602

SEQ ID NO: 19672 - protein, 15 aa, Artificial Sequence
  Description of Artificial Sequence: Synthetic peptide
  XENP020602 vlCDR1
KASQSVDYDGDSYMN

SEQ ID NO: 19673 - protein, 7 aa, Artificial Sequence
  Description of Artificial Sequence: Synthetic peptide
  XENP020602 vlCDR2
AASNLES

SEQ ID NO: 19674 - protein, 9 aa, Artificial Sequence
  Description of Artificial Sequence: Synthetic peptide
  XENP020602 vlCDR3
QQSNEDPFT

SEQ ID NO: 19675 - protein, 450 aa, Artificial Sequence
  Description of Artificial Sequence: Synthetic polypeptide
  XENP020603 7G8_H0.147_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWYWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19676 - protein, 121 aa, Artificial Sequence
  Description of Artificial Sequence: Synthetic polypeptide
  VH of XENP020603
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWYWYFDVWGAGTTVTVSS

SEQ ID NO: 19677 - protein, 5 aa, Artificial Sequence
  Description of Artificial Sequence: Synthetic peptide
  XENP020603 vhCDR1
DAWMD

SEQ ID NO: 19678 - protein, 19 aa, Artificial Sequence
  Description of Artificial Sequence: Synthetic peptide
  XENP020603 vhCDR2
EIRTKANNHATYYAESVKG

SEQ ID NO: 19679 - protein, 10 aa, Artificial Sequence
  Description of Artificial Sequence: Synthetic peptide
  XENP020603 vhCDR3
LANWYWYFDV

SEQ ID NO: 19680 - protein, 218 aa, Artificial Sequence; identical to SEQ ID NO: 17590
  Description of Artificial Sequence: Synthetic polypeptide
  XENP020603 7G8_H0.147_L0_IgG1_PVA_/S267K Light Chain

SEQ ID NO: 19681 - protein, 111 aa, Artificial Sequence; identical to SEQ ID NO: 17591
  Description of Artificial Sequence: Synthetic polypeptide
  VL of XENP020603

SEQ ID NO: 19682 - protein, 15 aa, Artificial Sequence
  Description of Artificial Sequence: Synthetic peptide
  XENP020603 vlCDR1
KASQSVDYDGDSYMN

SEQ ID NO: 19683 - protein, 7 aa, Artificial Sequence
  Description of Artificial Sequence: Synthetic peptide
  XENP020603 vlCDR2
AASNLES

SEQ ID NO: 19684 - protein, 9 aa, Artificial Sequence
  Description of Artificial Sequence: Synthetic peptide
  XENP020603 vlCDR3
QQSNEDPFT

SEQ ID NO: 19685 - protein, 450 aa, Artificial Sequence
  Description of Artificial Sequence: Synthetic polypeptide
  XENP020604 7G8_H0.148_L0_IgG1_PVA_/S267K Heavy Chain
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 19686 - protein, 121 aa, Artificial Sequence
  Description of Artificial Sequence: Synthetic polypeptide
  VH of XENP020604
EVKLEESGGGLVQPGGSMKLSCAASGFTFSDAWMDWVRQSPEKGLEWVAEIRTKANNHATYYAESVKGRFTISRDDSKSSVYLQMNSLRAEDTGIYYCTRLANWDYYFDVWGAGTTVTVSS

SEQ ID NO: 19687 - protein, 5 aa, Artificial Sequence
  Description of Artificial Sequence: Synthetic peptide
  XENP020604 vhCDR1
DAWMD

SEQ ID NO: 19688 - protein, 19 aa, Artificial Sequence
  Description of Artificial Sequence: Synthetic peptide
  XENP020604 vhCDR2
EIRTKANNHATYYAESVKG

SEQ ID NO: 19689 - protein, 10 aa, Artificial Sequence
  Description of Artificial Sequence: Synthetic peptide
  XENP020604 vhCDR3
LANWDYYFDV

SEQ ID NO: 19690 - protein, 218 aa, Artificial Sequence; identical to SEQ ID NO: 17590
  Description of Artificial Sequence: Synthetic polypeptide
  XENP020604 7G8_H0.148_L0_IgG1_PVA_/S267K Light Chain

SEQ ID NO: 19691 - protein, 111 aa, Artificial Sequence; identical to SEQ ID NO: 17591
  Description of Artificial Sequence: Synthetic polypeptide
  VL of XENP020604

SEQ ID NO: 19692 - protein, 15 aa, Artificial Sequence
  Description of Artificial Sequence: Synthetic peptide
  XENP020604 vlCDR1
KASQSVDYDGDSYMN

SEQ ID NO: 19693 - protein, 7 aa, Artificial Sequence
  Description of Artificial Sequence: Synthetic peptide
  XENP020604 vlCDR2
AASNLES

SEQ ID NO: 19694 - protein, 9 aa, Artificial Sequence
  Description of Artificial Sequence: Synthetic peptide
  XENP020604 vlCDR3
QQSNEDPFT

SEQ ID NO: 19695 - protein, 450 aa, Artificial Sequence; identical to SEQ ID NO: 17585
  Description of Artificial Sequence: Synthetic polypeptide
  XENP020605 7G8_H0_L0.1_IgG1_PVA_/S267K Heavy Chain

SEQ ID NO: 19696 - protein, 121 aa, Artificial Sequence; identical to SEQ ID NO: 17586
  Description of Artificial Sequence: Synthetic polypeptide
  VH of XENP020605

SEQ ID NO: 19697 - protein, 5 aa, Artificial Sequence
  Description of Artificial Sequence: Synthetic peptide
  XENP020605 vhCDR1
DAWMD

SEQ ID NO: 19698 - protein, 19 aa, Artificial Sequence
  Description of Artificial Sequence: Synthetic peptide
  XENP020605 vhCDR2
EIRTKANNHATYYAESVKG

SEQ ID NO: 19699 - protein, 10 aa, Artificial Sequence
  Description of Artificial Sequence: Synthetic peptide
  XENP020605 vhCDR3
LANWDWYFDV

SEQ ID NO: 19700 - protein, 218 aa, Artificial Sequence
  Description of Artificial Sequence: Synthetic polypeptide
  XENP020605 7G8_H0_L0.1_IgG1_PVA_/S267K Light Chain
DTVLTQSPASLAVSLGQRATISCKASQSVNYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19701 - protein, 111 aa, Artificial Sequence
  Description of Artificial Sequence: Synthetic polypeptide
  VL of XENP020605
DTVLTQSPASLAVSLGQRATISCKASQSVNYDGDSYMNWYQQKPGQPPKLLIYAASNLESGIPARLSGSGSGTDFTLNIHPVEEEDAATYYCQQSNEDPFTFGSGTKLEVK

SEQ ID NO: 19702 - protein, 15 aa, Artificial Sequence
  Description of Artificial Sequence: Synthetic peptide
  XENP020605 vlCDR1
KASQSVNYDGDSYMN

SEQ ID NO: 19703 - protein, 7 aa, Artificial Sequence
  Description of Artificial Sequence: Synthetic peptide
  XENP020605 vlCDR2
AASNLES

SEQ ID NO: 19704 - protein, 9 aa, Artificial Sequence
  Description of Artificial Sequence: Synthetic peptide
  XENP020605 vlCDR3
QQSNEDPFT

SEQ ID NO: 19705 - protein, 450 aa, Artificial Sequence; identical to SEQ ID NO: 17585
  Description of Artificial Sequence: Synthetic polypeptide
  XENP020606 7G8_H0_L0.2_IgG1_PVA_/S267K Heavy Chain

SEQ ID NO: 19706 - protein, 121 aa, Artificial Sequence; identical to SEQ ID NO: 17586
  Description of Artificial Sequence: Synthetic polypeptide
  VH of XENP020606

SEQ ID NO: 19707 - protein, 5 aa, Artificial Sequence
  Description of Artificial Sequence: Synthetic peptide
  XENP020606 vhCDR1
DAWMD

SEQ ID NO: 19708 - protein, 19 aa, Artificial Sequence
  Description of Artificial Sequence: Synthetic peptide
  XENP020606 vhCDR2
EIRTKANNHATYYAESVKG

SEQ ID NO: 19709 - protein, 10 aa, Artificial Sequence
  Description of Artificial Sequence: Synthetic peptide
  XENP020606 vhCDR3
LANWDWYFDV

SEQ ID NO: 19710 - protein, 218 aa, Artificial Sequence
  Description of Artificial Sequence: Synthetic polypeptide
  XENP020606 7G8_H0_L0.2_IgG1_PVA_/S267K Light Chain
DTVLTQSPASLAVSLGQRATISCKASQSVEYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19711 - protein, 111 aa, Artificial Sequence
  Description of Artificial Sequence: Synthetic polypeptide
  VL of XENP020606
DTVLTQSPASLAVSLGQRATISCKASQSVEYDGDSYMNWYQQKPGQPPKLLIYAASNLESGIPARLSGSGSGTDFTLNIHPVEEEDAATYYCQQSNEDPFTFGSGTKLEVK

SEQ ID NO: 19712 - protein, 15 aa, Artificial Sequence
  Description of Artificial Sequence: Synthetic peptide
  XENP020606 vlCDR1
KASQSVEYDGDSYMN

SEQ ID NO: 19713 - protein, 7 aa, Artificial Sequence
  Description of Artificial Sequence: Synthetic peptide
  XENP020606 vlCDR2
AASNLES

SEQ ID NO: 19714 - protein, 9 aa, Artificial Sequence
  Description of Artificial Sequence: Synthetic peptide
  XENP020606 vlCDR3
QQSNEDPFT

SEQ ID NO: 19715 - protein, 450 aa, Artificial Sequence; identical to SEQ ID NO: 17585
  Description of Artificial Sequence: Synthetic polypeptide
  XENP020607 7G8_H0_L0.3_IgG1_PVA_/S267K Heavy Chain

SEQ ID NO: 19716 - protein, 121 aa, Artificial Sequence; identical to SEQ ID NO: 17586
  Description of Artificial Sequence: Synthetic polypeptide
  VH of XENP020607

SEQ ID NO: 19717 - protein, 5 aa, Artificial Sequence
  Description of Artificial Sequence: Synthetic peptide
  XENP020607 vhCDR1
DAWMD

SEQ ID NO: 19718 - protein, 19 aa, Artificial Sequence
  Description of Artificial Sequence: Synthetic peptide
  XENP020607 vhCDR2
EIRTKANNHATYYAESVKG

SEQ ID NO: 19719 - protein, 10 aa, Artificial Sequence
  Description of Artificial Sequence: Synthetic peptide
  XENP020607 vhCDR3
LANWDWYFDV

SEQ ID NO: 19720 - protein, 218 aa, Artificial Sequence
  Description of Artificial Sequence: Synthetic polypeptide
  XENP020607 7G8_H0_L0.3_IgG1_PVA_/S267K Light Chain
DTVLTQSPASLAVSLGQRATISCKASQSVHYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19721 - protein, 111 aa, Artificial Sequence
  Description of Artificial Sequence: Synthetic polypeptide
  VL of XENP020607
DTVLTQSPASLAVSLGQRATISCKASQSVHYDGDSYMNWYQQKPGQPPKLLIYAASNLESGIPARLSGSGSGTDFTLNIHPVEEEDAATYYCQQSNEDPFTFGSGTKLEVK

SEQ ID NO: 19722 - protein, 15 aa, Artificial Sequence
  Description of Artificial Sequence: Synthetic peptide
  XENP020607 vlCDR1
KASQSVHYDGDSYMN

SEQ ID NO: 19723 - protein, 7 aa, Artificial Sequence
  Description of Artificial Sequence: Synthetic peptide
  XENP020607 vlCDR2
AASNLES

SEQ ID NO: 19724 - protein, 9 aa, Artificial Sequence
  Description of Artificial Sequence: Synthetic peptide
  XENP020607 vlCDR3
QQSNEDPFT

SEQ ID NO: 19725 - protein, 450 aa, Artificial Sequence; identical to SEQ ID NO: 17585
  Description of Artificial Sequence: Synthetic polypeptide
  XENP020608 7G8_H0_L0.4_IgG1_PVA_/S267K Heavy Chain

SEQ ID NO: 19726 - protein, 121 aa, Artificial Sequence; identical to SEQ ID NO: 17586
  Description of Artificial Sequence: Synthetic polypeptide
  VH of XENP020608

SEQ ID NO: 19727 - protein, 5 aa, Artificial Sequence
  Description of Artificial Sequence: Synthetic peptide
  XENP020608 vhCDR1
DAWMD

SEQ ID NO: 19728 - protein, 19 aa, Artificial Sequence
  Description of Artificial Sequence: Synthetic peptide
  XENP020608 vhCDR2
EIRTKANNHATYYAESVKG

SEQ ID NO: 19729 - protein, 10 aa, Artificial Sequence
  Description of Artificial Sequence: Synthetic peptide
  XENP020608 vhCDR3
LANWDWYFDV

SEQ ID NO: 19730 - protein, 218 aa, Artificial Sequence
  Description of Artificial Sequence: Synthetic polypeptide
  XENP020608 7G8_H0_L0.4_IgG1_PVA_/S267K Light Chain
DTVLTQSPASLAVSLGQRATISCKASQSVSYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19731 - protein, 111 aa, Artificial Sequence
  Description of Artificial Sequence: Synthetic polypeptide
  VL of XENP020608
DTVLTQSPASLAVSLGQRATISCKASQSVSYDGDSYMNWYQQKPGQPPKLLIYAASNLESGIPARLSGSGSGTDFTLNIHPVEEEDAATYYCQQSNEDPFTFGSGTKLEVK

SEQ ID NO: 19732 - protein, 15 aa, Artificial Sequence
  Description of Artificial Sequence: Synthetic peptide
  XENP020608 vlCDR1
KASQSVSYDGDSYMN

SEQ ID NO: 19733 - protein, 7 aa, Artificial Sequence
  Description of Artificial Sequence: Synthetic peptide
  XENP020608 vlCDR2
AASNLES

SEQ ID NO: 19734 - protein, 9 aa, Artificial Sequence
  Description of Artificial Sequence: Synthetic peptide
  XENP020608 vlCDR3
QQSNEDPFT

SEQ ID NO: 19735 - protein, 450 aa, Artificial Sequence; identical to SEQ ID NO: 17585
  Description of Artificial Sequence: Synthetic polypeptide
  XENP020609 7G8_H0_L0.5_IgG1_PVA_/S267K Heavy Chain

SEQ ID NO: 19736 - protein, 121 aa, Artificial Sequence; identical to SEQ ID NO: 17586
  Description of Artificial Sequence: Synthetic polypeptide
  VH of XENP020609

SEQ ID NO: 19737 - protein, 5 aa, Artificial Sequence
  Description of Artificial Sequence: Synthetic peptide
  XENP020609 vhCDR1
DAWMD

SEQ ID NO: 19738 - protein, 19 aa, Artificial Sequence
  Description of Artificial Sequence: Synthetic peptide
  XENP020609 vhCDR2
EIRTKANNHATYYAESVKG

SEQ ID NO: 19739 - protein, 10 aa, Artificial Sequence
  Description of Artificial Sequence: Synthetic peptide
  XENP020609 vhCDR3
LANWDWYFDV

SEQ ID NO: 19740 - protein, 218 aa, Artificial Sequence
  Description of Artificial Sequence: Synthetic polypeptide
  XENP020609 7G8_H0_L0.5_IgG1_PVA_/S267K Light Chain
DTVLTQSPASLAVSLGQRATISCKASQSVRYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19741 - protein, 111 aa, Artificial Sequence
  Description of Artificial Sequence: Synthetic polypeptide
  VL of XENP020609
DTVLTQSPASLAVSLGQRATISCKASQSVRYDGDSYMNWYQQKPGQPPKLLIYAASNLESGIPARLSGSGSGTDFTLNIHPVEEEDAATYYCQQSNEDPFTFGSGTKLEVK

SEQ ID NO: 19742 - protein, 15 aa, Artificial Sequence
  Description of Artificial Sequence: Synthetic peptide
  XENP020609 vlCDR1
KASQSVRYDGDSYMN

SEQ ID NO: 19743 - protein, 7 aa, Artificial Sequence
  Description of Artificial Sequence: Synthetic peptide
  XENP020609 vlCDR2
AASNLES

SEQ ID NO: 19744 - protein, 9 aa, Artificial Sequence
  Description of Artificial Sequence: Synthetic peptide
  XENP020609 vlCDR3
QQSNEDPFT

SEQ ID NO: 19745 - protein, 450 aa, Artificial Sequence; identical to SEQ ID NO: 17585
  Description of Artificial Sequence: Synthetic polypeptide
  XENP020610 7G8_H0_L0.6_IgG1_PVA_/S267K Heavy Chain

SEQ ID NO: 19746 - protein, 121 aa, Artificial Sequence; identical to SEQ ID NO: 17586
  Description of Artificial Sequence: Synthetic polypeptide
  VH of XENP020610

SEQ ID NO: 19747 - protein, 5 aa, Artificial Sequence
  Description of Artificial Sequence: Synthetic peptide
  XENP020610 vhCDR1
DAWMD

SEQ ID NO: 19748 - protein, 19 aa, Artificial Sequence
  Description of Artificial Sequence: Synthetic peptide
  XENP020610 vhCDR2
EIRTKANNHATYYAESVKG

SEQ ID NO: 19749 - protein, 10 aa, Artificial Sequence
  Description of Artificial Sequence: Synthetic peptide
  XENP020610 vhCDR3
LANWDWYFDV

SEQ ID NO: 19750 - protein, 218 aa, Artificial Sequence
  Description of Artificial Sequence: Synthetic polypeptide
  XENP020610 7G8_H0_L0.6_IgG1_PVA_/S267K Light Chain
DTVLTQSPASLAVSLGQRATISCKASQSVLYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19751 - protein, 111 aa, Artificial Sequence
  Description of Artificial Sequence: Synthetic polypeptide
  VL of XENP020610
DTVLTQSPASLAVSLGQRATISCKASQSVLYDGDSYMNWYQQKPGQPPKLLIYAASNLESGIPARLSGSGSGTDFTLNIHPVEEEDAATYYCQQSNEDPFTFGSGTKLEVK

SEQ ID NO: 19752 - protein, 15 aa, Artificial Sequence
  Description of Artificial Sequence: Synthetic peptide
  XENP020610 vlCDR1
KASQSVLYDGDSYMN

SEQ ID NO: 19753 - protein, 7 aa, Artificial Sequence
  Description of Artificial Sequence: Synthetic peptide
  XENP020610 vlCDR2
AASNLES

SEQ ID NO: 19754 - protein, 9 aa, Artificial Sequence
  Description of Artificial Sequence: Synthetic peptide
  XENP020610 vlCDR3
QQSNEDPFT

SEQ ID NO: 19755 - protein, 450 aa, Artificial Sequence; identical to SEQ ID NO: 17585
  Description of Artificial Sequence: Synthetic polypeptide
  XENP020611 7G8_H0_L0.7_IgG1_PVA_/S267K Heavy Chain

SEQ ID NO: 19756 - protein, 121 aa, Artificial Sequence; identical to SEQ ID NO: 17586
  Description of Artificial Sequence: Synthetic polypeptide
  VH of XENP020611

SEQ ID NO: 19757 - protein, 5 aa, Artificial Sequence
  Description of Artificial Sequence: Synthetic peptide
  XENP020611 vhCDR1
DAWMD

SEQ ID NO: 19758 - protein, 19 aa, Artificial Sequence
  Description of Artificial Sequence: Synthetic peptide
  XENP020611 vhCDR2
EIRTKANNHATYYAESVKG

SEQ ID NO: 19759 - protein, 10 aa, Artificial Sequence
  Description of Artificial Sequence: Synthetic peptide
  XENP020611 vhCDR3
LANWDWYFDV

SEQ ID NO: 19760 - protein, 218 aa, Artificial Sequence
  Description of Artificial Sequence: Synthetic polypeptide
  XENP020611 7G8_H0_L0.7_IgG1_PVA_/S267K Light Chain
DTVLTQSPASLAVSLGQRATISCKASQSVTYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19761 - protein, 111 aa, Artificial Sequence
  Description of Artificial Sequence: Synthetic polypeptide
  VL of XENP020611
DTVLTQSPASLAVSLGQRATISCKASQSVTYDGDSYMNWYQQKPGQPPKLLIYAASNLESGIPARLSGSGSGTDFTLNIHPVEEEDAATYYCQQSNEDPFTFGSGTKLEVK

SEQ ID NO: 19762 - protein, 15 aa, Artificial Sequence
  Description of Artificial Sequence: Synthetic peptide
  XENP020611 vlCDR1
KASQSVTYDGDSYMN

SEQ ID NO: 19763 - protein, 7 aa, Artificial Sequence
  Description of Artificial Sequence: Synthetic peptide
  XENP020611 vlCDR2
AASNLES

SEQ ID NO: 19764 - protein, 9 aa, Artificial Sequence
  Description of Artificial Sequence: Synthetic peptide
  XENP020611 vlCDR3
QQSNEDPFT

SEQ ID NO: 19765 - protein, 450 aa, Artificial Sequence; identical to SEQ ID NO: 17585
  Description of Artificial Sequence: Synthetic polypeptide
  XENP020612 7G8_H0_L0.8_IgG1_PVA_/S267K Heavy Chain

SEQ ID NO: 19766 - protein, 121 aa, Artificial Sequence; identical to SEQ ID NO: 17586
  Description of Artificial Sequence: Synthetic polypeptide
  VH of XENP020612

SEQ ID NO: 19767 - protein, 5 aa, Artificial Sequence
  Description of Artificial Sequence: Synthetic peptide
  XENP020612 vhCDR1
DAWMD

SEQ ID NO: 19768 - protein, 19 aa, Artificial Sequence
  Description of Artificial Sequence: Synthetic peptide
  XENP020612 vhCDR2
EIRTKANNHATYYAESVKG

SEQ ID NO: 19769 - protein, 10 aa, Artificial Sequence
  Description of Artificial Sequence: Synthetic peptide
  XENP020612 vhCDR3
LANWDWYFDV

SEQ ID NO: 19770 - protein, 218 aa, Artificial Sequence
  Description of Artificial Sequence: Synthetic polypeptide
  XENP020612 7G8_H0_L0.8_IgG1_PVA_/S267K Light Chain
DTVLTQSPASLAVSLGQRATISCKASQSVGYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19771 - protein, 111 aa, Artificial Sequence
  Description of Artificial Sequence: Synthetic polypeptide
  VL of XENP020612
DTVLTQSPASLAVSLGQRATISCKASQSVGYDGDSYMNWYQQKPGQPPKLLIYAASNLESGIPARLSGSGSGTDFTLNIHPVEEEDAATYYCQQSNEDPFTFGSGTKLEVK

SEQ ID NO: 19772 - protein, 15 aa, Artificial Sequence
  Description of Artificial Sequence: Synthetic peptide
  XENP020612 vlCDR1
KASQSVGYDGDSYMN

SEQ ID NO: 19773 - protein, 7 aa, Artificial Sequence
  Description of Artificial Sequence: Synthetic peptide
  XENP020612 vlCDR2
AASNLES

SEQ ID NO: 19774 - protein, 9 aa, Artificial Sequence
  Description of Artificial Sequence: Synthetic peptide
  XENP020612 vlCDR3
QQSNEDPFT

SEQ ID NO: 19775 - protein, 450 aa, Artificial Sequence; identical to SEQ ID NO: 17585
  Description of Artificial Sequence: Synthetic polypeptide
  XENP020613 7G8_H0_L0.9_IgG1_PVA_/S267K Heavy Chain

SEQ ID NO: 19776 - protein, 121 aa, Artificial Sequence; identical to SEQ ID NO: 17586
  Description of Artificial Sequence: Synthetic polypeptide
  VH of XENP020613

SEQ ID NO: 19777 - protein, 5 aa, Artificial Sequence
  Description of Artificial Sequence: Synthetic peptide
  XENP020613 vhCDR1
DAWMD

SEQ ID NO: 19778 - protein, 19 aa, Artificial Sequence
  Description of Artificial Sequence: Synthetic peptide
  XENP020613 vhCDR2
EIRTKANNHATYYAESVKG

SEQ ID NO: 19779 - protein, 10 aa, Artificial Sequence
  Description of Artificial Sequence: Synthetic peptide
  XENP020613 vhCDR3
LANWDWYFDV

SEQ ID NO: 19780 - protein, 218 aa, Artificial Sequence
  Description of Artificial Sequence: Synthetic polypeptide
  XENP020613 7G8_H0_L0.9_IgG1_PVA_/S267K Light Chain
DTVLTQSPASLAVSLGQRATISCKASQSVYYDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19781 - protein, 111 aa, Artificial Sequence
  Description of Artificial Sequence: Synthetic polypeptide
  VL of XENP020613
DTVLTQSPASLAVSLGQRATISCKASQSVYYDGDSYMNWYQQKPGQPPKLLIYAASNLESGIPARLSGSGSGTDFTLNIHPVEEEDAATYYCQQSNEDPFTFGSGTKLEVK

SEQ ID NO: 19782 - protein, 15 aa, Artificial Sequence
  Description of Artificial Sequence: Synthetic peptide
  XENP020613 vlCDR1
KASQSVYYDGDSYMN

SEQ ID NO: 19783 - protein, 7 aa, Artificial Sequence
  Description of Artificial Sequence: Synthetic peptide
  XENP020613 vlCDR2
AASNLES

SEQ ID NO: 19784 - protein, 9 aa, Artificial Sequence
  Description of Artificial Sequence: Synthetic peptide
  XENP020613 vlCDR3
QQSNEDPFT

SEQ ID NO: 19785 - protein, 450 aa, Artificial Sequence; identical to SEQ ID NO: 17585
  Description of Artificial Sequence: Synthetic polypeptide
  XENP020614 7G8_H0_L0.10_IgG1_PVA_/S267K Heavy Chain

SEQ ID NO: 19786 - protein, 121 aa, Artificial Sequence; identical to SEQ ID NO: 17586
  Description of Artificial Sequence: Synthetic polypeptide
  VH of XENP020614

SEQ ID NO: 19787 - protein, 5 aa, Artificial Sequence
  Description of Artificial Sequence: Synthetic peptide
  XENP020614 vhCDR1
DAWMD

SEQ ID NO: 19788 - protein, 19 aa, Artificial Sequence
  Description of Artificial Sequence: Synthetic peptide
  XENP020614 vhCDR2
EIRTKANNHATYYAESVKG

SEQ ID NO: 19789 - protein, 10 aa, Artificial Sequence
  Description of Artificial Sequence: Synthetic peptide
  XENP020614 vhCDR3
LANWDWYFDV

SEQ ID NO: 19790 - protein, 218 aa, Artificial Sequence
  Description of Artificial Sequence: Synthetic polypeptide
  XENP020614 7G8_H0_L0.10_IgG1_PVA_/S267K Light Chain
DTVLTQSPASLAVSLGQRATISCKASQSVDFDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19791 - protein, 111 aa, Artificial Sequence
  Description of Artificial Sequence: Synthetic polypeptide
  VL of XENP020614
DTVLTQSPASLAVSLGQRATISCKASQSVDFDGDSYMNWYQQKPGQPPKLLIYAASNLESGIPARLSGSGSGTDFTLNIHPVEEEDAATYYCQQSNEDPFTFGSGTKLEVK

SEQ ID NO: 19792 - protein, 15 aa, Artificial Sequence
  Description of Artificial Sequence: Synthetic peptide
  XENP020614 vlCDR1
KASQSVDFDGDSYMN

SEQ ID NO: 19793 - protein, 7 aa, Artificial Sequence
  Description of Artificial Sequence: Synthetic peptide
  XENP020614 vlCDR2
AASNLES

SEQ ID NO: 19794 - protein, 9 aa, Artificial Sequence
  Description of Artificial Sequence: Synthetic peptide
  XENP020614 vlCDR3
QQSNEDPFT

SEQ ID NO: 19795 - protein, 450 aa, Artificial Sequence; identical to SEQ ID NO: 17585
  Description of Artificial Sequence: Synthetic polypeptide
  XENP020615 7G8_H0_L0.11_IgG1_PVA_/S267K Heavy Chain

SEQ ID NO: 19796 - protein, 121 aa, Artificial Sequence; identical to SEQ ID NO: 17586
  Description of Artificial Sequence: Synthetic polypeptide
  VH of XENP020615

SEQ ID NO: 19797 - protein, 5 aa, Artificial Sequence
  Description of Artificial Sequence: Synthetic peptide
  XENP020615 vhCDR1
DAWMD

SEQ ID NO: 19798 - protein, 19 aa, Artificial Sequence
  Description of Artificial Sequence: Synthetic peptide
  XENP020615 vhCDR2
EIRTKANNHATYYAESVKG

SEQ ID NO: 19799 - protein, 10 aa, Artificial Sequence
  Description of Artificial Sequence: Synthetic peptide
  XENP020615 vhCDR3
LANWDWYFDV

SEQ ID NO: 19800 - protein, 218 aa, Artificial Sequence
  Description of Artificial Sequence: Synthetic polypeptide
  XENP020615 7G8_H0_L0.11_IgG1_PVA_/S267K Light Chain
DTVLTQSPASLAVSLGQRATISCKASQSVDHDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19801 - protein, 111 aa, Artificial Sequence
  Description of Artificial Sequence: Synthetic polypeptide
  VL of XENP020615
DTVLTQSPASLAVSLGQRATISCKASQSVDHDGDSYMNWYQQKPGQPPKLLIYAASNLESGIPARLSGSGSGTDFTLNIHPVEEEDAATYYCQQSNEDPFTFGSGTKLEVK

SEQ ID NO: 19802 - protein, 15 aa, Artificial Sequence
  Description of Artificial Sequence: Synthetic peptide
  XENP020615 vlCDR1
KASQSVDHDGDSYMN

SEQ ID NO: 19803 - protein, 7 aa, Artificial Sequence
  Description of Artificial Sequence: Synthetic peptide
  XENP020615 vlCDR2
AASNLES

SEQ ID NO: 19804 - protein, 9 aa, Artificial Sequence
  Description of Artificial Sequence: Synthetic peptide
  XENP020615 vlCDR3
QQSNEDPFT

SEQ ID NO: 19805 - protein, 450 aa, Artificial Sequence; identical to SEQ ID NO: 17585
  Description of Artificial Sequence: Synthetic polypeptide
  XENP020616 7G8_H0_L0.12_IgG1_PVA_/S267K Heavy Chain

SEQ ID NO: 19806 - protein, 121 aa, Artificial Sequence; identical to SEQ ID NO: 17586
  Description of Artificial Sequence: Synthetic polypeptide
  VH of XENP020616

SEQ ID NO: 19807 - protein, 5 aa, Artificial Sequence
  Description of Artificial Sequence: Synthetic peptide
  XENP020616 vhCDR1
DAWMD

SEQ ID NO: 19808 - protein, 19 aa, Artificial Sequence
  Description of Artificial Sequence: Synthetic peptide
  XENP020616 vhCDR2
EIRTKANNHATYYAESVKG

SEQ ID NO: 19809 - protein, 10 aa, Artificial Sequence
  Description of Artificial Sequence: Synthetic peptide
  XENP020616 vhCDR3
LANWDWYFDV

SEQ ID NO: 19810 - protein, 218 aa, Artificial Sequence
  Description of Artificial Sequence: Synthetic polypeptide
  XENP020616 7G8_H0_L0.12_IgG1_PVA_/S267K Light Chain
DTVLTQSPASLAVSLGQRATISCKASQSVDLDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19811 - protein, 111 aa, Artificial Sequence
  Description of Artificial Sequence: Synthetic polypeptide
  VL of XENP020616
DTVLTQSPASLAVSLGQRATISCKASQSVDLDGDSYMNWYQQKPGQPPKLLIYAASNLESGIPARLSGSGSGTDFTLNIHPVEEEDAATYYCQQSNEDPFTFGSGTKLEVK

SEQ ID NO: 19812 - protein, 15 aa, Artificial Sequence
  Description of Artificial Sequence: Synthetic peptide
  XENP020616 vlCDR1
KASQSVDLDGDSYMN

SEQ ID NO: 19813 - protein, 7 aa, Artificial Sequence
  Description of Artificial Sequence: Synthetic peptide
  XENP020616 vlCDR2
AASNLES

SEQ ID NO: 19814 - protein, 9 aa, Artificial Sequence
  Description of Artificial Sequence: Synthetic peptide
  XENP020616 vlCDR3
QQSNEDPFT

SEQ ID NO: 19815 - protein, 450 aa, Artificial Sequence; identical to SEQ ID NO: 17585
  Description of Artificial Sequence: Synthetic polypeptide
  XENP020617 7G8_H0_L0.13_IgG1_PVA_/S267K Heavy Chain

SEQ ID NO: 19816 - protein, 121 aa, Artificial Sequence; identical to SEQ ID NO: 17586
  Description of Artificial Sequence: Synthetic polypeptide
  VH of XENP020617

SEQ ID NO: 19817 - protein, 5 aa, Artificial Sequence
  Description of Artificial Sequence: Synthetic peptide
  XENP020617 vhCDR1
DAWMD

SEQ ID NO: 19818 - protein, 19 aa, Artificial Sequence
  Description of Artificial Sequence: Synthetic peptide
  XENP020617 vhCDR2
EIRTKANNHATYYAESVKG

SEQ ID NO: 19819 - protein, 10 aa, Artificial Sequence
  Description of Artificial Sequence: Synthetic peptide
  XENP020617 vhCDR3
LANWDWYFDV

SEQ ID NO: 19820 - protein, 218 aa, Artificial Sequence
  Description of Artificial Sequence: Synthetic polypeptide
  XENP020617 7G8_H0_L0.13_IgG1_PVA_/S267K Light Chain
DTVLTQSPASLAVSLGQRATISCKASQSVDWDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19821 - protein, 111 aa, Artificial Sequence
  Description of Artificial Sequence: Synthetic polypeptide
  VL of XENP020617
DTVLTQSPASLAVSLGQRATISCKASQSVDWDGDSYMNWYQQKPGQPPKLLIYAASNLESGIPARLSGSGSGTDFTLNIHPVEEEDAATYYCQQSNEDPFTFGSGTKLEVK

SEQ ID NO: 19822 - protein, 15 aa, Artificial Sequence
  Description of Artificial Sequence: Synthetic peptide
  XENP020617 vlCDR1
KASQSVDWDGDSYMN

SEQ ID NO: 19823 - protein, 7 aa, Artificial Sequence
  Description of Artificial Sequence: Synthetic peptide
  XENP020617 vlCDR2
AASNLES

SEQ ID NO: 19824 - protein, 9 aa, Artificial Sequence
  Description of Artificial Sequence: Synthetic peptide
  XENP020617 vlCDR3
QQSNEDPFT

SEQ ID NO: 19825 - protein, 450 aa, Artificial Sequence; identical to SEQ ID NO: 17585
  Description of Artificial Sequence: Synthetic polypeptide
  XENP020618 7G8_H0_L0.14_IgG1_PVA_/S267K Heavy Chain

SEQ ID NO: 19826 - protein, 121 aa, Artificial Sequence; identical to SEQ ID NO: 17586
  Description of Artificial Sequence: Synthetic polypeptide
  VH of XENP020618

SEQ ID NO: 19827 - protein, 5 aa, Artificial Sequence
  Description of Artificial Sequence: Synthetic peptide
  XENP020618 vhCDR1
DAWMD

SEQ ID NO: 19828 - protein, 19 aa, Artificial Sequence
  Description of Artificial Sequence: Synthetic peptide
  XENP020618 vhCDR2
EIRTKANNHATYYAESVKG

SEQ ID NO: 19829 - protein, 10 aa, Artificial Sequence
  Description of Artificial Sequence: Synthetic peptide
  XENP020618 vhCDR3
LANWDWYFDV

SEQ ID NO: 19830 - protein, 218 aa, Artificial Sequence
  Description of Artificial Sequence: Synthetic polypeptide
  XENP020618 7G8_H0_L0.14_IgG1_PVA_/S267K Light Chain
DTVLTQSPASLAVSLGQRATISCKASQSVDVDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19831 - protein, 111 aa, Artificial Sequence
  Description of Artificial Sequence: Synthetic polypeptide
  VL of XENP020618
DTVLTQSPASLAVSLGQRATISCKASQSVDVDGDSYMNWYQQKPGQPPKLLIYAASNLESGIPARLSGSGSGTDFTLNIHPVEEEDAATYYCQQSNEDPFTFGSGTKLEVK

SEQ ID NO: 19832 - protein, 15 aa, Artificial Sequence
  Description of Artificial Sequence: Synthetic peptide
  XENP020618 vlCDR1
KASQSVDVDGDSYMN

SEQ ID NO: 19833 - protein, 7 aa, Artificial Sequence
  Description of Artificial Sequence: Synthetic peptide
  XENP020618 vlCDR2
AASNLES

SEQ ID NO: 19834 - protein, 9 aa, Artificial Sequence
  Description of Artificial Sequence: Synthetic peptide
  XENP020618 vlCDR3
QQSNEDPFT

SEQ ID NO: 19835 - protein, 450 aa, Artificial Sequence; identical to SEQ ID NO: 17585
  Description of Artificial Sequence: Synthetic polypeptide
  XENP020619 7G8_H0_L0.15_IgG1_PVA_/S267K Heavy Chain

SEQ ID NO: 19836 - protein, 121 aa, Artificial Sequence; identical to SEQ ID NO: 17586
  Description of Artificial Sequence: Synthetic polypeptide
  VH of XENP020619

SEQ ID NO: 19837 - protein, 5 aa, Artificial Sequence
  Description of Artificial Sequence: Synthetic peptide
  XENP020619 vhCDR1
DAWMD

SEQ ID NO: 19838 - protein, 19 aa, Artificial Sequence
  Description of Artificial Sequence: Synthetic peptide
  XENP020619 vhCDR2
EIRTKANNHATYYAESVKG

SEQ ID NO: 19839 - protein, 10 aa, Artificial Sequence
  Description of Artificial Sequence: Synthetic peptide
  XENP020619 vhCDR3
LANWDWYFDV

SEQ ID NO: 19840 - protein, 218 aa, Artificial Sequence
  Description of Artificial Sequence: Synthetic polypeptide
  XENP020619 7G8_H0_L0.15_IgG1_PVA_/S267K Light Chain
DTVLTQSPASLAVSLGQRATISCKASQSVDADGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19841 - protein, 111 aa, Artificial Sequence
  Description of Artificial Sequence: Synthetic polypeptide
  VL of XENP020619
DTVLTQSPASLAVSLGQRATISCKASQSVDADGDSYMNWYQQKPGQPPKLLIYAASNLESGIPARLSGSGSGTDFTLNIHPVEEEDAATYYCQQSNEDPFTFGSGTKLEVK

SEQ ID NO: 19842 - protein, 15 aa, Artificial Sequence
  Description of Artificial Sequence: Synthetic peptide
  XENP020619 vlCDR1
KASQSVDADGDSYMN

SEQ ID NO: 19843 - protein, 7 aa, Artificial Sequence
  Description of Artificial Sequence: Synthetic peptide
  XENP020619 vlCDR2
AASNLES

SEQ ID NO: 19844 - protein, 9 aa, Artificial Sequence
  Description of Artificial Sequence: Synthetic peptide
  XENP020619 vlCDR3
QQSNEDPFT

SEQ ID NO: 19845 - protein, 450 aa, Artificial Sequence; identical to SEQ ID NO: 17585
  Description of Artificial Sequence: Synthetic polypeptide
  XENP020620 7G8_H0_L0.16_IgG1_PVA_/S267K Heavy Chain

SEQ ID NO: 19846 - protein, 121 aa, Artificial Sequence; identical to SEQ ID NO: 17586
  Description of Artificial Sequence: Synthetic polypeptide
  VH of XENP020620

SEQ ID NO: 19847 - protein, 5 aa, Artificial Sequence
  Description of Artificial Sequence: Synthetic peptide
  XENP020620 vhCDR1
DAWMD

SEQ ID NO: 19848 - protein, 19 aa, Artificial Sequence
  Description of Artificial Sequence: Synthetic peptide
  XENP020620 vhCDR2
EIRTKANNHATYYAESVKG

SEQ ID NO: 19849 - protein, 10 aa, Artificial Sequence
  Description of Artificial Sequence: Synthetic peptide
  XENP020620 vhCDR3
LANWDWYFDV

SEQ ID NO: 19850 - protein, 218 aa, Artificial Sequence
  Description of Artificial Sequence: Synthetic polypeptide
  XENP020620 7G8_H0_L0.16_IgG1_PVA_/S267K Light Chain
DTVLTQSPASLAVSLGQRATISCKASQSVDQDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19851 - protein, 111 aa, Artificial Sequence
  Description of Artificial Sequence: Synthetic polypeptide
  VL of XENP020620
DTVLTQSPASLAVSLGQRATISCKASQSVDQDGDSYMNWYQQKPGQPPKLLIYAASNLESGIPARLSGSGSGTDFTLNIHPVEEEDAATYYCQQSNEDPFTFGSGTKLEVK

SEQ ID NO: 19852 - protein, 15 aa, Artificial Sequence
  Description of Artificial Sequence: Synthetic peptide
  XENP020620 vlCDR1
KASQSVDQDGDSYMN

SEQ ID NO: 19853 - protein, 7 aa, Artificial Sequence
  Description of Artificial Sequence: Synthetic peptide
  XENP020620 vlCDR2
AASNLES

SEQ ID NO: 19854 - protein, 9 aa, Artificial Sequence
  Description of Artificial Sequence: Synthetic peptide
  XENP020620 vlCDR3
QQSNEDPFT

SEQ ID NO: 19855 - protein, 450 aa, Artificial Sequence; identical to SEQ ID NO: 17585
  Description of Artificial Sequence: Synthetic polypeptide
  XENP020621 7G8_H0_L0.17_IgG1_PVA_/S267K Heavy Chain

SEQ ID NO: 19856 - protein, 121 aa, Artificial Sequence; identical to SEQ ID NO: 17586
  Description of Artificial Sequence: Synthetic polypeptide
  VH of XENP020621

SEQ ID NO: 19857 - protein, 5 aa, Artificial Sequence
  Description of Artificial Sequence: Synthetic peptide
  XENP020621 vhCDR1
DAWMD

SEQ ID NO: 19858 - protein, 19 aa, Artificial Sequence
  Description of Artificial Sequence: Synthetic peptide
  XENP020621 vhCDR2
EIRTKANNHATYYAESVKG

SEQ ID NO: 19859 - protein, 10 aa, Artificial Sequence
  Description of Artificial Sequence: Synthetic peptide
  XENP020621 vhCDR3
LANWDWYFDV

SEQ ID NO: 19860 - protein, 218 aa, Artificial Sequence
  Description of Artificial Sequence: Synthetic polypeptide
  XENP020621 7G8_H0_L0.17_IgG1_PVA_/S267K Light Chain
DTVLTQSPASLAVSLGQRATISCKASQSVDDDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19861 - protein, 111 aa, Artificial Sequence
  Description of Artificial Sequence: Synthetic polypeptide
  VL of XENP020621
DTVLTQSPASLAVSLGQRATISCKASQSVDDDGDSYMNWYQQKPGQPPKLLIYAASNLESGIPARLSGSGSGTDFTLNIHPVEEEDAATYYCQQSNEDPFTFGSGTKLEVK

SEQ ID NO: 19862 - protein, 15 aa, Artificial Sequence
  Description of Artificial Sequence: Synthetic peptide
  XENP020621 vlCDR1
KASQSVDDDGDSYMN

SEQ ID NO: 19863 - protein, 7 aa, Artificial Sequence
  Description of Artificial Sequence: Synthetic peptide
  XENP020621 vlCDR2
AASNLES

SEQ ID NO: 19864 - protein, 9 aa, Artificial Sequence
  Description of Artificial Sequence: Synthetic peptide
  XENP020621 vlCDR3
QQSNEDPFT

SEQ ID NO: 19865 - protein, 450 aa, Artificial Sequence; identical to SEQ ID NO: 17585
  Description of Artificial Sequence: Synthetic polypeptide
  XENP020622 7G8_H0_L0.18_IgG1_PVA_/S267K Heavy Chain

SEQ ID NO: 19866 - protein, 121 aa, Artificial Sequence; identical to SEQ ID NO: 17586
  Description of Artificial Sequence: Synthetic polypeptide
  VH of XENP020622

SEQ ID NO: 19867 - protein, 5 aa, Artificial Sequence
  Description of Artificial Sequence: Synthetic peptide
  XENP020622 vhCDR1
DAWMD

SEQ ID NO: 19868 - protein, 19 aa, Artificial Sequence
  Description of Artificial Sequence: Synthetic peptide
  XENP020622 vhCDR2
EIRTKANNHATYYAESVKG

SEQ ID NO: 19869 - protein, 10 aa, Artificial Sequence
  Description of Artificial Sequence: Synthetic peptide
  XENP020622 vhCDR3
LANWDWYFDV

SEQ ID NO: 19870 - protein, 218 aa, Artificial Sequence
  Description of Artificial Sequence: Synthetic polypeptide
  XENP020622 7G8_H0_L0.18_IgG1_PVA_/S267K Light Chain
DTVLTQSPASLAVSLGQRATISCKASQSVDKDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19871 - protein, 111 aa, Artificial Sequence
  Description of Artificial Sequence: Synthetic polypeptide
  VL of XENP020622
DTVLTQSPASLAVSLGQRATISCKASQSVDKDGDSYMNWYQQKPGQPPKLLIYAASNLESGIPARLSGSGSGTDFTLNIHPVEEEDAATYYCQQSNEDPFTFGSGTKLEVK

SEQ ID NO: 19872 - protein, 15 aa, Artificial Sequence
  Description of Artificial Sequence: Synthetic peptide
  XENP020622 vlCDR1
KASQSVDKDGDSYMN

SEQ ID NO: 19873 - protein, 7 aa, Artificial Sequence
  Description of Artificial Sequence: Synthetic peptide
  XENP020622 vlCDR2
AASNLES

SEQ ID NO: 19874 - protein, 9 aa, Artificial Sequence
  Description of Artificial Sequence: Synthetic peptide
  XENP020622 vlCDR3
QQSNEDPFT

SEQ ID NO: 19875 - protein, 450 aa, Artificial Sequence; identical to SEQ ID NO: 17585
  Description of Artificial Sequence: Synthetic polypeptide
  XENP020623 7G8_H0_L0.19_IgG1_PVA_/S267K Heavy Chain

SEQ ID NO: 19876 - protein, 121 aa, Artificial Sequence; identical to SEQ ID NO: 17586
  Description of Artificial Sequence: Synthetic polypeptide
  VH of XENP020623

SEQ ID NO: 19877 - protein, 5 aa, Artificial Sequence
  Description of Artificial Sequence: Synthetic peptide
  XENP020623 vhCDR1
DAWMD

SEQ ID NO: 19878 - protein, 19 aa, Artificial Sequence
  Description of Artificial Sequence: Synthetic peptide
  XENP020623 vhCDR2
EIRTKANNHATYYAESVKG

SEQ ID NO: 19879 - protein, 10 aa, Artificial Sequence
  Description of Artificial Sequence: Synthetic peptide
  XENP020623 vhCDR3
LANWDWYFDV

SEQ ID NO: 19880 - protein, 218 aa, Artificial Sequence
  Description of Artificial Sequence: Synthetic polypeptide
  XENP020623 7G8_H0_L0.19_IgG1_PVA_/S267K Light Chain
DTVLTQSPASLAVSLGQRATISCKASQSVDNDGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19881 - protein, 111 aa, Artificial Sequence
  Description of Artificial Sequence: Synthetic polypeptide
  VL of XENP020623
DTVLTQSPASLAVSLGQRATISCKASQSVDNDGDSYMNWYQQKPGQPPKLLIYAASNLESGIPARLSGSGSGTDFTLNIHPVEEEDAATYYCQQSNEDPFTFGSGTKLEVK

SEQ ID NO: 19882 - protein, 15 aa, Artificial Sequence
  Description of Artificial Sequence: Synthetic peptide
  XENP020623 vlCDR1
KASQSVDNDGDSYMN

SEQ ID NO: 19883 - protein, 7 aa, Artificial Sequence
  Description of Artificial Sequence: Synthetic peptide
  XENP020623 vlCDR2
AASNLES

SEQ ID NO: 19884 - protein, 9 aa, Artificial Sequence
  Description of Artificial Sequence: Synthetic peptide
  XENP020623 vlCDR3
QQSNEDPFT

SEQ ID NO: 19885 - protein, 450 aa, Artificial Sequence; identical to SEQ ID NO: 17585
  Description of Artificial Sequence: Synthetic polypeptide
  XENP020624 7G8_H0_L0.20_IgG1_PVA_/S267K Heavy Chain

SEQ ID NO: 19886 - protein, 121 aa, Artificial Sequence; identical to SEQ ID NO: 17586
  Description of Artificial Sequence: Synthetic polypeptide
  VH of XENP020624

SEQ ID NO: 19887 - protein, 5 aa, Artificial Sequence
  Description of Artificial Sequence: Synthetic peptide
  XENP020624 vhCDR1
DAWMD

SEQ ID NO: 19888 - protein, 19 aa, Artificial Sequence
  Description of Artificial Sequence: Synthetic peptide
  XENP020624 vhCDR2
EIRTKANNHATYYAESVKG

SEQ ID NO: 19889 - protein, 10 aa, Artificial Sequence
  Description of Artificial Sequence: Synthetic peptide
  XENP020624 vhCDR3
LANWDWYFDV

SEQ ID NO: 19890 - protein, 218 aa, Artificial Sequence
  Description of Artificial Sequence: Synthetic polypeptide
  XENP020624 7G8_H0_L0.20_IgG1_PVA_/S267K Light Chain
DTVLTQSPASLAVSLGQRATISCKASQSVDYNGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19891 - protein, 111 aa, Artificial Sequence
  Description of Artificial Sequence: Synthetic polypeptide
  VL of XENP020624
DTVLTQSPASLAVSLGQRATISCKASQSVDYNGDSYMNWYQQKPGQPPKLLIYAASNLESGIPARLSGSGSGTDFTLNIHPVEEEDAATYYCQQSNEDPFTFGSGTKLEVK

SEQ ID NO: 19892 - protein, 15 aa, Artificial Sequence
  Description of Artificial Sequence: Synthetic peptide
  XENP020624 vlCDR1
KASQSVDYNGDSYMN

SEQ ID NO: 19893 - protein, 7 aa, Artificial Sequence
  Description of Artificial Sequence: Synthetic peptide
  XENP020624 vlCDR2
AASNLES

SEQ ID NO: 19894 - protein, 9 aa, Artificial Sequence
  Description of Artificial Sequence: Synthetic peptide
  XENP020624 vlCDR3
QQSNEDPFT

SEQ ID NO: 19895 - protein, 450 aa, Artificial Sequence; identical to SEQ ID NO: 17585
  Description of Artificial Sequence: Synthetic polypeptide
  XENP020625 7G8_H0_L0.21_IgG1_PVA_/S267K Heavy Chain

SEQ ID NO: 19896 - protein, 121 aa, Artificial Sequence; identical to SEQ ID NO: 17586
  Description of Artificial Sequence: Synthetic polypeptide
  VH of XENP020625

SEQ ID NO: 19897 - protein, 5 aa, Artificial Sequence
  Description of Artificial Sequence: Synthetic peptide
  XENP020625 vhCDR1
DAWMD

SEQ ID NO: 19898 - protein, 19 aa, Artificial Sequence
  Description of Artificial Sequence: Synthetic peptide
  XENP020625 vhCDR2
EIRTKANNHATYYAESVKG

SEQ ID NO: 19899 - protein, 10 aa, Artificial Sequence
  Description of Artificial Sequence: Synthetic peptide
  XENP020625 vhCDR3
LANWDWYFDV

SEQ ID NO: 19900 - protein, 218 aa, Artificial Sequence
  Description of Artificial Sequence: Synthetic polypeptide
  XENP020625 7G8_H0_L0.21_IgG1_PVA_/S267K Light Chain
DTVLTQSPASLAVSLGQRATISCKASQSVDYEGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19901 - protein, 111 aa, Artificial Sequence
  Description of Artificial Sequence: Synthetic polypeptide
  VL of XENP020625
DTVLTQSPASLAVSLGQRATISCKASQSVDYEGDSYMNWYQQKPGQPPKLLIYAASNLESGIPARLSGSGSGTDFTLNIHPVEEEDAATYYCQQSNEDPFTFGSGTKLEVK

SEQ ID NO: 19902 - protein, 15 aa, Artificial Sequence
  Description of Artificial Sequence: Synthetic peptide
  XENP020625 vlCDR1
KASQSVDYEGDSYMN

SEQ ID NO: 19903 - protein, 7 aa, Artificial Sequence
  Description of Artificial Sequence: Synthetic peptide
  XENP020625 vlCDR2
AASNLES

SEQ ID NO: 19904 - protein, 9 aa, Artificial Sequence
  Description of Artificial Sequence: Synthetic peptide
  XENP020625 vlCDR3
QQSNEDPFT

SEQ ID NO: 19905 - protein, 450 aa, Artificial Sequence; identical to SEQ ID NO: 17585
  Description of Artificial Sequence: Synthetic polypeptide
  XENP020626 7G8_H0_L0.22_IgG1_PVA_/S267K Heavy Chain

SEQ ID NO: 19906 - protein, 121 aa, Artificial Sequence; identical to SEQ ID NO: 17586
  Description of Artificial Sequence: Synthetic polypeptide
  VH of XENP020626

SEQ ID NO: 19907 - protein, 5 aa, Artificial Sequence
  Description of Artificial Sequence: Synthetic peptide
  XENP020626 vhCDR1
DAWMD

SEQ ID NO: 19908 - protein, 19 aa, Artificial Sequence
  Description of Artificial Sequence: Synthetic peptide
  XENP020626 vhCDR2
EIRTKANNHATYYAESVKG

SEQ ID NO: 19909 - protein, 10 aa, Artificial Sequence
  Description of Artificial Sequence: Synthetic peptide
  XENP020626 vhCDR3
LANWDWYFDV

SEQ ID NO: 19910 - protein, 218 aa, Artificial Sequence
  Description of Artificial Sequence: Synthetic polypeptide
  XENP020626 7G8_H0_L0.22_IgG1_PVA_/S267K Light Chain
DTVLTQSPASLAVSLGQRATISCKASQSVDYHGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19911 - protein, 111 aa, Artificial Sequence
  Description of Artificial Sequence: Synthetic polypeptide
  VL of XENP020626
DTVLTQSPASLAVSLGQRATISCKASQSVDYHGDSYMNWYQQKPGQPPKLLIYAASNLESGIPARLSGSGSGTDFTLNIHPVEEEDAATYYCQQSNEDPFTFGSGTKLEVK

SEQ ID NO: 19912 - protein, 15 aa, Artificial Sequence
  Description of Artificial Sequence: Synthetic peptide
  XENP020626 vlCDR1
KASQSVDYHGDSYMN

SEQ ID NO: 19913 - protein, 7 aa, Artificial Sequence
  Description of Artificial Sequence: Synthetic peptide
  XENP020626 vlCDR2
AASNLES

SEQ ID NO: 19914 - protein, 9 aa, Artificial Sequence
  Description of Artificial Sequence: Synthetic peptide
  XENP020626 vlCDR3
QQSNEDPFT

SEQ ID NO: 19915 - protein, 450 aa, Artificial Sequence; identical to SEQ ID NO: 17585
  Description of Artificial Sequence: Synthetic polypeptide
  XENP020627 7G8_H0_L0.23_IgG1_PVA_/S267K Heavy Chain

SEQ ID NO: 19916 - protein, 121 aa, Artificial Sequence; identical to SEQ ID NO: 17586
  Description of Artificial Sequence: Synthetic polypeptide
  VH of XENP020627

SEQ ID NO: 19917 - protein, 5 aa, Artificial Sequence
  Description of Artificial Sequence: Synthetic peptide
  XENP020627 vhCDR1
DAWMD

SEQ ID NO: 19918 - protein, 19 aa, Artificial Sequence
  Description of Artificial Sequence: Synthetic peptide
  XENP020627 vhCDR2
EIRTKANNHATYYAESVKG

SEQ ID NO: 19919 - protein, 10 aa, Artificial Sequence
  Description of Artificial Sequence: Synthetic peptide
  XENP020627 vhCDR3
LANWDWYFDV

SEQ ID NO: 19920 - protein, 218 aa, Artificial Sequence
  Description of Artificial Sequence: Synthetic polypeptide
  XENP020627 7G8_H0_L0.23_IgG1_PVA_/S267K Light Chain
DTVLTQSPASLAVSLGQRATISCKASQSVDYSGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19921 - protein, 111 aa, Artificial Sequence
  Description of Artificial Sequence: Synthetic polypeptide
  VL of XENP020627
DTVLTQSPASLAVSLGQRATISCKASQSVDYSGDSYMNWYQQKPGQPPKLLIYAASNLESGIPARLSGSGSGTDFTLNIHPVEEEDAATYYCQQSNEDPFTFGSGTKLEVK

SEQ ID NO: 19922 - protein, 15 aa, Artificial Sequence
  Description of Artificial Sequence: Synthetic peptide
  XENP020627 vlCDR1
KASQSVDYSGDSYMN

SEQ ID NO: 19923 - protein, 7 aa, Artificial Sequence
  Description of Artificial Sequence: Synthetic peptide
  XENP020627 vlCDR2
AASNLES

SEQ ID NO: 19924 - protein, 9 aa, Artificial Sequence
  Description of Artificial Sequence: Synthetic peptide
  XENP020627 vlCDR3
QQSNEDPFT

SEQ ID NO: 19925 - protein, 450 aa, Artificial Sequence; identical to SEQ ID NO: 17585
  Description of Artificial Sequence: Synthetic polypeptide
  XENP020628 7G8_H0_L0.24_IgG1_PVA_/S267K Heavy Chain

SEQ ID NO: 19926 - protein, 121 aa, Artificial Sequence; identical to SEQ ID NO: 17586
  Description of Artificial Sequence: Synthetic polypeptide
  VH of XENP020628

SEQ ID NO: 19927 - protein, 5 aa, Artificial Sequence
  Description of Artificial Sequence: Synthetic peptide
  XENP020628 vhCDR1
DAWMD

SEQ ID NO: 19928 - protein, 19 aa, Artificial Sequence
  Description of Artificial Sequence: Synthetic peptide
  XENP020628 vhCDR2
EIRTKANNHATYYAESVKG

SEQ ID NO: 19929 - protein, 10 aa, Artificial Sequence
  Description of Artificial Sequence: Synthetic peptide
  XENP020628 vhCDR3
LANWDWYFDV

SEQ ID NO: 19930 - protein, 218 aa, Artificial Sequence
  Description of Artificial Sequence: Synthetic polypeptide
  XENP020628 7G8_H0_L0.24_IgG1_PVA_/S267K Light Chain
DTVLTQSPASLAVSLGQRATISCKASQSVDYRGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19931 - protein, 111 aa, Artificial Sequence
  Description of Artificial Sequence: Synthetic polypeptide
  VL of XENP020628
DTVLTQSPASLAVSLGQRATISCKASQSVDYRGDSYMNWYQQKPGQPPKLLIYAASNLESGIPARLSGSGSGTDFTLNIHPVEEEDAATYYCQQSNEDPFTFGSGTKLEVK

SEQ ID NO: 19932 - protein, 15 aa, Artificial Sequence
  Description of Artificial Sequence: Synthetic peptide
  XENP020628 vlCDR1
KASQSVDYRGDSYMN

SEQ ID NO: 19933 - protein, 7 aa, Artificial Sequence
  Description of Artificial Sequence: Synthetic peptide
  XENP020628 vlCDR2
AASNLES

SEQ ID NO: 19934 - protein, 9 aa, Artificial Sequence
  Description of Artificial Sequence: Synthetic peptide
  XENP020628 vlCDR3
QQSNEDPFT

SEQ ID NO: 19935 - protein, 450 aa, Artificial Sequence; identical to SEQ ID NO: 17585
  Description of Artificial Sequence: Synthetic polypeptide
  XENP020629 7G8_H0_L0.25_IgG1_PVA_/S267K Heavy Chain

SEQ ID NO: 19936 - protein, 121 aa, Artificial Sequence; identical to SEQ ID NO: 17586
  Description of Artificial Sequence: Synthetic polypeptide
  VH of XENP020629

SEQ ID NO: 19937 - protein, 5 aa, Artificial Sequence
  Description of Artificial Sequence: Synthetic peptide
  XENP020629 vhCDR1
DAWMD

SEQ ID NO: 19938 - protein, 19 aa, Artificial Sequence
  Description of Artificial Sequence: Synthetic peptide
  XENP020629 vhCDR2
EIRTKANNHATYYAESVKG

SEQ ID NO: 19939 - protein, 10 aa, Artificial Sequence
  Description of Artificial Sequence: Synthetic peptide
  XENP020629 vhCDR3
LANWDWYFDV

SEQ ID NO: 19940 - protein, 218 aa, Artificial Sequence
  Description of Artificial Sequence: Synthetic polypeptide
  XENP020629 7G8_H0_L0.25_IgG1_PVA_/S267K Light Chain
DTVLTQSPASLAVSLGQRATISCKASQSVDYLGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19941 - protein, 111 aa, Artificial Sequence
  Description of Artificial Sequence: Synthetic polypeptide
  VL of XENP020629
DTVLTQSPASLAVSLGQRATISCKASQSVDYLGDSYMNWYQQKPGQPPKLLIYAASNLESGIPARLSGSGSGTDFTLNIHPVEEEDAATYYCQQSNEDPFTFGSGTKLEVK

SEQ ID NO: 19942 - protein, 15 aa, Artificial Sequence
  Description of Artificial Sequence: Synthetic peptide
  XENP020629 vlCDR1
KASQSVDYLGDSYMN

SEQ ID NO: 19943 - protein, 7 aa, Artificial Sequence
  Description of Artificial Sequence: Synthetic peptide
  XENP020629 vlCDR2
AASNLES

SEQ ID NO: 19944 - protein, 9 aa, Artificial Sequence
  Description of Artificial Sequence: Synthetic peptide
  XENP020629 vlCDR3
QQSNEDPFT

SEQ ID NO: 19945 - protein, 450 aa, Artificial Sequence; identical to SEQ ID NO: 17585
  Description of Artificial Sequence: Synthetic polypeptide
  XENP020630 7G8_H0_L0.26_IgG1_PVA_/S267K Heavy Chain

SEQ ID NO: 19946 - protein, 121 aa, Artificial Sequence; identical to SEQ ID NO: 17586
  Description of Artificial Sequence: Synthetic polypeptide
  VH of XENP020630

SEQ ID NO: 19947 - protein, 5 aa, Artificial Sequence
  Description of Artificial Sequence: Synthetic peptide
  XENP020630 vhCDR1
DAWMD

SEQ ID NO: 19948 - protein, 19 aa, Artificial Sequence
  Description of Artificial Sequence: Synthetic peptide
  XENP020630 vhCDR2
EIRTKANNHATYYAESVKG

SEQ ID NO: 19949 - protein, 10 aa, Artificial Sequence
  Description of Artificial Sequence: Synthetic peptide
  XENP020630 vhCDR3
LANWDWYFDV

SEQ ID NO: 19950 - protein, 218 aa, Artificial Sequence
  Description of Artificial Sequence: Synthetic polypeptide
  XENP020630 7G8_H0_L0.26_IgG1_PVA_/S267K Light Chain
DTVLTQSPASLAVSLGQRATISCKASQSVDYTGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19951 - protein, 111 aa, Artificial Sequence
  Description of Artificial Sequence: Synthetic polypeptide
  VL of XENP020630
DTVLTQSPASLAVSLGQRATISCKASQSVDYTGDSYMNWYQQKPGQPPKLLIYAASNLESGIPARLSGSGSGTDFTLNIHPVEEEDAATYYCQQSNEDPFTFGSGTKLEVK

SEQ ID NO: 19952 - protein, 15 aa, Artificial Sequence
  Description of Artificial Sequence: Synthetic peptide
  XENP020630 vlCDR1
KASQSVDYTGDSYMN

SEQ ID NO: 19953 - protein, 7 aa, Artificial Sequence
  Description of Artificial Sequence: Synthetic peptide
  XENP020630 vlCDR2
AASNLES

SEQ ID NO: 19954 - protein, 9 aa, Artificial Sequence
  Description of Artificial Sequence: Synthetic peptide
  XENP020630 vlCDR3
QQSNEDPFT

SEQ ID NO: 19955 - protein, 450 aa, Artificial Sequence; identical to SEQ ID NO: 17585
  Description of Artificial Sequence: Synthetic polypeptide
  XENP020631 7G8_H0_L0.27_IgG1_PVA_/S267K Heavy Chain

SEQ ID NO: 19956 - protein, 121 aa, Artificial Sequence; identical to SEQ ID NO: 17586
  Description of Artificial Sequence: Synthetic polypeptide
  VH of XENP020631

SEQ ID NO: 19957 - protein, 5 aa, Artificial Sequence
  Description of Artificial Sequence: Synthetic peptide
  XENP020631 vhCDR1
DAWMD

SEQ ID NO: 19958 - protein, 19 aa, Artificial Sequence
  Description of Artificial Sequence: Synthetic peptide
  XENP020631 vhCDR2
EIRTKANNHATYYAESVKG

SEQ ID NO: 19959 - protein, 10 aa, Artificial Sequence
  Description of Artificial Sequence: Synthetic peptide
  XENP020631 vhCDR3
LANWDWYFDV

SEQ ID NO: 19960 - protein, 218 aa, Artificial Sequence
  Description of Artificial Sequence: Synthetic polypeptide
  XENP020631 7G8_H0_L0.27_IgG1_PVA_/S267K Light Chain
DTVLTQSPASLAVSLGQRATISCKASQSVDYGGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19961 - protein, 111 aa, Artificial Sequence
  Description of Artificial Sequence: Synthetic polypeptide
  VL of XENP020631
DTVLTQSPASLAVSLGQRATISCKASQSVDYGGDSYMNWYQQKPGQPPKLLIYAASNLESGIPARLSGSGSGTDFTLNIHPVEEEDAATYYCQQSNEDPFTFGSGTKLEVK

SEQ ID NO: 19962 - protein, 15 aa, Artificial Sequence
  Description of Artificial Sequence: Synthetic peptide
  XENP020631 vlCDR1
KASQSVDYGGDSYMN

SEQ ID NO: 19963 - protein, 7 aa, Artificial Sequence
  Description of Artificial Sequence: Synthetic peptide
  XENP020631 vlCDR2
AASNLES

SEQ ID NO: 19964 - protein, 9 aa, Artificial Sequence
  Description of Artificial Sequence: Synthetic peptide
  XENP020631 vlCDR3
QQSNEDPFT

SEQ ID NO: 19965 - protein, 450 aa, Artificial Sequence; identical to SEQ ID NO: 17585
  Description of Artificial Sequence: Synthetic polypeptide
  XENP020632 7G8_H0_L0.28_IgG1_PVA_/S267K Heavy Chain

SEQ ID NO: 19966 - protein, 121 aa, Artificial Sequence; identical to SEQ ID NO: 17586
  Description of Artificial Sequence: Synthetic polypeptide
  VH of XENP020632

SEQ ID NO: 19967 - protein, 5 aa, Artificial Sequence
  Description of Artificial Sequence: Synthetic peptide
  XENP020632 vhCDR1
DAWMD

SEQ ID NO: 19968 - protein, 19 aa, Artificial Sequence
  Description of Artificial Sequence: Synthetic peptide
  XENP020632 vhCDR2
EIRTKANNHATYYAESVKG

SEQ ID NO: 19969 - protein, 10 aa, Artificial Sequence
  Description of Artificial Sequence: Synthetic peptide
  XENP020632 vhCDR3
LANWDWYFDV

SEQ ID NO: 19970 - protein, 218 aa, Artificial Sequence
  Description of Artificial Sequence: Synthetic polypeptide
  XENP020632 7G8_H0_L0.28_IgG1_PVA_/S267K Light Chain
DTVLTQSPASLAVSLGQRATISCKASQSVDYYGDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19971 - protein, 111 aa, Artificial Sequence
  Description of Artificial Sequence: Synthetic polypeptide
  VL of XENP020632
DTVLTQSPASLAVSLGQRATISCKASQSVDYYGDSYMNWYQQKPGQPPKLLIYAASNLESGIPARLSGSGSGTDFTLNIHPVEEEDAATYYCQQSNEDPFTFGSGTKLEVK

SEQ ID NO: 19972 - protein, 15 aa, Artificial Sequence
  Description of Artificial Sequence: Synthetic peptide
  XENP020632 vlCDR1
KASQSVDYYGDSYMN

SEQ ID NO: 19973 - protein, 7 aa, Artificial Sequence
  Description of Artificial Sequence: Synthetic peptide
  XENP020632 vlCDR2
AASNLES

SEQ ID NO: 19974 - protein, 9 aa, Artificial Sequence
  Description of Artificial Sequence: Synthetic peptide
  XENP020632 vlCDR3
QQSNEDPFT

SEQ ID NO: 19975 - protein, 450 aa, Artificial Sequence; identical to SEQ ID NO: 17585
  Description of Artificial Sequence: Synthetic polypeptide
  XENP020633 7G8_H0_L0.29_IgG1_PVA_/S267K Heavy Chain

SEQ ID NO: 19976 - protein, 121 aa, Artificial Sequence; identical to SEQ ID NO: 17586
  Description of Artificial Sequence: Synthetic polypeptide
  VH of XENP020633

SEQ ID NO: 19977 - protein, 5 aa, Artificial Sequence
  Description of Artificial Sequence: Synthetic peptide
  XENP020633 vhCDR1
DAWMD

SEQ ID NO: 19978 - protein, 19 aa, Artificial Sequence
  Description of Artificial Sequence: Synthetic peptide
  XENP020633 vhCDR2
EIRTKANNHATYYAESVKG

SEQ ID NO: 19979 - protein, 10 aa, Artificial Sequence
  Description of Artificial Sequence: Synthetic peptide
  XENP020633 vhCDR3
LANWDWYFDV

SEQ ID NO: 19980 - protein, 218 aa, Artificial Sequence
  Description of Artificial Sequence: Synthetic polypeptide
  XENP020633 7G8_H0_L0.29_IgG1_PVA_/S267K Light Chain
DTVLTQSPASLAVSLGQRATISCKASQSVDYDADSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19981 - protein, 111 aa, Artificial Sequence
  Description of Artificial Sequence: Synthetic polypeptide
  VL of XENP020633
DTVLTQSPASLAVSLGQRATISCKASQSVDYDADSYMNWYQQKPGQPPKLLIYAASNLESGIPARLSGSGSGTDFTLNIHPVEEEDAATYYCQQSNEDPFTFGSGTKLEVK

SEQ ID NO: 19982 - protein, 15 aa, Artificial Sequence
  Description of Artificial Sequence: Synthetic peptide
  XENP020633 vlCDR1
KASQSVDYDADSYMN

SEQ ID NO: 19983 - protein, 7 aa, Artificial Sequence
  Description of Artificial Sequence: Synthetic peptide
  XENP020633 vlCDR2
AASNLES

SEQ ID NO: 19984 - protein, 9 aa, Artificial Sequence
  Description of Artificial Sequence: Synthetic peptide
  XENP020633 vlCDR3
QQSNEDPFT

SEQ ID NO: 19985 - protein, 450 aa, Artificial Sequence; identical to SEQ ID NO: 17585
  Description of Artificial Sequence: Synthetic polypeptide
  XENP020634 7G8_H0_L0.30_IgG1_PVA_/S267K Heavy Chain

SEQ ID NO: 19986 - protein, 121 aa, Artificial Sequence; identical to SEQ ID NO: 17586
  Description of Artificial Sequence: Synthetic polypeptide
  VH of XENP020634

SEQ ID NO: 19987 - protein, 5 aa, Artificial Sequence
  Description of Artificial Sequence: Synthetic peptide
  XENP020634 vhCDR1
DAWMD

SEQ ID NO: 19988 - protein, 19 aa, Artificial Sequence
  Description of Artificial Sequence: Synthetic peptide
  XENP020634 vhCDR2
EIRTKANNHATYYAESVKG

SEQ ID NO: 19989 - protein, 10 aa, Artificial Sequence
  Description of Artificial Sequence: Synthetic peptide
  XENP020634 vhCDR3
LANWDWYFDV

SEQ ID NO: 19990 - protein, 218 aa, Artificial Sequence
  Description of Artificial Sequence: Synthetic polypeptide
  XENP020634 7G8_H0_L0.30_IgG1_PVA_/S267K Light Chain
DTVLTQSPASLAVSLGQRATISCKASQSVDYDSDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19991 - protein, 111 aa, Artificial Sequence
  Description of Artificial Sequence: Synthetic polypeptide
  VL of XENP020634
DTVLTQSPASLAVSLGQRATISCKASQSVDYDSDSYMNWYQQKPGQPPKLLIYAASNLESGIPARLSGSGSGTDFTLNIHPVEEEDAATYYCQQSNEDPFTFGSGTKLEVK

SEQ ID NO: 19992 - protein, 15 aa, Artificial Sequence
  Description of Artificial Sequence: Synthetic peptide
  XENP020634 vlCDR1
KASQSVDYDSDSYMN

SEQ ID NO: 19993 - protein, 7 aa, Artificial Sequence
  Description of Artificial Sequence: Synthetic peptide
  XENP020634 vlCDR2
AASNLES

SEQ ID NO: 19994 - protein, 9 aa, Artificial Sequence
  Description of Artificial Sequence: Synthetic peptide
  XENP020634 vlCDR3
QQSNEDPFT

SEQ ID NO: 19995 - protein, 450 aa, Artificial Sequence; identical to SEQ ID NO: 17585
  Description of Artificial Sequence: Synthetic polypeptide
  XENP020635 7G8_H0_L0.31_IgG1_PVA_/S267K Heavy Chain

SEQ ID NO: 19996 - protein, 121 aa, Artificial Sequence; identical to SEQ ID NO: 17586
  Description of Artificial Sequence: Synthetic polypeptide
  VH of XENP020635

SEQ ID NO: 19997 - protein, 5 aa, Artificial Sequence
  Description of Artificial Sequence: Synthetic peptide
  XENP020635 vhCDR1
DAWMD

SEQ ID NO: 19998 - protein, 19 aa, Artificial Sequence
  Description of Artificial Sequence: Synthetic peptide
  XENP020635 vhCDR2
EIRTKANNHATYYAESVKG

SEQ ID NO: 19999 - protein, 10 aa, Artificial Sequence
  Description of Artificial Sequence: Synthetic peptide
  XENP020635 vhCDR3
LANWDWYFDV

SEQ ID NO: 20000 - protein, 218 aa, Artificial Sequence
  Description of Artificial Sequence: Synthetic polypeptide
  XENP020635 7G8_H0_L0.31_IgG1_PVA_/S267K Light Chain
DTVLTQSPASLAVSLGQRATISCKASQSVDYDTDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20001 - protein, 111 aa, Artificial Sequence
  Description of Artificial Sequence: Synthetic polypeptide
  VL of XENP020635
DTVLTQSPASLAVSLGQRATISCKASQSVDYDTDSYMNWYQQKPGQPPKLLIYAASNLESGIPARLSGSGSGTDFTLNIHPVEEEDAATYYCQQSNEDPFTFGSGTKLEVK

SEQ ID NO: 20002 - protein, 15 aa, Artificial Sequence
  Description of Artificial Sequence: Synthetic peptide
  XENP020635 vlCDR1
KASQSVDYDTDSYMN

SEQ ID NO: 20003 - protein, 7 aa, Artificial Sequence
  Description of Artificial Sequence: Synthetic peptide
  XENP020635 vlCDR2
AASNLES

SEQ ID NO: 20004 - protein, 9 aa, Artificial Sequence
  Description of Artificial Sequence: Synthetic peptide
  XENP020635 vlCDR3
QQSNEDPFT

SEQ ID NO: 20005 - protein, 450 aa, Artificial Sequence; identical to SEQ ID NO: 17585
  Description of Artificial Sequence: Synthetic polypeptide
  XENP020636 7G8_H0_L0.32_IgG1_PVA_/S267K Heavy Chain

SEQ ID NO: 20006 - protein, 121 aa, Artificial Sequence; identical to SEQ ID NO: 17586
  Description of Artificial Sequence: Synthetic polypeptide
  VH of XENP020636

SEQ ID NO: 20007 - protein, 5 aa, Artificial Sequence
  Description of Artificial Sequence: Synthetic peptide
  XENP020636 vhCDR1
DAWMD

SEQ ID NO: 20008 - protein, 19 aa, Artificial Sequence
  Description of Artificial Sequence: Synthetic peptide
  XENP020636 vhCDR2
EIRTKANNHATYYAESVKG

SEQ ID NO: 20009 - protein, 10 aa, Artificial Sequence
  Description of Artificial Sequence: Synthetic peptide
  XENP020636 vhCDR3
LANWDWYFDV

SEQ ID NO: 20010 - protein, 218 aa, Artificial Sequence
  Description of Artificial Sequence: Synthetic polypeptide
  XENP020636 7G8_H0_L0.32_IgG1_PVA_/S267K Light Chain
DTVLTQSPASLAVSLGQRATISCKASQSVDYDQDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20011 - protein, 111 aa, Artificial Sequence
  Description of Artificial Sequence: Synthetic polypeptide
  VL of XENP020636
DTVLTQSPASLAVSLGQRATISCKASQSVDYDQDSYMNWYQQKPGQPPKLLIYAASNLESGIPARLSGSGSGTDFTLNIHPVEEEDAATYYCQQSNEDPFTFGSGTKLEVK

SEQ ID NO: 20012 - protein, 15 aa, Artificial Sequence
  Description of Artificial Sequence: Synthetic peptide
  XENP020636 vlCDR1
KASQSVDYDQDSYMN

SEQ ID NO: 20013 - protein, 7 aa, Artificial Sequence
  Description of Artificial Sequence: Synthetic peptide
  XENP020636 vlCDR2
AASNLES

SEQ ID NO: 20014 - protein, 9 aa, Artificial Sequence
  Description of Artificial Sequence: Synthetic peptide
  XENP020636 vlCDR3
QQSNEDPFT

SEQ ID NO: 20015 - protein, 450 aa, Artificial Sequence; identical to SEQ ID NO: 17585
  Description of Artificial Sequence: Synthetic polypeptide
  XENP020637 7G8_H0_L0.33_IgG1_PVA_/S267K Heavy Chain

SEQ ID NO: 20016 - protein, 121 aa, Artificial Sequence; identical to SEQ ID NO: 17586
  Description of Artificial Sequence: Synthetic polypeptide
  VH of XENP020637

SEQ ID NO: 20017 - protein, 5 aa, Artificial Sequence
  Description of Artificial Sequence: Synthetic peptide
  XENP020637 vhCDR1
DAWMD

SEQ ID NO: 20018 - protein, 19 aa, Artificial Sequence
  Description of Artificial Sequence: Synthetic peptide
  XENP020637 vhCDR2
EIRTKANNHATYYAESVKG

SEQ ID NO: 20019 - protein, 10 aa, Artificial Sequence
  Description of Artificial Sequence: Synthetic peptide
  XENP020637 vhCDR3
LANWDWYFDV

SEQ ID NO: 20020 - protein, 218 aa, Artificial Sequence
  Description of Artificial Sequence: Synthetic polypeptide
  XENP020637 7G8_H0_L0.33_IgG1_PVA_/S267K Light Chain
DTVLTQSPASLAVSLGQRATISCKASQSVDYDHDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20021 - protein, 111 aa, Artificial Sequence
  Description of Artificial Sequence: Synthetic polypeptide
  VL of XENP020637
DTVLTQSPASLAVSLGQRATISCKASQSVDYDHDSYMNWYQQKPGQPPKLLIYAASNLESGIPARLSGSGSGTDFTLNIHPVEEEDAATYYCQQSNEDPFTFGSGTKLEVK

SEQ ID NO: 20022 - protein, 15 aa, Artificial Sequence
  Description of Artificial Sequence: Synthetic peptide
  XENP020637 vlCDR1
KASQSVDYDHDSYMN

SEQ ID NO: 20023 - protein, 7 aa, Artificial Sequence
  Description of Artificial Sequence: Synthetic peptide
  XENP020637 vlCDR2
AASNLES

SEQ ID NO: 20024 - protein, 9 aa, Artificial Sequence
  Description of Artificial Sequence: Synthetic peptide
  XENP020637 vlCDR3
QQSNEDPFT

SEQ ID NO: 20025 - protein, 450 aa, Artificial Sequence; identical to SEQ ID NO: 17585
  Description of Artificial Sequence: Synthetic polypeptide
  XENP020638 7G8_H0_L0.34_IgG1_PVA_/S267K Heavy Chain

SEQ ID NO: 20026 - protein, 121 aa, Artificial Sequence; identical to SEQ ID NO: 17586
  Description of Artificial Sequence: Synthetic polypeptide
  VH of XENP020638

SEQ ID NO: 20027 - protein, 5 aa, Artificial Sequence
  Description of Artificial Sequence: Synthetic peptide
  XENP020638 vhCDR1
DAWMD

SEQ ID NO: 20028 - protein, 19 aa, Artificial Sequence
  Description of Artificial Sequence: Synthetic peptide
  XENP020638 vhCDR2
EIRTKANNHATYYAESVKG

SEQ ID NO: 20029 - protein, 10 aa, Artificial Sequence
  Description of Artificial Sequence: Synthetic peptide
  XENP020638 vhCDR3
LANWDWYFDV

SEQ ID NO: 20030 - protein, 218 aa, Artificial Sequence
  Description of Artificial Sequence: Synthetic polypeptide
  XENP020638 7G8_H0_L0.34_IgG1_PVA_/S267K Light Chain
DTVLTQSPASLAVSLGQRATISCKASQSVDYDDDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20031 - protein, 111 aa, Artificial Sequence
  Description of Artificial Sequence: Synthetic polypeptide
  VL of XENP020638
DTVLTQSPASLAVSLGQRATISCKASQSVDYDDDSYMNWYQQKPGQPPKLLIYAASNLESGIPARLSGSGSGTDFTLNIHPVEEEDAATYYCQQSNEDPFTFGSGTKLEVK

SEQ ID NO: 20032 - protein, 15 aa, Artificial Sequence
  Description of Artificial Sequence: Synthetic peptide
  XENP020638 vlCDR1
KASQSVDYDDDSYMN

SEQ ID NO: 20033 - protein, 7 aa, Artificial Sequence
  Description of Artificial Sequence: Synthetic peptide
  XENP020638 vlCDR2
AASNLES

SEQ ID NO: 20034 - protein, 9 aa, Artificial Sequence
  Description of Artificial Sequence: Synthetic peptide
  XENP020638 vlCDR3
QQSNEDPFT

SEQ ID NO: 20035 - protein, 450 aa, Artificial Sequence; identical to SEQ ID NO: 17585
  Description of Artificial Sequence: Synthetic polypeptide
  XENP020639 7G8_H0_L0.35_IgG1_PVA_/S267K Heavy Chain

SEQ ID NO: 20036 - protein, 121 aa, Artificial Sequence; identical to SEQ ID NO: 17586
  Description of Artificial Sequence: Synthetic polypeptide
  VH of XENP020639

SEQ ID NO: 20037 - protein, 5 aa, Artificial Sequence
  Description of Artificial Sequence: Synthetic peptide
  XENP020639 vhCDR1
DAWMD

SEQ ID NO: 20038 - protein, 19 aa, Artificial Sequence
  Description of Artificial Sequence: Synthetic peptide
  XENP020639 vhCDR2
EIRTKANNHATYYAESVKG

SEQ ID NO: 20039 - protein, 10 aa, Artificial Sequence
  Description of Artificial Sequence: Synthetic peptide
  XENP020639 vhCDR3
LANWDWYFDV

SEQ ID NO: 20040 - protein, 218 aa, Artificial Sequence
  Description of Artificial Sequence: Synthetic polypeptide
  XENP020639 7G8_H0_L0.35_IgG1_PVA_/S267K Light Chain
DTVLTQSPASLAVSLGQRATISCKASQSVDYDKDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20041 - protein, 111 aa, Artificial Sequence
  Description of Artificial Sequence: Synthetic polypeptide
  VL of XENP020639
DTVLTQSPASLAVSLGQRATISCKASQSVDYDKDSYMNWYQQKPGQPPKLLIYAASNLESGIPARLSGSGSGTDFTLNIHPVEEEDAATYYCQQSNEDPFTFGSGTKLEVK

SEQ ID NO: 20042 - protein, 15 aa, Artificial Sequence
  Description of Artificial Sequence: Synthetic peptide
  XENP020639 vlCDR1
KASQSVDYDKDSYMN

SEQ ID NO: 20043 - protein, 7 aa, Artificial Sequence
  Description of Artificial Sequence: Synthetic peptide
  XENP020639 vlCDR2
AASNLES

SEQ ID NO: 20044 - protein, 9 aa, Artificial Sequence
  Description of Artificial Sequence: Synthetic peptide
  XENP020639 vlCDR3
QQSNEDPFT

SEQ ID NO: 20045 - protein, 450 aa, Artificial Sequence; identical to SEQ ID NO: 17585
  Description of Artificial Sequence: Synthetic polypeptide
  XENP020640 7G8_H0_L0.36_IgG1_PVA_/S267K Heavy Chain

SEQ ID NO: 20046 - protein, 121 aa, Artificial Sequence; identical to SEQ ID NO: 17586
  Description of Artificial Sequence: Synthetic polypeptide
  VH of XENP020640

SEQ ID NO: 20047 - protein, 5 aa, Artificial Sequence
  Description of Artificial Sequence: Synthetic peptide
  XENP020640 vhCDR1
DAWMD

SEQ ID NO: 20048 - protein, 19 aa, Artificial Sequence
  Description of Artificial Sequence: Synthetic peptide
  XENP020640 vhCDR2
EIRTKANNHATYYAESVKG

SEQ ID NO: 20049 - protein, 10 aa, Artificial Sequence
  Description of Artificial Sequence: Synthetic peptide
  XENP020640 vhCDR3
LANWDWYFDV

SEQ ID NO: 20050 - protein, 218 aa, Artificial Sequence
  Description of Artificial Sequence: Synthetic polypeptide
  XENP020640 7G8_H0_L0.36_IgG1_PVA_/S267K Light Chain
DTVLTQSPASLAVSLGQRATISCKASQSVDYDLDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20051 - protein, 111 aa, Artificial Sequence
  Description of Artificial Sequence: Synthetic polypeptide
  VL of XENP020640
DTVLTQSPASLAVSLGQRATISCKASQSVDYDLDSYMNWYQQKPGQPPKLLIYAASNLESGIPARLSGSGSGTDFTLNIHPVEEEDAATYYCQQSNEDPFTFGSGTKLEVK

SEQ ID NO: 20052 - protein, 15 aa, Artificial Sequence
  Description of Artificial Sequence: Synthetic peptide
  XENP020640 vlCDR1
KASQSVDYDLDSYMN

SEQ ID NO: 20053 - protein, 7 aa, Artificial Sequence
  Description of Artificial Sequence: Synthetic peptide
  XENP020640 vlCDR2
AASNLES

SEQ ID NO: 20054 - protein, 9 aa, Artificial Sequence
  Description of Artificial Sequence: Synthetic peptide
  XENP020640 vlCDR3
QQSNEDPFT

SEQ ID NO: 20055 - protein, 450 aa, Artificial Sequence; identical to SEQ ID NO: 17585
  Description of Artificial Sequence: Synthetic polypeptide
  XENP020641 7G8_H0_L0.37_IgG1_PVA_/S267K Heavy Chain

SEQ ID NO: 20056 - protein, 121 aa, Artificial Sequence; identical to SEQ ID NO: 17586
  Description of Artificial Sequence: Synthetic polypeptide
  VH of XENP020641

SEQ ID NO: 20057 - protein, 5 aa, Artificial Sequence
  Description of Artificial Sequence: Synthetic peptide
  XENP020641 vhCDR1
DAWMD

SEQ ID NO: 20058 - protein, 19 aa, Artificial Sequence
  Description of Artificial Sequence: Synthetic peptide
  XENP020641 vhCDR2
EIRTKANNHATYYAESVKG

SEQ ID NO: 20059 - protein, 10 aa, Artificial Sequence
  Description of Artificial Sequence: Synthetic peptide
  XENP020641 vhCDR3
LANWDWYFDV

SEQ ID NO: 20060 - protein, 218 aa, Artificial Sequence
  Description of Artificial Sequence: Synthetic polypeptide
  XENP020641 7G8_H0_L0.37_IgG1_PVA_/S267K Light Chain
DTVLTQSPASLAVSLGQRATISCKASQSVDYDYDSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20061 - protein, 111 aa, Artificial Sequence
  Description of Artificial Sequence: Synthetic polypeptide
  VL of XENP020641
DTVLTQSPASLAVSLGQRATISCKASQSVDYDYDSYMNWYQQKPGQPPKLLIYAASNLESGIPARLSGSGSGTDFTLNIHPVEEEDAATYYCQQSNEDPFTFGSGTKLEVK

SEQ ID NO: 20062 - protein, 15 aa, Artificial Sequence
  Description of Artificial Sequence: Synthetic peptide
  XENP020641 vlCDR1
KASQSVDYDYDSYMN

SEQ ID NO: 20063 - protein, 7 aa, Artificial Sequence
  Description of Artificial Sequence: Synthetic peptide
  XENP020641 vlCDR2
AASNLES

SEQ ID NO: 20064 - protein, 9 aa, Artificial Sequence
  Description of Artificial Sequence: Synthetic peptide
  XENP020641 vlCDR3
QQSNEDPFT

SEQ ID NO: 20065 - protein, 450 aa, Artificial Sequence; identical to SEQ ID NO: 17585
  Description of Artificial Sequence: Synthetic polypeptide
  XENP020642 7G8_H0_L0.38_IgG1_PVA_/S267K Heavy Chain

SEQ ID NO: 20066 - protein, 121 aa, Artificial Sequence; identical to SEQ ID NO: 17586
  Description of Artificial Sequence: Synthetic polypeptide
  VH of XENP020642

SEQ ID NO: 20067 - protein, 5 aa, Artificial Sequence
  Description of Artificial Sequence: Synthetic peptide
  XENP020642 vhCDR1
DAWMD

SEQ ID NO: 20068 - protein, 19 aa, Artificial Sequence
  Description of Artificial Sequence: Synthetic peptide
  XENP020642 vhCDR2
EIRTKANNHATYYAESVKG

SEQ ID NO: 20069 - protein, 10 aa, Artificial Sequence
  Description of Artificial Sequence: Synthetic peptide
  XENP020642 vhCDR3
LANWDWYFDV

SEQ ID NO: 20070 - protein, 218 aa, Artificial Sequence
  Description of Artificial Sequence: Synthetic polypeptide
  XENP020642 7G8_H0_L0.38_IgG1_PVA_/S267K Light Chain
DTVLTQSPASLAVSLGQRATISCKASQSVDYDGNSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20071 - protein, 111 aa, Artificial Sequence
  Description of Artificial Sequence: Synthetic polypeptide
  VL of XENP020642
DTVLTQSPASLAVSLGQRATISCKASQSVDYDGNSYMNWYQQKPGQPPKLLIYAASNLESGIPARLSGSGSGTDFTLNIHPVEEEDAATYYCQQSNEDPFTFGSGTKLEVK

SEQ ID NO: 20072 - protein, 15 aa, Artificial Sequence
  Description of Artificial Sequence: Synthetic peptide
  XENP020642 vlCDR1
KASQSVDYDGNSYMN

SEQ ID NO: 20073 - protein, 7 aa, Artificial Sequence
  Description of Artificial Sequence: Synthetic peptide
  XENP020642 vlCDR2
AASNLES

SEQ ID NO: 20074 - protein, 9 aa, Artificial Sequence
  Description of Artificial Sequence: Synthetic peptide
  XENP020642 vlCDR3
QQSNEDPFT

SEQ ID NO: 20075 - protein, 450 aa, Artificial Sequence; identical to SEQ ID NO: 17585
  Description of Artificial Sequence: Synthetic polypeptide
  XENP020643 7G8_H0_L0.39_IgG1_PVA_/S267K Heavy Chain

SEQ ID NO: 20076 - protein, 121 aa, Artificial Sequence; identical to SEQ ID NO: 17586
  Description of Artificial Sequence: Synthetic polypeptide
  VH of XENP020643

SEQ ID NO: 20077 - protein, 5 aa, Artificial Sequence
  Description of Artificial Sequence: Synthetic peptide
  XENP020643 vhCDR1
DAWMD

SEQ ID NO: 20078 - protein, 19 aa, Artificial Sequence
  Description of Artificial Sequence: Synthetic peptide
  XENP020643 vhCDR2
EIRTKANNHATYYAESVKG

SEQ ID NO: 20079 - protein, 10 aa, Artificial Sequence
  Description of Artificial Sequence: Synthetic peptide
  XENP020643 vhCDR3
LANWDWYFDV

SEQ ID NO: 20080 - protein, 218 aa, Artificial Sequence
  Description of Artificial Sequence: Synthetic polypeptide
  XENP020643 7G8_H0_L0.39_IgG1_PVA_/S267K Light Chain
DTVLTQSPASLAVSLGQRATISCKASQSVDYDGESYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20081 - protein, 111 aa, Artificial Sequence
  Description of Artificial Sequence: Synthetic polypeptide
  VL of XENP020643
DTVLTQSPASLAVSLGQRATISCKASQSVDYDGESYMNWYQQKPGQPPKLLIYAASNLESGIPARLSGSGSGTDFTLNIHPVEEEDAATYYCQQSNEDPFTFGSGTKLEVK

SEQ ID NO: 20082 - protein, 15 aa, Artificial Sequence
  Description of Artificial Sequence: Synthetic peptide
  XENP020643 vlCDR1
KASQSVDYDGESYMN

SEQ ID NO: 20083 - protein, 7 aa, Artificial Sequence
  Description of Artificial Sequence: Synthetic peptide
  XENP020643 vlCDR2
AASNLES

SEQ ID NO: 20084 - protein, 9 aa, Artificial Sequence
  Description of Artificial Sequence: Synthetic peptide
  XENP020643 vlCDR3
QQSNEDPFT

SEQ ID NO: 20085 - protein, 450 aa, Artificial Sequence; identical to SEQ ID NO: 17585
  Description of Artificial Sequence: Synthetic polypeptide
  XENP020644 7G8_H0_L0.40_IgG1_PVA_/S267K Heavy Chain

SEQ ID NO: 20086 - protein, 121 aa, Artificial Sequence; identical to SEQ ID NO: 17586
  Description of Artificial Sequence: Synthetic polypeptide
  VH of XENP020644

SEQ ID NO: 20087 - protein, 5 aa, Artificial Sequence
  Description of Artificial Sequence: Synthetic peptide
  XENP020644 vhCDR1
DAWMD

SEQ ID NO: 20088 - protein, 19 aa, Artificial Sequence
  Description of Artificial Sequence: Synthetic peptide
  XENP020644 vhCDR2
EIRTKANNHATYYAESVKG

SEQ ID NO: 20089 - protein, 10 aa, Artificial Sequence
  Description of Artificial Sequence: Synthetic peptide
  XENP020644 vhCDR3
LANWDWYFDV

SEQ ID NO: 20090 - protein, 218 aa, Artificial Sequence
  Description of Artificial Sequence: Synthetic polypeptide
  XENP020644 7G8_H0_L0.40_IgG1_PVA_/S267K Light Chain
DTVLTQSPASLAVSLGQRATISCKASQSVDYDGHSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20091 - protein, 111 aa, Artificial Sequence
  Description of Artificial Sequence: Synthetic polypeptide
  VL of XENP020644
DTVLTQSPASLAVSLGQRATISCKASQSVDYDGHSYMNWYQQKPGQPPKLLIYAASNLESGIPARLSGSGSGTDFTLNIHPVEEEDAATYYCQQSNEDPFTFGSGTKLEVK

SEQ ID NO: 20092 - protein, 15 aa, Artificial Sequence
  Description of Artificial Sequence: Synthetic peptide
  XENP020644 vlCDR1
KASQSVDYDGHSYMN

SEQ ID NO: 20093 - protein, 7 aa, Artificial Sequence
  Description of Artificial Sequence: Synthetic peptide
  XENP020644 vlCDR2
AASNLES

SEQ ID NO: 20094 - protein, 9 aa, Artificial Sequence
  Description of Artificial Sequence: Synthetic peptide
  XENP020644 vlCDR3
QQSNEDPFT

SEQ ID NO: 20095 - protein, 450 aa, Artificial Sequence; identical to SEQ ID NO: 17585
  Description of Artificial Sequence: Synthetic polypeptide
  XENP020645 7G8_H0_L0.41_IgG1_PVA_/S267K Heavy Chain

SEQ ID NO: 20096 - protein, 121 aa, Artificial Sequence; identical to SEQ ID NO: 17586
  Description of Artificial Sequence: Synthetic polypeptide
  VH of XENP020645

SEQ ID NO: 20097 - protein, 5 aa, Artificial Sequence
  Description of Artificial Sequence: Synthetic peptide
  XENP020645 vhCDR1
DAWMD

SEQ ID NO: 20098 - protein, 19 aa, Artificial Sequence
  Description of Artificial Sequence: Synthetic peptide
  XENP020645 vhCDR2
EIRTKANNHATYYAESVKG

SEQ ID NO: 20099 - protein, 10 aa, Artificial Sequence
  Description of Artificial Sequence: Synthetic peptide
  XENP020645 vhCDR3
LANWDWYFDV

SEQ ID NO: 20100 - protein, 218 aa, Artificial Sequence
  Description of Artificial Sequence: Synthetic polypeptide
  XENP020645 7G8_H0_L0.41_IgG1_PVA_/S267K Light Chain
DTVLTQSPASLAVSLGQRATISCKASQSVDYDGSSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20101 - protein, 111 aa, Artificial Sequence
  Description of Artificial Sequence: Synthetic polypeptide
  VL of XENP020645
DTVLTQSPASLAVSLGQRATISCKASQSVDYDGSSYMNWYQQKPGQPPKLLIYAASNLESGIPARLSGSGSGTDFTLNIHPVEEEDAATYYCQQSNEDPFTFGSGTKLEVK

SEQ ID NO: 20102 - protein, 15 aa, Artificial Sequence
  Description of Artificial Sequence: Synthetic peptide
  XENP020645 vlCDR1
KASQSVDYDGSSYMN

SEQ ID NO: 20103 - protein, 7 aa, Artificial Sequence
  Description of Artificial Sequence: Synthetic peptide
  XENP020645 vlCDR2
AASNLES

SEQ ID NO: 20104 - protein, 9 aa, Artificial Sequence
  Description of Artificial Sequence: Synthetic peptide
  XENP020645 vlCDR3
QQSNEDPFT

SEQ ID NO: 20105 - protein, 450 aa, Artificial Sequence; identical to SEQ ID NO: 17585
  Description of Artificial Sequence: Synthetic polypeptide
  XENP020646 7G8_H0_L0.42_IgG1_PVA_/S267K Heavy Chain

SEQ ID NO: 20106 - protein, 121 aa, Artificial Sequence; identical to SEQ ID NO: 17586
  Description of Artificial Sequence: Synthetic polypeptide
  VH of XENP020646

SEQ ID NO: 20107 - protein, 5 aa, Artificial Sequence
  Description of Artificial Sequence: Synthetic peptide
  XENP020646 vhCDR1
DAWMD

SEQ ID NO: 20108 - protein, 19 aa, Artificial Sequence
  Description of Artificial Sequence: Synthetic peptide
  XENP020646 vhCDR2
EIRTKANNHATYYAESVKG

SEQ ID NO: 20109 - protein, 10 aa, Artificial Sequence
  Description of Artificial Sequence: Synthetic peptide
  XENP020646 vhCDR3
LANWDWYFDV

SEQ ID NO: 20110 - protein, 218 aa, Artificial Sequence
  Description of Artificial Sequence: Synthetic polypeptide
  XENP020646 7G8_H0_L0.42_IgG1_PVA_/S267K Light Chain
DTVLTQSPASLAVSLGQRATISCKASQSVDYDGRSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20111 - protein, 111 aa, Artificial Sequence
  Description of Artificial Sequence: Synthetic polypeptide
  VL of XENP020646
DTVLTQSPASLAVSLGQRATISCKASQSVDYDGRSYMNWYQQKPGQPPKLLIYAASNLESGIPARLSGSGSGTDFTLNIHPVEEEDAATYYCQQSNEDPFTFGSGTKLEVK

SEQ ID NO: 20112 - protein, 15 aa, Artificial Sequence
  Description of Artificial Sequence: Synthetic peptide
  XENP020646 vlCDR1
KASQSVDYDGRSYMN

SEQ ID NO: 20113 - protein, 7 aa, Artificial Sequence
  Description of Artificial Sequence: Synthetic peptide
  XENP020646 vlCDR2
AASNLES

SEQ ID NO: 20114 - protein, 9 aa, Artificial Sequence
  Description of Artificial Sequence: Synthetic peptide
  XENP020646 vlCDR3
QQSNEDPFT

SEQ ID NO: 20115 - protein, 450 aa, Artificial Sequence; identical to SEQ ID NO: 17585
  Description of Artificial Sequence: Synthetic polypeptide
  XENP020647 7G8_H0_L0.43_IgG1_PVA_/S267K Heavy Chain

SEQ ID NO: 20116 - protein, 121 aa, Artificial Sequence; identical to SEQ ID NO: 17586
  Description of Artificial Sequence: Synthetic polypeptide
  VH of XENP020647

SEQ ID NO: 20117 - protein, 5 aa, Artificial Sequence
  Description of Artificial Sequence: Synthetic peptide
  XENP020647 vhCDR1
DAWMD

SEQ ID NO: 20118 - protein, 19 aa, Artificial Sequence
  Description of Artificial Sequence: Synthetic peptide
  XENP020647 vhCDR2
EIRTKANNHATYYAESVKG

SEQ ID NO: 20119 - protein, 10 aa, Artificial Sequence
  Description of Artificial Sequence: Synthetic peptide
  XENP020647 vhCDR3
LANWDWYFDV

SEQ ID NO: 20120 - protein, 218 aa, Artificial Sequence
  Description of Artificial Sequence: Synthetic polypeptide
  XENP020647 7G8_H0_L0.43_IgG1_PVA_/S267K Light Chain
DTVLTQSPASLAVSLGQRATISCKASQSVDYDGLSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20121 - protein, 111 aa, Artificial Sequence
  Description of Artificial Sequence: Synthetic polypeptide
  VL of XENP020647
DTVLTQSPASLAVSLGQRATISCKASQSVDYDGLSYMNWYQQKPGQPPKLLIYAASNLESGIPARLSGSGSGTDFTLNIHPVEEEDAATYYCQQSNEDPFTFGSGTKLEVK

SEQ ID NO: 20122 - protein, 15 aa, Artificial Sequence
  Description of Artificial Sequence: Synthetic peptide
  XENP020647 vlCDR1
KASQSVDYDGLSYMN

SEQ ID NO: 20123 - protein, 7 aa, Artificial Sequence
  Description of Artificial Sequence: Synthetic peptide
  XENP020647 vlCDR2
AASNLES

SEQ ID NO: 20124 - protein, 9 aa, Artificial Sequence
  Description of Artificial Sequence: Synthetic peptide
  XENP020647 vlCDR3
QQSNEDPFT

SEQ ID NO: 20125 - protein, 450 aa, Artificial Sequence; identical to SEQ ID NO: 17585
  Description of Artificial Sequence: Synthetic polypeptide
  XENP020648 7G8_H0_L0.44_IgG1_PVA_/S267K Heavy Chain

SEQ ID NO: 20126 - protein, 121 aa, Artificial Sequence; identical to SEQ ID NO: 17586
  Description of Artificial Sequence: Synthetic polypeptide
  VH of XENP020648

SEQ ID NO: 20127 - protein, 5 aa, Artificial Sequence
  Description of Artificial Sequence: Synthetic peptide
  XENP020648 vhCDR1
DAWMD

SEQ ID NO: 20128 - protein, 19 aa, Artificial Sequence
  Description of Artificial Sequence: Synthetic peptide
  XENP020648 vhCDR2
EIRTKANNHATYYAESVKG

SEQ ID NO: 20129 - protein, 10 aa, Artificial Sequence
  Description of Artificial Sequence: Synthetic peptide
  XENP020648 vhCDR3
LANWDWYFDV

SEQ ID NO: 20130 - protein, 218 aa, Artificial Sequence
  Description of Artificial Sequence: Synthetic polypeptide
  XENP020648 7G8_H0_L0.44_IgG1_PVA_/S267K Light Chain
DTVLTQSPASLAVSLGQRATISCKASQSVDYDGTSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20131 - protein, 111 aa, Artificial Sequence
  Description of Artificial Sequence: Synthetic polypeptide
  VL of XENP020648
DTVLTQSPASLAVSLGQRATISCKASQSVDYDGTSYMNWYQQKPGQPPKLLIYAASNLESGIPARLSGSGSGTDFTLNIHPVEEEDAATYYCQQSNEDPFTFGSGTKLEVK

SEQ ID NO: 20132 - protein, 15 aa, Artificial Sequence
  Description of Artificial Sequence: Synthetic peptide
  XENP020648 vlCDR1
KASQSVDYDGTSYMN

SEQ ID NO: 20133 - protein, 7 aa, Artificial Sequence
  Description of Artificial Sequence: Synthetic peptide
  XENP020648 vlCDR2
AASNLES

SEQ ID NO: 20134 - protein, 9 aa, Artificial Sequence
  Description of Artificial Sequence: Synthetic peptide
  XENP020648 vlCDR3
QQSNEDPFT

SEQ ID NO: 20135 - protein, 450 aa, Artificial Sequence; identical to SEQ ID NO: 17585
  Description of Artificial Sequence: Synthetic polypeptide
  XENP020649 7G8_H0_L0.45_IgG1_PVA_/S267K Heavy Chain

SEQ ID NO: 20136 - protein, 121 aa, Artificial Sequence; identical to SEQ ID NO: 17586
  Description of Artificial Sequence: Synthetic polypeptide
  VH of XENP020649

SEQ ID NO: 20137 - protein, 5 aa, Artificial Sequence
  Description of Artificial Sequence: Synthetic peptide
  XENP020649 vhCDR1
DAWMD

SEQ ID NO: 20138 - protein, 19 aa, Artificial Sequence
  Description of Artificial Sequence: Synthetic peptide
  XENP020649 vhCDR2
EIRTKANNHATYYAESVKG

SEQ ID NO: 20139 - protein, 10 aa, Artificial Sequence
  Description of Artificial Sequence: Synthetic peptide
  XENP020649 vhCDR3
LANWDWYFDV

SEQ ID NO: 20140 - protein, 218 aa, Artificial Sequence
  Description of Artificial Sequence: Synthetic polypeptide
  XENP020649 7G8_H0_L0.45_IgG1_PVA_/S267K Light Chain
DTVLTQSPASLAVSLGQRATISCKASQSVDYDGGSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20141 - protein, 111 aa, Artificial Sequence
  Description of Artificial Sequence: Synthetic polypeptide
  VL of XENP020649
DTVLTQSPASLAVSLGQRATISCKASQSVDYDGGSYMNWYQQKPGQPPKLLIYAASNLESGIPARLSGSGSGTDFTLNIHPVEEEDAATYYCQQSNEDPFTFGSGTKLEVK

SEQ ID NO: 20142 - protein, 15 aa, Artificial Sequence
  Description of Artificial Sequence: Synthetic peptide
  XENP020649 vlCDR1
KASQSVDYDGGSYMN

SEQ ID NO: 20143 - protein, 7 aa, Artificial Sequence
  Description of Artificial Sequence: Synthetic peptide
  XENP020649 vlCDR2
AASNLES

SEQ ID NO: 20144 - protein, 9 aa, Artificial Sequence
  Description of Artificial Sequence: Synthetic peptide
  XENP020649 vlCDR3
QQSNEDPFT

SEQ ID NO: 20145 - protein, 450 aa, Artificial Sequence; identical to SEQ ID NO: 17585
  Description of Artificial Sequence: Synthetic polypeptide
  XENP020650 7G8_H0_L0.46_IgG1_PVA_/S267K Heavy Chain

SEQ ID NO: 20146 - protein, 121 aa, Artificial Sequence; identical to SEQ ID NO: 17586
  Description of Artificial Sequence: Synthetic polypeptide
  VH of XENP020650

SEQ ID NO: 20147 - protein, 5 aa, Artificial Sequence
  Description of Artificial Sequence: Synthetic peptide
  XENP020650 vhCDR1
DAWMD

SEQ ID NO: 20148 - protein, 19 aa, Artificial Sequence
  Description of Artificial Sequence: Synthetic peptide
  XENP020650 vhCDR2
EIRTKANNHATYYAESVKG

SEQ ID NO: 20149 - protein, 10 aa, Artificial Sequence
  Description of Artificial Sequence: Synthetic peptide
  XENP020650 vhCDR3
LANWDWYFDV

SEQ ID NO: 20150 - protein, 218 aa, Artificial Sequence
  Description of Artificial Sequence: Synthetic polypeptide
  XENP020650 7G8_H0_L0.46_IgG1_PVA_/S267K Light Chain
DTVLTQSPASLAVSLGQRATISCKASQSVDYDGYSYMNWYQQKPGQPPKLLIYAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20151 - protein, 111 aa, Artificial Sequence
  Description of Artificial Sequence: Synthetic polypeptide
  VL of XENP020650
DTVLTQSPASLAVSLGQRATISCKASQSVDYDGYSYMNWYQQKPGQPPKLLIYAASNLESGIPARLSGSGSGTDFTLNIHPVEEEDAATYYCQQSNEDPFTFGSGTKLEVK

SEQ ID NO: 20152 - protein, 15 aa, Artificial Sequence
  Description of Artificial Sequence: Synthetic peptide
  XENP020650 vlCDR1
KASQSVDYDGYSYMN

SEQ ID NO: 20153 - protein, 7 aa, Artificial Sequence
  Description of Artificial Sequence: Synthetic peptide
  XENP020650 vlCDR2
AASNLES

SEQ ID NO: 20154 - protein, 9 aa, Artificial Sequence
  Description of Artificial Sequence: Synthetic peptide
  XENP020650 vlCDR3
QQSNEDPFT

SEQ ID NO: 20155 - protein, 450 aa, Artificial Sequence; identical to SEQ ID NO: 17585
  Description of Artificial Sequence: Synthetic polypeptide
  XENP020651 7G8_H0_L0.47_IgG1_PVA_/S267K Heavy Chain

SEQ ID NO: 20156 - protein, 121 aa, Artificial Sequence; identical to SEQ ID NO: 17586
  Description of Artificial Sequence: Synthetic polypeptide
  VH of XENP020651

SEQ ID NO: 20157 - protein, 5 aa, Artificial Sequence
  Description of Artificial Sequence: Synthetic peptide
  XENP020651 vhCDR1
DAWMD

SEQ ID NO: 20158 - protein, 19 aa, Artificial Sequence
  Description of Artificial Sequence: Synthetic peptide
  XENP020651 vhCDR2
EIRTKANNHATYYAESVKG

SEQ ID NO: 20159 - protein, 10 aa, Artificial Sequence
  Description of Artificial Sequence: Synthetic peptide
  XENP020651 vhCDR3
LANWDWYFDV

SEQ ID NO: 20160 - protein, 218 aa, Artificial Sequence
  Description of Artificial Sequence: Synthetic polypeptide
  XENP020651 7G8_H0_L0.47_IgG1_PVA_/S267K Light Chain
DTVLTQSPASLAVSLGQRATISCKASQSVDYDGDSYMNWYQQKPGQPPKLLIKAASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20161 - protein, 111 aa, Artificial Sequence
  Description of Artificial Sequence: Synthetic polypeptide
  VL of XENP020651
DTVLTQSPASLAVSLGQRATISCKASQSVDYDGDSYMNWYQQKPGQPPKLLIKAASNLESGIPARLSGSGSGTDFTLNIHPVEEEDAATYYCQQSNEDPFTFGSGTKLEVK

SEQ ID NO: 20162 - protein, 15 aa, Artificial Sequence
  Description of Artificial Sequence: Synthetic peptide
  XENP020651 vlCDR1
KASQSVDYDGDSYMN

SEQ ID NO: 20163 - protein, 7 aa, Artificial Sequence
  Description of Artificial Sequence: Synthetic peptide
  XENP020651 vlCDR2
AASNLES

SEQ ID NO: 20164 - protein, 9 aa, Artificial Sequence
  Description of Artificial Sequence: Synthetic peptide
  XENP020651 vlCDR3
QQSNEDPFT

SEQ ID NO: 20165 - protein, 450 aa, Artificial Sequence; identical to SEQ ID NO: 17585
  Description of Artificial Sequence: Synthetic polypeptide
  XENP020652 7G8_H0_L0.48_IgG1_PVA_/S267K Heavy Chain

SEQ ID NO: 20166 - protein, 121 aa, Artificial Sequence; identical to SEQ ID NO: 17586
  Description of Artificial Sequence: Synthetic polypeptide
  VH of XENP020652

SEQ ID NO: 20167 - protein, 5 aa, Artificial Sequence
  Description of Artificial Sequence: Synthetic peptide
  XENP020652 vhCDR1
DAWMD

SEQ ID NO: 20168 - protein, 19 aa, Artificial Sequence
  Description of Artificial Sequence: Synthetic peptide
  XENP020652 vhCDR2
EIRTKANNHATYYAESVKG

SEQ ID NO: 20169 - protein, 10 aa, Artificial Sequence
  Description of Artificial Sequence: Synthetic peptide
  XENP020652 vhCDR3
LANWDWYFDV

SEQ ID NO: 20170 - protein, 218 aa, Artificial Sequence
  Description of Artificial Sequence: Synthetic polypeptide
  XENP020652 7G8_H0_L0.48_IgG1_PVA_/S267K Light Chain
DTVLTQSPASLAVSLGQRATISCKASQSVDYDGDSYMNWYQQKPGQPPKLLIYSASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20171 - protein, 111 aa, Artificial Sequence
  Description of Artificial Sequence: Synthetic polypeptide
  VL of XENP020652
DTVLTQSPASLAVSLGQRATISCKASQSVDYDGDSYMNWYQQKPGQPPKLLIYSASNLESGIPARLSGSGSGTDFTLNIHPVEEEDAATYYCQQSNEDPFTFGSGTKLEVK

SEQ ID NO: 20172 - protein, 15 aa, Artificial Sequence
  Description of Artificial Sequence: Synthetic peptide
  XENP020652 vlCDR1
KASQSVDYDGDSYMN

SEQ ID NO: 20173 - protein, 7 aa, Artificial Sequence
  Description of Artificial Sequence: Synthetic peptide
  XENP020652 vlCDR2
SASNLES

SEQ ID NO: 20174 - protein, 9 aa, Artificial Sequence
  Description of Artificial Sequence: Synthetic peptide
  XENP020652 vlCDR3
QQSNEDPFT

SEQ ID NO: 20175 - protein, 450 aa, Artificial Sequence; identical to SEQ ID NO: 17585
  Description of Artificial Sequence: Synthetic polypeptide
  XENP020653 7G8_H0_L0.49_IgG1_PVA_/S267K Heavy Chain

SEQ ID NO: 20176 - protein, 121 aa, Artificial Sequence; identical to SEQ ID NO: 17586
  Description of Artificial Sequence: Synthetic polypeptide
  VH of XENP020653

SEQ ID NO: 20177 - protein, 5 aa, Artificial Sequence
  Description of Artificial Sequence: Synthetic peptide
  XENP020653 vhCDR1
DAWMD

SEQ ID NO: 20178 - protein, 19 aa, Artificial Sequence
  Description of Artificial Sequence: Synthetic peptide
  XENP020653 vhCDR2
EIRTKANNHATYYAESVKG

SEQ ID NO: 20179 - protein, 10 aa, Artificial Sequence
  Description of Artificial Sequence: Synthetic peptide
  XENP020653 vhCDR3
LANWDWYFDV

SEQ ID NO: 20180 - protein, 218 aa, Artificial Sequence
  Description of Artificial Sequence: Synthetic polypeptide
  XENP020653 7G8_H0_L0.49_IgG1_PVA_/S267K Light Chain
DTVLTQSPASLAVSLGQRATISCKASQSVDYDGDSYMNWYQQKPGQPPKLLIYTASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20181 - protein, 111 aa, Artificial Sequence
  Description of Artificial Sequence: Synthetic polypeptide
  VL of XENP020653
DTVLTQSPASLAVSLGQRATISCKASQSVDYDGDSYMNWYQQKPGQPPKLLIYTASNLESGIPARLSGSGSGTDFTLNIHPVEEEDAATYYCQQSNEDPFTFGSGTKLEVK

SEQ ID NO: 20182 - protein, 15 aa, Artificial Sequence
  Description of Artificial Sequence: Synthetic peptide
  XENP020653 vlCDR1
KASQSVDYDGDSYMN

SEQ ID NO: 20183 - protein, 7 aa, Artificial Sequence
  Description of Artificial Sequence: Synthetic peptide
  XENP020653 vlCDR2
TASNLES

SEQ ID NO: 20184 - protein, 9 aa, Artificial Sequence
  Description of Artificial Sequence: Synthetic peptide
  XENP020653 vlCDR3
QQSNEDPFT

SEQ ID NO: 20185 - protein, 450 aa, Artificial Sequence; identical to SEQ ID NO: 17585
  Description of Artificial Sequence: Synthetic polypeptide
  XENP020654 7G8_H0_L0.50_IgG1_PVA_/S267K Heavy Chain

SEQ ID NO: 20186 - protein, 121 aa, Artificial Sequence; identical to SEQ ID NO: 17586
  Description of Artificial Sequence: Synthetic polypeptide
  VH of XENP020654

SEQ ID NO: 20187 - protein, 5 aa, Artificial Sequence
  Description of Artificial Sequence: Synthetic peptide
  XENP020654 vhCDR1
DAWMD

SEQ ID NO: 20188 - protein, 19 aa, Artificial Sequence
  Description of Artificial Sequence: Synthetic peptide
  XENP020654 vhCDR2
EIRTKANNHATYYAESVKG

SEQ ID NO: 20189 - protein, 10 aa, Artificial Sequence
  Description of Artificial Sequence: Synthetic peptide
  XENP020654 vhCDR3
LANWDWYFDV

SEQ ID NO: 20190 - protein, 218 aa, Artificial Sequence
  Description of Artificial Sequence: Synthetic polypeptide
  XENP020654 7G8_H0_L0.50_IgG1_PVA_/S267K Light Chain
DTVLTQSPASLAVSLGQRATISCKASQSVDYDGDSYMNWYQQKPGQPPKLLIYGASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20191 - protein, 111 aa, Artificial Sequence
  Description of Artificial Sequence: Synthetic polypeptide
  VL of XENP020654
DTVLTQSPASLAVSLGQRATISCKASQSVDYDGDSYMNWYQQKPGQPPKLLIYGASNLESGIPARLSGSGSGTDFTLNIHPVEEEDAATYYCQQSNEDPFTFGSGTKLEVK

SEQ ID NO: 20192 - protein, 15 aa, Artificial Sequence
  Description of Artificial Sequence: Synthetic peptide
  XENP020654 vlCDR1
KASQSVDYDGDSYMN

SEQ ID NO: 20193 - protein, 7 aa, Artificial Sequence
  Description of Artificial Sequence: Synthetic peptide
  XENP020654 vlCDR2
GASNLES

SEQ ID NO: 20194 - protein, 9 aa, Artificial Sequence
  Description of Artificial Sequence: Synthetic peptide
  XENP020654 vlCDR3
QQSNEDPFT

SEQ ID NO: 20195 - protein, 450 aa, Artificial Sequence; identical to SEQ ID NO: 17585
  Description of Artificial Sequence: Synthetic polypeptide
  XENP020655 7G8_H0_L0.51_IgG1_PVA_/S267K Heavy Chain

SEQ ID NO: 20196 - protein, 121 aa, Artificial Sequence; identical to SEQ ID NO: 17586
  Description of Artificial Sequence: Synthetic polypeptide
  VH of XENP020655

SEQ ID NO: 20197 - protein, 5 aa, Artificial Sequence
  Description of Artificial Sequence: Synthetic peptide
  XENP020655 vhCDR1
DAWMD

SEQ ID NO: 20198 - protein, 19 aa, Artificial Sequence
  Description of Artificial Sequence: Synthetic peptide
  XENP020655 vhCDR2
EIRTKANNHATYYAESVKG

SEQ ID NO: 20199 - protein, 10 aa, Artificial Sequence
  Description of Artificial Sequence: Synthetic peptide
  XENP020655 vhCDR3
LANWDWYFDV

SEQ ID NO: 20200 - protein, 218 aa, Artificial Sequence
  Description of Artificial Sequence: Synthetic polypeptide
  XENP020655 7G8_H0_L0.51_IgG1_PVA_/S267K Light Chain
DTVLTQSPASLAVSLGQRATISCKASQSVDYDGDSYMNWYQQKPGQPPKLLIYHASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20201 - protein, 111 aa, Artificial Sequence
  Description of Artificial Sequence: Synthetic polypeptide
  VL of XENP020655
DTVLTQSPASLAVSLGQRATISCKASQSVDYDGDSYMNWYQQKPGQPPKLLIYHASNLESGIPARLSGSGSGTDFTLNIHPVEEEDAATYYCQQSNEDPFTFGSGTKLEVK

SEQ ID NO: 20202 - protein, 15 aa, Artificial Sequence
  Description of Artificial Sequence: Synthetic peptide
  XENP020655 vlCDR1
KASQSVDYDGDSYMN

SEQ ID NO: 20203 - protein, 7 aa, Artificial Sequence
  Description of Artificial Sequence: Synthetic peptide
  XENP020655 vlCDR2
HASNLES

SEQ ID NO: 20204 - protein, 9 aa, Artificial Sequence
  Description of Artificial Sequence: Synthetic peptide
  XENP020655 vlCDR3
QQSNEDPFT

SEQ ID NO: 20205 - protein, 450 aa, Artificial Sequence; identical to SEQ ID NO: 17585
  Description of Artificial Sequence: Synthetic polypeptide
  XENP020656 7G8_H0_L0.52_IgG1_PVA_/S267K Heavy Chain

SEQ ID NO: 20206 - protein, 121 aa, Artificial Sequence; identical to SEQ ID NO: 17586
  Description of Artificial Sequence: Synthetic polypeptide
  VH of XENP020656

SEQ ID NO: 20207 - protein, 5 aa, Artificial Sequence
  Description of Artificial Sequence: Synthetic peptide
  XENP020656 vhCDR1
DAWMD

SEQ ID NO: 20208 - protein, 19 aa, Artificial Sequence
  Description of Artificial Sequence: Synthetic peptide
  XENP020656 vhCDR2
EIRTKANNHATYYAESVKG

SEQ ID NO: 20209 - protein, 10 aa, Artificial Sequence
  Description of Artificial Sequence: Synthetic peptide
  XENP020656 vhCDR3
LANWDWYFDV

SEQ ID NO: 20210 - protein, 218 aa, Artificial Sequence
  Description of Artificial Sequence: Synthetic polypeptide
  XENP020656 7G8_H0_L0.52_IgG1_PVA_/S267K Light Chain
DTVLTQSPASLAVSLGQRATISCKASQSVDYDGDSYMNWYQQKPGQPPKLLIYQASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20211 - protein, 111 aa, Artificial Sequence
  Description of Artificial Sequence: Synthetic polypeptide
  VL of XENP020656
DTVLTQSPASLAVSLGQRATISCKASQSVDYDGDSYMNWYQQKPGQPPKLLIYQASNLESGIPARLSGSGSGTDFTLNIHPVEEEDAATYYCQQSNEDPFTFGSGTKLEVK

SEQ ID NO: 20212 - protein, 15 aa, Artificial Sequence
  Description of Artificial Sequence: Synthetic peptide
  XENP020656 vlCDR1
KASQSVDYDGDSYMN

SEQ ID NO: 20213 - protein, 7 aa, Artificial Sequence
  Description of Artificial Sequence: Synthetic peptide
  XENP020656 vlCDR2
QASNLES

SEQ ID NO: 20214 - protein, 9 aa, Artificial Sequence
  Description of Artificial Sequence: Synthetic peptide
  XENP020656 vlCDR3
QQSNEDPFT

SEQ ID NO: 20215 - protein, 450 aa, Artificial Sequence; identical to SEQ ID NO: 17585
  Description of Artificial Sequence: Synthetic polypeptide
  XENP020657 7G8_H0_L0.53_IgG1_PVA_/S267K Heavy Chain

SEQ ID NO: 20216 - protein, 121 aa, Artificial Sequence; identical to SEQ ID NO: 17586
  Description of Artificial Sequence: Synthetic polypeptide
  VH of XENP020657

SEQ ID NO: 20217 - protein, 5 aa, Artificial Sequence
  Description of Artificial Sequence: Synthetic peptide
  XENP020657 vhCDR1
DAWMD

SEQ ID NO: 20218 - protein, 19 aa, Artificial Sequence
  Description of Artificial Sequence: Synthetic peptide
  XENP020657 vhCDR2
EIRTKANNHATYYAESVKG

SEQ ID NO: 20219 - protein, 10 aa, Artificial Sequence
  Description of Artificial Sequence: Synthetic peptide
  XENP020657 vhCDR3
LANWDWYFDV

SEQ ID NO: 20220 - protein, 218 aa, Artificial Sequence
  Description of Artificial Sequence: Synthetic polypeptide
  XENP020657 7G8_H0_L0.53_IgG1_PVA_/S267K Light Chain
DTVLTQSPASLAVSLGQRATISCKASQSVDYDGDSYMNWYQQKPGQPPKLLIYDASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20221 - protein, 111 aa, Artificial Sequence
  Description of Artificial Sequence: Synthetic polypeptide
  VL of XENP020657
DTVLTQSPASLAVSLGQRATISCKASQSVDYDGDSYMNWYQQKPGQPPKLLIYDASNLESGIPARLSGSGSGTDFTLNIHPVEEEDAATYYCQQSNEDPFTFGSGTKLEVK

SEQ ID NO: 20222 - protein, 15 aa, Artificial Sequence
  Description of Artificial Sequence: Synthetic peptide
  XENP020657 vlCDR1
KASQSVDYDGDSYMN

SEQ ID NO: 20223 - protein, 7 aa, Artificial Sequence
  Description of Artificial Sequence: Synthetic peptide
  XENP020657 vlCDR2
DASNLES

SEQ ID NO: 20224 - protein, 9 aa, Artificial Sequence
  Description of Artificial Sequence: Synthetic peptide
  XENP020657 vlCDR3
QQSNEDPFT

SEQ ID NO: 20225 - protein, 450 aa, Artificial Sequence; identical to SEQ ID NO: 17585
  Description of Artificial Sequence: Synthetic polypeptide
  XENP020658 7G8_H0_L0.54_IgG1_PVA_/S267K Heavy Chain

SEQ ID NO: 20226 - protein, 121 aa, Artificial Sequence; identical to SEQ ID NO: 17586
  Description of Artificial Sequence: Synthetic polypeptide
  VH of XENP020658

SEQ ID NO: 20227 - protein, 5 aa, Artificial Sequence
  Description of Artificial Sequence: Synthetic peptide
  XENP020658 vhCDR1
DAWMD

SEQ ID NO: 20228 - protein, 19 aa, Artificial Sequence
  Description of Artificial Sequence: Synthetic peptide
  XENP020658 vhCDR2
EIRTKANNHATYYAESVKG

SEQ ID NO: 20229 - protein, 10 aa, Artificial Sequence
  Description of Artificial Sequence: Synthetic peptide
  XENP020658 vhCDR3
LANWDWYFDV

SEQ ID NO: 20230 - protein, 218 aa, Artificial Sequence
  Description of Artificial Sequence: Synthetic polypeptide
  XENP020658 7G8_H0_L0.54_IgG1_PVA_/S267K Light Chain
DTVLTQSPASLAVSLGQRATISCKASQSVDYDGDSYMNWYQQKPGQPPKLLIYLASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20231 - protein, 111 aa, Artificial Sequence
  Description of Artificial Sequence: Synthetic polypeptide
  VL of XENP020658
DTVLTQSPASLAVSLGQRATISCKASQSVDYDGDSYMNWYQQKPGQPPKLLIYLASNLESGIPARLSGSGSGTDFTLNIHPVEEEDAATYYCQQSNEDPFTFGSGTKLEVK

SEQ ID NO: 20232 - protein, 15 aa, Artificial Sequence
  Description of Artificial Sequence: Synthetic peptide
  XENP020658 vlCDR1
KASQSVDYDGDSYMN

SEQ ID NO: 20233 - protein, 7 aa, Artificial Sequence
  Description of Artificial Sequence: Synthetic peptide
  XENP020658 vlCDR2
LASNLES

SEQ ID NO: 20234 - protein, 9 aa, Artificial Sequence
  Description of Artificial Sequence: Synthetic peptide
  XENP020658 vlCDR3
QQSNEDPFT

SEQ ID NO: 20235 - protein, 450 aa, Artificial Sequence; identical to SEQ ID NO: 17585
  Description of Artificial Sequence: Synthetic polypeptide
  XENP020659 7G8_H0_L0.55_IgG1_PVA_/S267K Heavy Chain

SEQ ID NO: 20236 - protein, 121 aa, Artificial Sequence; identical to SEQ ID NO: 17586
  Description of Artificial Sequence: Synthetic polypeptide
  VH of XENP020659

SEQ ID NO: 20237 - protein, 5 aa, Artificial Sequence
  Description of Artificial Sequence: Synthetic peptide
  XENP020659 vhCDR1
DAWMD

SEQ ID NO: 20238 - protein, 19 aa, Artificial Sequence
  Description of Artificial Sequence: Synthetic peptide
  XENP020659 vhCDR2
EIRTKANNHATYYAESVKG

SEQ ID NO: 20239 - protein, 10 aa, Artificial Sequence
  Description of Artificial Sequence: Synthetic peptide
  XENP020659 vhCDR3
LANWDWYFDV

SEQ ID NO: 20240 - protein, 218 aa, Artificial Sequence
  Description of Artificial Sequence: Synthetic polypeptide
  XENP020659 7G8_H0_L0.55_IgG1_PVA_/S267K Light Chain
DTVLTQSPASLAVSLGQRATISCKASQSVDYDGDSYMNWYQQKPGQPPKLLIYKASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20241 - protein, 111 aa, Artificial Sequence
  Description of Artificial Sequence: Synthetic polypeptide
  VL of XENP020659
DTVLTQSPASLAVSLGQRATISCKASQSVDYDGDSYMNWYQQKPGQPPKLLIYKASNLESGIPARLSGSGSGTDFTLNIHPVEEEDAATYYCQQSNEDPFTFGSGTKLEVK

SEQ ID NO: 20242 - protein, 15 aa, Artificial Sequence
  Description of Artificial Sequence: Synthetic peptide
  XENP020659 vlCDR1
KASQSVDYDGDSYMN

SEQ ID NO: 20243 - protein, 7 aa, Artificial Sequence
  Description of Artificial Sequence: Synthetic peptide
  XENP020659 vlCDR2
KASNLES

SEQ ID NO: 20244 - protein, 9 aa, Artificial Sequence
  Description of Artificial Sequence: Synthetic peptide
  XENP020659 vlCDR3
QQSNEDPFT

SEQ ID NO: 20245 - protein, 450 aa, Artificial Sequence; identical to SEQ ID NO: 17585
  Description of Artificial Sequence: Synthetic polypeptide
  XENP020660 7G8_H0_L0.56_IgG1_PVA_/S267K Heavy Chain

SEQ ID NO: 20246 - protein, 121 aa, Artificial Sequence; identical to SEQ ID NO: 17586
  Description of Artificial Sequence: Synthetic polypeptide
  VH of XENP020660

SEQ ID NO: 20247 - protein, 5 aa, Artificial Sequence
  Description of Artificial Sequence: Synthetic peptide
  XENP020660 vhCDR1
DAWMD

SEQ ID NO: 20248 - protein, 19 aa, Artificial Sequence
  Description of Artificial Sequence: Synthetic peptide
  XENP020660 vhCDR2
EIRTKANNHATYYAESVKG

SEQ ID NO: 20249 - protein, 10 aa, Artificial Sequence
  Description of Artificial Sequence: Synthetic peptide
  XENP020660 vhCDR3
LANWDWYFDV

SEQ ID NO: 20250 - protein, 218 aa, Artificial Sequence
  Description of Artificial Sequence: Synthetic polypeptide
  XENP020660 7G8_H0_L0.56_IgG1_PVA_/S267K Light Chain
DTVLTQSPASLAVSLGQRATISCKASQSVDYDGDSYMNWYQQKPGQPPKLLIYYASNLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20251 - protein, 111 aa, Artificial Sequence
  Description of Artificial Sequence: Synthetic polypeptide
  VL of XENP020660
DTVLTQSPASLAVSLGQRATISCKASQSVDYDGDSYMNWYQQKPGQPPKLLIYYASNLESGIPARLSGSGSGTDFTLNIHPVEEEDAATYYCQQSNEDPFTFGSGTKLEVK

SEQ ID NO: 20252 - protein, 15 aa, Artificial Sequence
  Description of Artificial Sequence: Synthetic peptide
  XENP020660 vlCDR1
KASQSVDYDGDSYMN

SEQ ID NO: 20253 - protein, 7 aa, Artificial Sequence
  Description of Artificial Sequence: Synthetic peptide
  XENP020660 vlCDR2
YASNLES

SEQ ID NO: 20254 - protein, 9 aa, Artificial Sequence
  Description of Artificial Sequence: Synthetic peptide
  XENP020660 vlCDR3
QQSNEDPFT

SEQ ID NO: 20255 - protein, 450 aa, Artificial Sequence; identical to SEQ ID NO: 17585
  Description of Artificial Sequence: Synthetic polypeptide
  XENP020661 7G8_H0_L0.57_IgG1_PVA_/S267K Heavy Chain

SEQ ID NO: 20256 - protein, 121 aa, Artificial Sequence; identical to SEQ ID NO: 17586
  Description of Artificial Sequence: Synthetic polypeptide
  VH of XENP020661

SEQ ID NO: 20257 - protein, 5 aa, Artificial Sequence
  Description of Artificial Sequence: Synthetic peptide
  XENP020661 vhCDR1
DAWMD

SEQ ID NO: 20258 - protein, 19 aa, Artificial Sequence
  Description of Artificial Sequence: Synthetic peptide
  XENP020661 vhCDR2
EIRTKANNHATYYAESVKG

SEQ ID NO: 20259 - protein, 10 aa, Artificial Sequence
  Description of Artificial Sequence: Synthetic peptide
  XENP020661 vhCDR3
LANWDWYFDV

SEQ ID NO: 20260 - protein, 218 aa, Artificial Sequence
  Description of Artificial Sequence: Synthetic polypeptide
  XENP020661 7G8_H0_L0.57_IgG1_PVA_/S267K Light Chain
DTVLTQSPASLAVSLGQRATISCKASQSVDYDGDSYMNWYQQKPGQPPKLLIYAASDLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20261 - protein, 111 aa, Artificial Sequence
  Description of Artificial Sequence: Synthetic polypeptide
  VL of XENP020661
DTVLTQSPASLAVSLGQRATISCKASQSVDYDGDSYMNWYQQKPGQPPKLLIYAASDLESGIPARLSGSGSGTDFTLNIHPVEEEDAATYYCQQSNEDPFTFGSGTKLEVK

SEQ ID NO: 20262 - protein, 15 aa, Artificial Sequence
  Description of Artificial Sequence: Synthetic peptide
  XENP020661 vlCDR1
KASQSVDYDGDSYMN

SEQ ID NO: 20263 - protein, 7 aa, Artificial Sequence
  Description of Artificial Sequence: Synthetic peptide
  XENP020661 vlCDR2
AASDLES

SEQ ID NO: 20264 - protein, 9 aa, Artificial Sequence
  Description of Artificial Sequence: Synthetic peptide
  XENP020661 vlCDR3
QQSNEDPFT

SEQ ID NO: 20265 - protein, 450 aa, Artificial Sequence; identical to SEQ ID NO: 17585
  Description of Artificial Sequence: Synthetic polypeptide
  XENP020662 7G8_H0_L0.58_IgG1_PVA_/S267K Heavy Chain

SEQ ID NO: 20266 - protein, 121 aa, Artificial Sequence; identical to SEQ ID NO: 17586
  Description of Artificial Sequence: Synthetic polypeptide
  VH of XENP020662

SEQ ID NO: 20267 - protein, 5 aa, Artificial Sequence
  Description of Artificial Sequence: Synthetic peptide
  XENP020662 vhCDR1
DAWMD

SEQ ID NO: 20268 - protein, 19 aa, Artificial Sequence
  Description of Artificial Sequence: Synthetic peptide
  XENP020662 vhCDR2
EIRTKANNHATYYAESVKG

SEQ ID NO: 20269 - protein, 10 aa, Artificial Sequence
  Description of Artificial Sequence: Synthetic peptide
  XENP020662 vhCDR3
LANWDWYFDV

SEQ ID NO: 20270 - protein, 218 aa, Artificial Sequence
  Description of Artificial Sequence: Synthetic polypeptide
  XENP020662 7G8_H0_L0.58_IgG1_PVA_/S267K Light Chain
DTVLTQSPASLAVSLGQRATISCKASQSVDYDGDSYMNWYQQKPGQPPKLLIYAASHLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20271 - protein, 111 aa, Artificial Sequence
  Description of Artificial Sequence: Synthetic polypeptide
  VL of XENP020662
DTVLTQSPASLAVSLGQRATISCKASQSVDYDGDSYMNWYQQKPGQPPKLLIYAASHLESGIPARLSGSGSGTDFTLNIHPVEEEDAATYYCQQSNEDPFTFGSGTKLEVK

SEQ ID NO: 20272 - protein, 15 aa, Artificial Sequence
  Description of Artificial Sequence: Synthetic peptide
  XENP020662 vlCDR1
KASQSVDYDGDSYMN

SEQ ID NO: 20273 - protein, 7 aa, Artificial Sequence
  Description of Artificial Sequence: Synthetic peptide
  XENP020662 vlCDR2
AASHLES

SEQ ID NO: 20274 - protein, 9 aa, Artificial Sequence
  Description of Artificial Sequence: Synthetic peptide
  XENP020662 vlCDR3
QQSNEDPFT

SEQ ID NO: 20275 - protein, 450 aa, Artificial Sequence; identical to SEQ ID NO: 17585
  Description of Artificial Sequence: Synthetic polypeptide
  XENP020663 7G8_H0_L0.59_IgG1_PVA_/S267K Heavy Chain

SEQ ID NO: 20276 - protein, 121 aa, Artificial Sequence; identical to SEQ ID NO: 17586
  Description of Artificial Sequence: Synthetic polypeptide
  VH of XENP020663

SEQ ID NO: 20277 - protein, 5 aa, Artificial Sequence
  Description of Artificial Sequence: Synthetic peptide
  XENP020663 vhCDR1
DAWMD

SEQ ID NO: 20278 - protein, 19 aa, Artificial Sequence
  Description of Artificial Sequence: Synthetic peptide
  XENP020663 vhCDR2
EIRTKANNHATYYAESVKG

SEQ ID NO: 20279 - protein, 10 aa, Artificial Sequence
  Description of Artificial Sequence: Synthetic peptide
  XENP020663 vhCDR3
LANWDWYFDV

SEQ ID NO: 20280 - protein, 218 aa, Artificial Sequence
  Description of Artificial Sequence: Synthetic polypeptide
  XENP020663 7G8_H0_L0.59_IgG1_PVA_/S267K Light Chain
DTVLTQSPASLAVSLGQRATISCKASQSVDYDGDSYMNWYQQKPGQPPKLLIYAASELESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20281 - protein, 111 aa, Artificial Sequence
  Description of Artificial Sequence: Synthetic polypeptide
  VL of XENP020663
DTVLTQSPASLAVSLGQRATISCKASQSVDYDGDSYMNWYQQKPGQPPKLLIYAASELESGIPARLSGSGSGTDFTLNIHPVEEEDAATYYCQQSNEDPFTFGSGTKLEVK

SEQ ID NO: 20282 - protein, 15 aa, Artificial Sequence
  Description of Artificial Sequence: Synthetic peptide
  XENP020663 vlCDR1
KASQSVDYDGDSYMN

SEQ ID NO: 20283 - protein, 7 aa, Artificial Sequence
  Description of Artificial Sequence: Synthetic peptide
  XENP020663 vlCDR2
AASELES

SEQ ID NO: 20284 - protein, 9 aa, Artificial Sequence
  Description of Artificial Sequence: Synthetic peptide
  XENP020663 vlCDR3
QQSNEDPFT

SEQ ID NO: 20285 - protein, 450 aa, Artificial Sequence; identical to SEQ ID NO: 17585
  Description of Artificial Sequence: Synthetic polypeptide
  XENP020664 7G8_H0_L0.60_IgG1_PVA_/S267K Heavy Chain

SEQ ID NO: 20286 - protein, 121 aa, Artificial Sequence; identical to SEQ ID NO: 17586
  Description of Artificial Sequence: Synthetic polypeptide
  VH of XENP020664

SEQ ID NO: 20287 - protein, 5 aa, Artificial Sequence
  Description of Artificial Sequence: Synthetic peptide
  XENP020664 vhCDR1
DAWMD

SEQ ID NO: 20288 - protein, 19 aa, Artificial Sequence
  Description of Artificial Sequence: Synthetic peptide
  XENP020664 vhCDR2
EIRTKANNHATYYAESVKG

SEQ ID NO: 20289 - protein, 10 aa, Artificial Sequence
  Description of Artificial Sequence: Synthetic peptide
  XENP020664 vhCDR3
LANWDWYFDV

SEQ ID NO: 20290 - protein, 218 aa, Artificial Sequence
  Description of Artificial Sequence: Synthetic polypeptide
  XENP020664 7G8_H0_L0.60_IgG1_PVA_/S267K Light Chain
DTVLTQSPASLAVSLGQRATISCKASQSVDYDGDSYMNWYQQKPGQPPKLLIYAASSLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20291 - protein, 111 aa, Artificial Sequence
  Description of Artificial Sequence: Synthetic polypeptide
  VL of XENP020664
DTVLTQSPASLAVSLGQRATISCKASQSVDYDGDSYMNWYQQKPGQPPKLLIYAASSLESGIPARLSGSGSGTDFTLNIHPVEEEDAATYYCQQSNEDPFTFGSGTKLEVK

SEQ ID NO: 20292 - protein, 15 aa, Artificial Sequence
  Description of Artificial Sequence: Synthetic peptide
  XENP020664 vlCDR1
KASQSVDYDGDSYMN

SEQ ID NO: 20293 - protein, 7 aa, Artificial Sequence
  Description of Artificial Sequence: Synthetic peptide
  XENP020664 vlCDR2
AASSLES

SEQ ID NO: 20294 - protein, 9 aa, Artificial Sequence
  Description of Artificial Sequence: Synthetic peptide
  XENP020664 vlCDR3
QQSNEDPFT

SEQ ID NO: 20295 - protein, 450 aa, Artificial Sequence; identical to SEQ ID NO: 17585
  Description of Artificial Sequence: Synthetic polypeptide
  XENP020665 7G8_H0_L0.61_IgG1_PVA_/S267K Heavy Chain

SEQ ID NO: 20296 - protein, 121 aa, Artificial Sequence; identical to SEQ ID NO: 17586
  Description of Artificial Sequence: Synthetic polypeptide
  VH of XENP020665

SEQ ID NO: 20297 - protein, 5 aa, Artificial Sequence
  Description of Artificial Sequence: Synthetic peptide
  XENP020665 vhCDR1
DAWMD

SEQ ID NO: 20298 - protein, 19 aa, Artificial Sequence
  Description of Artificial Sequence: Synthetic peptide
  XENP020665 vhCDR2
EIRTKANNHATYYAESVKG

SEQ ID NO: 20299 - protein, 10 aa, Artificial Sequence
  Description of Artificial Sequence: Synthetic peptide
  XENP020665 vhCDR3
LANWDWYFDV

SEQ ID NO: 20300 - protein, 218 aa, Artificial Sequence
  Description of Artificial Sequence: Synthetic polypeptide
  XENP020665 7G8_H0_L0.61_IgG1_PVA_/S267K Light Chain
DTVLTQSPASLAVSLGQRATISCKASQSVDYDGDSYMNWYQQKPGQPPKLLIYAASRLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20301 - protein, 111 aa, Artificial Sequence
  Description of Artificial Sequence: Synthetic polypeptide
  VL of XENP020665
DTVLTQSPASLAVSLGQRATISCKASQSVDYDGDSYMNWYQQKPGQPPKLLIYAASRLESGIPARLSGSGSGTDFTLNIHPVEEEDAATYYCQQSNEDPFTFGSGTKLEVK

SEQ ID NO: 20302 - protein, 15 aa, Artificial Sequence
  Description of Artificial Sequence: Synthetic peptide
  XENP020665 vlCDR1
KASQSVDYDGDSYMN

SEQ ID NO: 20303 - protein, 7 aa, Artificial Sequence
  Description of Artificial Sequence: Synthetic peptide
  XENP020665 vlCDR2
AASRLES

SEQ ID NO: 20304 - protein, 9 aa, Artificial Sequence
  Description of Artificial Sequence: Synthetic peptide
  XENP020665 vlCDR3
QQSNEDPFT

SEQ ID NO: 20305 - protein, 450 aa, Artificial Sequence; identical to SEQ ID NO: 17585
  Description of Artificial Sequence: Synthetic polypeptide
  XENP020666 7G8_H0_L0.62_IgG1_PVA_/S267K Heavy Chain

SEQ ID NO: 20306 - protein, 121 aa, Artificial Sequence; identical to SEQ ID NO: 17586
  Description of Artificial Sequence: Synthetic polypeptide
  VH of XENP020666

SEQ ID NO: 20307 - protein, 5 aa, Artificial Sequence
  Description of Artificial Sequence: Synthetic peptide
  XENP020666 vhCDR1
DAWMD

SEQ ID NO: 20308 - protein, 19 aa, Artificial Sequence
  Description of Artificial Sequence: Synthetic peptide
  XENP020666 vhCDR2
EIRTKANNHATYYAESVKG

SEQ ID NO: 20309 - protein, 10 aa, Artificial Sequence
  Description of Artificial Sequence: Synthetic peptide
  XENP020666 vhCDR3
LANWDWYFDV

SEQ ID NO: 20310 - protein, 218 aa, Artificial Sequence
  Description of Artificial Sequence: Synthetic polypeptide
  XENP020666 7G8_H0_L0.62_IgG1_PVA_/S267K Light Chain
DTVLTQSPASLAVSLGQRATISCKASQSVDYDGDSYMNWYQQKPGQPPKLLIYAASLLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20311 - protein, 111 aa, Artificial Sequence
  Description of Artificial Sequence: Synthetic polypeptide
  VL of XENP020666
DTVLTQSPASLAVSLGQRATISCKASQSVDYDGDSYMNWYQQKPGQPPKLLIYAASLLESGIPARLSGSGSGTDFTLNIHPVEEEDAATYYCQQSNEDPFTFGSGTKLEVK

SEQ ID NO: 20312 - protein, 15 aa, Artificial Sequence
  Description of Artificial Sequence: Synthetic peptide
  XENP020666 vlCDR1
KASQSVDYDGDSYMN

SEQ ID NO: 20313 - protein, 7 aa, Artificial Sequence
  Description of Artificial Sequence: Synthetic peptide
  XENP020666 vlCDR2
AASLLES

SEQ ID NO: 20314 - protein, 9 aa, Artificial Sequence
  Description of Artificial Sequence: Synthetic peptide
  XENP020666 vlCDR3
QQSNEDPFT

SEQ ID NO: 20315 - protein, 450 aa, Artificial Sequence; identical to SEQ ID NO: 17585
  Description of Artificial Sequence: Synthetic polypeptide
  XENP020667 7G8_H0_L0.63_IgG1_PVA_/S267K Heavy Chain

SEQ ID NO: 20316 - protein, 121 aa, Artificial Sequence; identical to SEQ ID NO: 17586
  Description of Artificial Sequence: Synthetic polypeptide
  VH of XENP020667

SEQ ID NO: 20317 - protein, 5 aa, Artificial Sequence
  Description of Artificial Sequence: Synthetic peptide
  XENP020667 vhCDR1
DAWMD

SEQ ID NO: 20318 - protein, 19 aa, Artificial Sequence
  Description of Artificial Sequence: Synthetic peptide
  XENP020667 vhCDR2
EIRTKANNHATYYAESVKG

SEQ ID NO: 20319 - protein, 10 aa, Artificial Sequence
  Description of Artificial Sequence: Synthetic peptide
  XENP020667 vhCDR3
LANWDWYFDV

SEQ ID NO: 20320 - protein, 218 aa, Artificial Sequence
  Description of Artificial Sequence: Synthetic polypeptide
  XENP020667 7G8_H0_L0.63_IgG1_PVA_/S267K Light Chain
DTVLTQSPASLAVSLGQRATISCKASQSVDYDGDSYMNWYQQKPGQPPKLLIYAASTLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20321 - protein, 111 aa, Artificial Sequence
  Description of Artificial Sequence: Synthetic polypeptide
  VL of XENP020667
DTVLTQSPASLAVSLGQRATISCKASQSVDYDGDSYMNWYQQKPGQPPKLLIYAASTLESGIPARLSGSGSGTDFTLNIHPVEEEDAATYYCQQSNEDPFTFGSGTKLEVK

SEQ ID NO: 20322 - protein, 15 aa, Artificial Sequence
  Description of Artificial Sequence: Synthetic peptide
  XENP020667 vlCDR1
KASQSVDYDGDSYMN

SEQ ID NO: 20323 - protein, 7 aa, Artificial Sequence
  Description of Artificial Sequence: Synthetic peptide
  XENP020667 vlCDR2
AASTLES

SEQ ID NO: 20324 - protein, 9 aa, Artificial Sequence
  Description of Artificial Sequence: Synthetic peptide
  XENP020667 vlCDR3
QQSNEDPFT

SEQ ID NO: 20325 - protein, 450 aa, Artificial Sequence; identical to SEQ ID NO: 17585
  Description of Artificial Sequence: Synthetic polypeptide
  XENP020668 7G8_H0_L0.64_IgG1_PVA_/S267K Heavy Chain

SEQ ID NO: 20326 - protein, 121 aa, Artificial Sequence; identical to SEQ ID NO: 17586
  Description of Artificial Sequence: Synthetic polypeptide
  VH of XENP020668

SEQ ID NO: 20327 - protein, 5 aa, Artificial Sequence
  Description of Artificial Sequence: Synthetic peptide
  XENP020668 vhCDR1
DAWMD

SEQ ID NO: 20328 - protein, 19 aa, Artificial Sequence
  Description of Artificial Sequence: Synthetic peptide
  XENP020668 vhCDR2
EIRTKANNHATYYAESVKG

SEQ ID NO: 20329 - protein, 10 aa, Artificial Sequence
  Description of Artificial Sequence: Synthetic peptide
  XENP020668 vhCDR3
LANWDWYFDV

SEQ ID NO: 20330 - protein, 218 aa, Artificial Sequence
  Description of Artificial Sequence: Synthetic polypeptide
  XENP020668 7G8_H0_L0.64_IgG1_PVA_/S267K Light Chain
DTVLTQSPASLAVSLGQRATISCKASQSVDYDGDSYMNWYQQKPGQPPKLLIYAASGLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20331 - protein, 111 aa, Artificial Sequence
  Description of Artificial Sequence: Synthetic polypeptide
  VL of XENP020668
DTVLTQSPASLAVSLGQRATISCKASQSVDYDGDSYMNWYQQKPGQPPKLLIYAASGLESGIPARLSGSGSGTDFTLNIHPVEEEDAATYYCQQSNEDPFTFGSGTKLEVK

SEQ ID NO: 20332 - protein, 15 aa, Artificial Sequence
  Description of Artificial Sequence: Synthetic peptide
  XENP020668 vlCDR1
KASQSVDYDGDSYMN

SEQ ID NO: 20333 - protein, 7 aa, Artificial Sequence
  Description of Artificial Sequence: Synthetic peptide
  XENP020668 vlCDR2
AASGLES

SEQ ID NO: 20334 - protein, 9 aa, Artificial Sequence
  Description of Artificial Sequence: Synthetic peptide
  XENP020668 vlCDR3
QQSNEDPFT

SEQ ID NO: 20335 - protein, 450 aa, Artificial Sequence; identical to SEQ ID NO: 17585
  Description of Artificial Sequence: Synthetic polypeptide
  XENP020669 7G8_H0_L0.65_IgG1_PVA_/S267K Heavy Chain

SEQ ID NO: 20336 - protein, 121 aa, Artificial Sequence; identical to SEQ ID NO: 17586
  Description of Artificial Sequence: Synthetic polypeptide
  VH of XENP020669

SEQ ID NO: 20337 - protein, 5 aa, Artificial Sequence
  Description of Artificial Sequence: Synthetic peptide
  XENP020669 vhCDR1
DAWMD

SEQ ID NO: 20338 - protein, 19 aa, Artificial Sequence
  Description of Artificial Sequence: Synthetic peptide
  XENP020669 vhCDR2
EIRTKANNHATYYAESVKG

SEQ ID NO: 20339 - protein, 10 aa, Artificial Sequence
  Description of Artificial Sequence: Synthetic peptide
  XENP020669 vhCDR3
LANWDWYFDV

SEQ ID NO: 20340 - protein, 218 aa, Artificial Sequence
  Description of Artificial Sequence: Synthetic polypeptide
  XENP020669 7G8_H0_L0.65_IgG1_PVA_/S267K Light Chain
DTVLTQSPASLAVSLGQRATISCKASQSVDYDGDSYMNWYQQKPGQPPKLLIYAASYLESGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20341 - protein, 111 aa, Artificial Sequence
  Description of Artificial Sequence: Synthetic polypeptide
  VL of XENP020669
DTVLTQSPASLAVSLGQRATISCKASQSVDYDGDSYMNWYQQKPGQPPKLLIYAASYLESGIPARLSGSGSGTDFTLNIHPVEEEDAATYYCQQSNEDPFTFGSGTKLEVK

SEQ ID NO: 20342 - protein, 15 aa, Artificial Sequence
  Description of Artificial Sequence: Synthetic peptide
  XENP020669 vlCDR1
KASQSVDYDGDSYMN

SEQ ID NO: 20343 - protein, 7 aa, Artificial Sequence
  Description of Artificial Sequence: Synthetic peptide
  XENP020669 vlCDR2
AASYLES

SEQ ID NO: 20344 - protein, 9 aa, Artificial Sequence
  Description of Artificial Sequence: Synthetic peptide
  XENP020669 vlCDR3
QQSNEDPFT

SEQ ID NO: 20345 - protein, 450 aa, Artificial Sequence; identical to SEQ ID NO: 17585
  Description of Artificial Sequence: Synthetic polypeptide
  XENP020670 7G8_H0_L0.66_IgG1_PVA_/S267K Heavy Chain

SEQ ID NO: 20346 - protein, 121 aa, Artificial Sequence; identical to SEQ ID NO: 17586
  Description of Artificial Sequence: Synthetic polypeptide
  VH of XENP020670

SEQ ID NO: 20347 - protein, 5 aa, Artificial Sequence
  Description of Artificial Sequence: Synthetic peptide
  XENP020670 vhCDR1
DAWMD

SEQ ID NO: 20348 - protein, 19 aa, Artificial Sequence
  Description of Artificial Sequence: Synthetic peptide
  XENP020670 vhCDR2
EIRTKANNHATYYAESVKG

SEQ ID NO: 20349 - protein, 10 aa, Artificial Sequence
  Description of Artificial Sequence: Synthetic peptide
  XENP020670 vhCDR3
LANWDWYFDV

SEQ ID NO: 20350 - protein, 218 aa, Artificial Sequence
  Description of Artificial Sequence: Synthetic polypeptide
  XENP020670 7G8_H0_L0.66_IgG1_PVA_/S267K Light Chain
DTVLTQSPASLAVSLGQRATISCKASQSVDYDGDSYMNWYQQKPGQPPKLLIYAASNLQSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20351 - protein, 111 aa, Artificial Sequence
  Description of Artificial Sequence: Synthetic polypeptide
  VL of XENP020670
DTVLTQSPASLAVSLGQRATISCKASQSVDYDGDSYMNWYQQKPGQPPKLLIYAASNLQSGIPARLSGSGSGTDFTLNIHPVEEEDAATYYCQQSNEDPFTFGSGTKLEVK

SEQ ID NO: 20352 - protein, 15 aa, Artificial Sequence
  Description of Artificial Sequence: Synthetic peptide
  XENP020670 vlCDR1
KASQSVDYDGDSYMN

SEQ ID NO: 20353 - protein, 7 aa, Artificial Sequence
  Description of Artificial Sequence: Synthetic peptide
  XENP020670 vlCDR2
AASNLQS

SEQ ID NO: 20354 - protein, 9 aa, Artificial Sequence
  Description of Artificial Sequence: Synthetic peptide
  XENP020670 vlCDR3
QQSNEDPFT

SEQ ID NO: 20355 - protein, 450 aa, Artificial Sequence; identical to SEQ ID NO: 17585
  Description of Artificial Sequence: Synthetic polypeptide
  XENP020671 7G8_H0_L0.67_IgG1_PVA_/S267K Heavy Chain

SEQ ID NO: 20356 - protein, 121 aa, Artificial Sequence; identical to SEQ ID NO: 17586
  Description of Artificial Sequence: Synthetic polypeptide
  VH of XENP020671

SEQ ID NO: 20357 - protein, 5 aa, Artificial Sequence
  Description of Artificial Sequence: Synthetic peptide
  XENP020671 vhCDR1
DAWMD

SEQ ID NO: 20358 - protein, 19 aa, Artificial Sequence
  Description of Artificial Sequence: Synthetic peptide
  XENP020671 vhCDR2
EIRTKANNHATYYAESVKG

SEQ ID NO: 20359 - protein, 10 aa, Artificial Sequence
  Description of Artificial Sequence: Synthetic peptide
  XENP020671 vhCDR3
LANWDWYFDV

SEQ ID NO: 20360 - protein, 218 aa, Artificial Sequence
  Description of Artificial Sequence: Synthetic polypeptide
  XENP020671 7G8_H0_L0.67_IgG1_PVA_/S267K Light Chain
DTVLTQSPASLAVSLGQRATISCKASQSVDYDGDSYMNWYQQKPGQPPKLLIYAASNLDSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20361 - protein, 111 aa, Artificial Sequence
  Description of Artificial Sequence: Synthetic polypeptide
  VL of XENP020671
DTVLTQSPASLAVSLGQRATISCKASQSVDYDGDSYMNWYQQKPGQPPKLLIYAASNLDSGIPARLSGSGSGTDFTLNIHPVEEEDAATYYCQQSNEDPFTFGSGTKLEVK

SEQ ID NO: 20362 - protein, 15 aa, Artificial Sequence
  Description of Artificial Sequence: Synthetic peptide
  XENP020671 vlCDR1
KASQSVDYDGDSYMN

SEQ ID NO: 20363 - protein, 7 aa, Artificial Sequence
  Description of Artificial Sequence: Synthetic peptide
  XENP020671 vlCDR2
AASNLDS

SEQ ID NO: 20364 - protein, 9 aa, Artificial Sequence
  Description of Artificial Sequence: Synthetic peptide
  XENP020671 vlCDR3
QQSNEDPFT

SEQ ID NO: 20365 - protein, 450 aa, Artificial Sequence; identical to SEQ ID NO: 17585
  Description of Artificial Sequence: Synthetic polypeptide
  XENP020672 7G8_H0_L0.68_IgG1_PVA_/S267K Heavy Chain

SEQ ID NO: 20366 - protein, 121 aa, Artificial Sequence; identical to SEQ ID NO: 17586
  Description of Artificial Sequence: Synthetic polypeptide
  VH of XENP020672

SEQ ID NO: 20367 - protein, 5 aa, Artificial Sequence
  Description of Artificial Sequence: Synthetic peptide
  XENP020672 vhCDR1
DAWMD

SEQ ID NO: 20368 - protein, 19 aa, Artificial Sequence
  Description of Artificial Sequence: Synthetic peptide
  XENP020672 vhCDR2
EIRTKANNHATYYAESVKG

SEQ ID NO: 20369 - protein, 10 aa, Artificial Sequence
  Description of Artificial Sequence: Synthetic peptide
  XENP020672 vhCDR3
LANWDWYFDV

SEQ ID NO: 20370 - protein, 218 aa, Artificial Sequence
  Description of Artificial Sequence: Synthetic polypeptide
  XENP020672 7G8_H0_L0.68_IgG1_PVA_/S267K Light Chain
DTVLTQSPASLAVSLGQRATISCKASQSVDYDGDSYMNWYQQKPGQPPKLLIYAASNLKSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20371 - protein, 111 aa, Artificial Sequence
  Description of Artificial Sequence: Synthetic polypeptide
  VL of XENP020672
DTVLTQSPASLAVSLGQRATISCKASQSVDYDGDSYMNWYQQKPGQPPKLLIYAASNLKSGIPARLSGSGSGTDFTLNIHPVEEEDAATYYCQQSNEDPFTFGSGTKLEVK

SEQ ID NO: 20372 - protein, 15 aa, Artificial Sequence
  Description of Artificial Sequence: Synthetic peptide
  XENP020672 vlCDR1
KASQSVDYDGDSYMN

SEQ ID NO: 20373 - protein, 7 aa, Artificial Sequence
  Description of Artificial Sequence: Synthetic peptide
  XENP020672 vlCDR2
AASNLKS

SEQ ID NO: 20374 - protein, 9 aa, Artificial Sequence
  Description of Artificial Sequence: Synthetic peptide
  XENP020672 vlCDR3
QQSNEDPFT

SEQ ID NO: 20375 - protein, 450 aa, Artificial Sequence; identical to SEQ ID NO: 17585
  Description of Artificial Sequence: Synthetic polypeptide
  XENP020673 7G8_H0_L0.69_IgG1_PVA_/S267K Heavy Chain

SEQ ID NO: 20376 - protein, 121 aa, Artificial Sequence; identical to SEQ ID NO: 17586
  Description of Artificial Sequence: Synthetic polypeptide
  VH of XENP020673

SEQ ID NO: 20377 - protein, 5 aa, Artificial Sequence
  Description of Artificial Sequence: Synthetic peptide
  XENP020673 vhCDR1
DAWMD

SEQ ID NO: 20378 - protein, 19 aa, Artificial Sequence
  Description of Artificial Sequence: Synthetic peptide
  XENP020673 vhCDR2
EIRTKANNHATYYAESVKG

SEQ ID NO: 20379 - protein, 10 aa, Artificial Sequence
  Description of Artificial Sequence: Synthetic peptide
  XENP020673 vhCDR3
LANWDWYFDV

SEQ ID NO: 20380 - protein, 218 aa, Artificial Sequence
  Description of Artificial Sequence: Synthetic polypeptide
  XENP020673 7G8_H0_L0.69_IgG1_PVA_/S267K Light Chain
DTVLTQSPASLAVSLGQRATISCKASQSVDYDGDSYMNWYQQKPGQPPKLLIYAASNLHSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20381 - protein, 111 aa, Artificial Sequence
  Description of Artificial Sequence: Synthetic polypeptide
  VL of XENP020673
DTVLTQSPASLAVSLGQRATISCKASQSVDYDGDSYMNWYQQKPGQPPKLLIYAASNLHSGIPARLSGSGSGTDFTLNIHPVEEEDAATYYCQQSNEDPFTFGSGTKLEVK

SEQ ID NO: 20382 - protein, 15 aa, Artificial Sequence
  Description of Artificial Sequence: Synthetic peptide
  XENP020673 vlCDR1
KASQSVDYDGDSYMN

SEQ ID NO: 20383 - protein, 7 aa, Artificial Sequence
  Description of Artificial Sequence: Synthetic peptide
  XENP020673 vlCDR2
AASNLHS

SEQ ID NO: 20384 - protein, 9 aa, Artificial Sequence
  Description of Artificial Sequence: Synthetic peptide
  XENP020673 vlCDR3
QQSNEDPFT

SEQ ID NO: 20385 - protein, 450 aa, Artificial Sequence; identical to SEQ ID NO: 17585
  Description of Artificial Sequence: Synthetic polypeptide
  XENP020674 7G8_H0_L0.70_IgG1_PVA_/S267K Heavy Chain

SEQ ID NO: 20386 - protein, 121 aa, Artificial Sequence; identical to SEQ ID NO: 17586
  Description of Artificial Sequence: Synthetic polypeptide
  VH of XENP020674

SEQ ID NO: 20387 - protein, 5 aa, Artificial Sequence
  Description of Artificial Sequence: Synthetic peptide
  XENP020674 vhCDR1
DAWMD

SEQ ID NO: 20388 - protein, 19 aa, Artificial Sequence
  Description of Artificial Sequence: Synthetic peptide
  XENP020674 vhCDR2
EIRTKANNHATYYAESVKG

SEQ ID NO: 20389 - protein, 10 aa, Artificial Sequence
  Description of Artificial Sequence: Synthetic peptide
  XENP020674 vhCDR3
LANWDWYFDV

SEQ ID NO: 20390 - protein, 218 aa, Artificial Sequence
  Description of Artificial Sequence: Synthetic polypeptide
  XENP020674 7G8_H0_L0.70_IgG1_PVA_/S267K Light Chain
DTVLTQSPASLAVSLGQRATISCKASQSVDYDGDSYMNWYQQKPGQPPKLLIYAASNLASGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20391 - protein, 111 aa, Artificial Sequence
  Description of Artificial Sequence: Synthetic polypeptide
  VL of XENP020674
DTVLTQSPASLAVSLGQRATISCKASQSVDYDGDSYMNWYQQKPGQPPKLLIYAASNLASGIPARLSGSGSGTDFTLNIHPVEEEDAATYYCQQSNEDPFTFGSGTKLEVK

SEQ ID NO: 20392 - protein, 15 aa, Artificial Sequence
  Description of Artificial Sequence: Synthetic peptide
  XENP020674 vlCDR1
KASQSVDYDGDSYMN

SEQ ID NO: 20393 - protein, 7 aa, Artificial Sequence
  Description of Artificial Sequence: Synthetic peptide
  XENP020674 vlCDR2
AASNLAS

SEQ ID NO: 20394 - protein, 9 aa, Artificial Sequence
  Description of Artificial Sequence: Synthetic peptide
  XENP020674 vlCDR3
QQSNEDPFT

SEQ ID NO: 20395 - protein, 450 aa, Artificial Sequence; identical to SEQ ID NO: 17585
  Description of Artificial Sequence: Synthetic polypeptide
  XENP020675 7G8_H0_L0.71_IgG1_PVA_/S267K Heavy Chain

SEQ ID NO: 20396 - protein, 121 aa, Artificial Sequence; identical to SEQ ID NO: 17586
  Description of Artificial Sequence: Synthetic polypeptide
  VH of XENP020675

SEQ ID NO: 20397 - protein, 5 aa, Artificial Sequence
  Description of Artificial Sequence: Synthetic peptide
  XENP020675 vhCDR1
DAWMD

SEQ ID NO: 20398 - protein, 19 aa, Artificial Sequence
  Description of Artificial Sequence: Synthetic peptide
  XENP020675 vhCDR2
EIRTKANNHATYYAESVKG

SEQ ID NO: 20399 - protein, 10 aa, Artificial Sequence
  Description of Artificial Sequence: Synthetic peptide
  XENP020675 vhCDR3
LANWDWYFDV

SEQ ID NO: 20400 - protein, 218 aa, Artificial Sequence
  Description of Artificial Sequence: Synthetic polypeptide
  XENP020675 7G8_H0_L0.71_IgG1_PVA_/S267K Light Chain
DTVLTQSPASLAVSLGQRATISCKASQSVDYDGDSYMNWYQQKPGQPPKLLIYAASNLGSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20401 - protein, 111 aa, Artificial Sequence
  Description of Artificial Sequence: Synthetic polypeptide
  VL of XENP020675
DTVLTQSPASLAVSLGQRATISCKASQSVDYDGDSYMNWYQQKPGQPPKLLIYAASNLGSGIPARLSGSGSGTDFTLNIHPVEEEDAATYYCQQSNEDPFTFGSGTKLEVK

SEQ ID NO: 20402 - protein, 15 aa, Artificial Sequence
  Description of Artificial Sequence: Synthetic peptide
  XENP020675 vlCDR1
KASQSVDYDGDSYMN

SEQ ID NO: 20403 - protein, 7 aa, Artificial Sequence
  Description of Artificial Sequence: Synthetic peptide
  XENP020675 vlCDR2
AASNLGS

SEQ ID NO: 20404 - protein, 9 aa, Artificial Sequence
  Description of Artificial Sequence: Synthetic peptide
  XENP020675 vlCDR3
QQSNEDPFT

SEQ ID NO: 20405 - protein, 450 aa, Artificial Sequence; identical to SEQ ID NO: 17585
  Description of Artificial Sequence: Synthetic polypeptide
  XENP020676 7G8_H0_L0.72_IgG1_PVA_/S267K Heavy Chain

SEQ ID NO: 20406 - protein, 121 aa, Artificial Sequence; identical to SEQ ID NO: 17586
  Description of Artificial Sequence: Synthetic polypeptide
  VH of XENP020676

SEQ ID NO: 20407 - protein, 5 aa, Artificial Sequence
  Description of Artificial Sequence: Synthetic peptide
  XENP020676 vhCDR1
DAWMD

SEQ ID NO: 20408 - protein, 19 aa, Artificial Sequence
  Description of Artificial Sequence: Synthetic peptide
  XENP020676 vhCDR2
EIRTKANNHATYYAESVKG

SEQ ID NO: 20409 - protein, 10 aa, Artificial Sequence
  Description of Artificial Sequence: Synthetic peptide
  XENP020676 vhCDR3
LANWDWYFDV

SEQ ID NO: 20410 - protein, 218 aa, Artificial Sequence
  Description of Artificial Sequence: Synthetic polypeptide
  XENP020676 7G8_H0_L0.72_IgG1_PVA_/S267K Light Chain
DTVLTQSPASLAVSLGQRATISCKASQSVDYDGDSYMNWYQQKPGQPPKLLIYAASNLYSGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20411 - protein, 111 aa, Artificial Sequence
  Description of Artificial Sequence: Synthetic polypeptide
  VL of XENP020676
DTVLTQSPASLAVSLGQRATISCKASQSVDYDGDSYMNWYQQKPGQPPKLLIYAASNLYSGIPARLSGSGSGTDFTLNIHPVEEEDAATYYCQQSNEDPFTFGSGTKLEVK

SEQ ID NO: 20412 - protein, 15 aa, Artificial Sequence
  Description of Artificial Sequence: Synthetic peptide
  XENP020676 vlCDR1
KASQSVDYDGDSYMN

SEQ ID NO: 20413 - protein, 7 aa, Artificial Sequence
  Description of Artificial Sequence: Synthetic peptide
  XENP020676 vlCDR2
AASNLYS

SEQ ID NO: 20414 - protein, 9 aa, Artificial Sequence
  Description of Artificial Sequence: Synthetic peptide
  XENP020676 vlCDR3
QQSNEDPFT

SEQ ID NO: 20415 - protein, 450 aa, Artificial Sequence; identical to SEQ ID NO: 17585
  Description of Artificial Sequence: Synthetic polypeptide
  XENP020677 7G8_H0_L0.73_IgG1_PVA_/S267K Heavy Chain

SEQ ID NO: 20416 - protein, 121 aa, Artificial Sequence; identical to SEQ ID NO: 17586
  Description of Artificial Sequence: Synthetic polypeptide
  VH of XENP020677

SEQ ID NO: 20417 - protein, 5 aa, Artificial Sequence
  Description of Artificial Sequence: Synthetic peptide
  XENP020677 vhCDR1
DAWMD

SEQ ID NO: 20418 - protein, 19 aa, Artificial Sequence
  Description of Artificial Sequence: Synthetic peptide
  XENP020677 vhCDR2
EIRTKANNHATYYAESVKG

SEQ ID NO: 20419 - protein, 10 aa, Artificial Sequence
  Description of Artificial Sequence: Synthetic peptide
  XENP020677 vhCDR3
LANWDWYFDV

SEQ ID NO: 20420 - protein, 218 aa, Artificial Sequence
  Description of Artificial Sequence: Synthetic polypeptide
  XENP020677 7G8_H0_L0.73_IgG1_PVA_/S267K Light Chain
DTVLTQSPASLAVSLGQRATISCKASQSVDYDGDSYMNWYQQKPGQPPKLLIYAASNLISGIPARLSGSGSGTDFTLNIHPVEEEDAATYYCQQSNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20421 - protein, 111 aa, Artificial Sequence
  Description of Artificial Sequence: Synthetic polypeptide
  VL of XENP020677
DTVLTQSPASLAVSLGQRATISCKASQSVDYDGDSYMNWYQQKPGQPPKLLIYAASNLISGIPARLSGSGSGTDFTLNIHPVEEEDAATYYCQQSNEDPFTFGSGTKLEVK

SEQ ID NO: 20422 - protein, 15 aa, Artificial Sequence
  Description of Artificial Sequence: Synthetic peptide
  XENP020677 vlCDR1
KASQSVDYDGDSYMN

SEQ ID NO: 20423 - protein, 7 aa, Artificial Sequence
  Description of Artificial Sequence: Synthetic peptide
  XENP020677 vlCDR2
AASNLIS

SEQ ID NO: 20424 - protein, 9 aa, Artificial Sequence
  Description of Artificial Sequence: Synthetic peptide
  XENP020677 vlCDR3
QQSNEDPFT

SEQ ID NO: 20425 - protein, 450 aa, Artificial Sequence; identical to SEQ ID NO: 17585
  Description of Artificial Sequence: Synthetic polypeptide
  XENP020678 7G8_H0_L0.74_IgG1_PVA_/S267K Heavy Chain

SEQ ID NO: 20426 - protein, 121 aa, Artificial Sequence; identical to SEQ ID NO: 17586
  Description of Artificial Sequence: Synthetic polypeptide
  VH of XENP020678

SEQ ID NO: 20427 - protein, 5 aa, Artificial Sequence
  Description of Artificial Sequence: Synthetic peptide
  XENP020678 vhCDR1
DAWMD

SEQ ID NO: 20428 - protein, 19 aa, Artificial Sequence
  Description of Artificial Sequence: Synthetic peptide
  XENP020678 vhCDR2
EIRTKANNHATYYAESVKG

SEQ ID NO: 20429 - protein, 10 aa, Artificial Sequence
  Description of Artificial Sequence: Synthetic peptide
  XENP020678 vhCDR3
LANWDWYFDV

SEQ ID NO: 20430 - protein, 218 aa, Artificial Sequence
  Description of Artificial Sequence: Synthetic polypeptide
  XENP020678 7G8_H0_L0.74_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQTNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20431 - protein, 111 aa, Artificial Sequence
  Description of Artificial Sequence: Synthetic polypeptide
  VL of XENP020678
DTVLTQSPASLAVSLGQRATISCKASQSVDYDGDSYMNWYQQKPGQPPKLLIYAASNLESGIPARLSGSGSGTDFTLNIHPVEEEDAATYYCQQTNEDPFTFGSGTKLEVK

SEQ ID NO: 20432 - protein, 15 aa, Artificial Sequence
  Description of Artificial Sequence: Synthetic peptide
  XENP020678 vlCDR1
KASQSVDYDGDSYMN

SEQ ID NO: 20433 - protein, 7 aa, Artificial Sequence
  Description of Artificial Sequence: Synthetic peptide
  XENP020678 vlCDR2
AASNLES

SEQ ID NO: 20434 - protein, 9 aa, Artificial Sequence
  Description of Artificial Sequence: Synthetic peptide
  XENP020678 vlCDR3
QQTNEDPFT

SEQ ID NO: 20435 - protein, 450 aa, Artificial Sequence; identical to SEQ ID NO: 17585
  Description of Artificial Sequence: Synthetic polypeptide
  XENP020679 7G8_H0_L0.75_IgG1_PVA_/S267K Heavy Chain

SEQ ID NO: 20436 - protein, 121 aa, Artificial Sequence; identical to SEQ ID NO: 17586
  Description of Artificial Sequence: Synthetic polypeptide
  VH of XENP020679

SEQ ID NO: 20437 - protein, 5 aa, Artificial Sequence
  Description of Artificial Sequence: Synthetic peptide
  XENP020679 vhCDR1
DAWMD

SEQ ID NO: 20438 - protein, 19 aa, Artificial Sequence
  Description of Artificial Sequence: Synthetic peptide
  XENP020679 vhCDR2
EIRTKANNHATYYAESVKG

SEQ ID NO: 20439 - protein, 10 aa, Artificial Sequence
  Description of Artificial Sequence: Synthetic peptide
  XENP020679 vhCDR3
LANWDWYFDV

SEQ ID NO: 20440 - protein, 218 aa, Artificial Sequence
  Description of Artificial Sequence: Synthetic polypeptide
  XENP020679 7G8_H0_L0.75_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQANEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20441 - protein, 111 aa, Artificial Sequence
  Description of Artificial Sequence: Synthetic polypeptide
  VL of XENP020679
DTVLTQSPASLAVSLGQRATISCKASQSVDYDGDSYMNWYQQKPGQPPKLLIYAASNLESGIPARLSGSGSGTDFTLNIHPVEEEDAATYYCQQANEDPFTFGSGTKLEVK

SEQ ID NO: 20442 - protein, 15 aa, Artificial Sequence
  Description of Artificial Sequence: Synthetic peptide
  XENP020679 vlCDR1
KASQSVDYDGDSYMN

SEQ ID NO: 20443 - protein, 7 aa, Artificial Sequence
  Description of Artificial Sequence: Synthetic peptide
  XENP020679 vlCDR2
AASNLES

SEQ ID NO: 20444 - protein, 9 aa, Artificial Sequence
  Description of Artificial Sequence: Synthetic peptide
  XENP020679 vlCDR3
QQANEDPFT

SEQ ID NO: 20445 - protein, 450 aa, Artificial Sequence; identical to SEQ ID NO: 17585
  Description of Artificial Sequence: Synthetic polypeptide
  XENP020680 7G8_H0_L0.76_IgG1_PVA_/S267K Heavy Chain

SEQ ID NO: 20446 - protein, 121 aa, Artificial Sequence; identical to SEQ ID NO: 17586
  Description of Artificial Sequence: Synthetic polypeptide
  VH of XENP020680

SEQ ID NO: 20447 - protein, 5 aa, Artificial Sequence
  Description of Artificial Sequence: Synthetic peptide
  XENP020680 vhCDR1
DAWMD

SEQ ID NO: 20448 - protein, 19 aa, Artificial Sequence
  Description of Artificial Sequence: Synthetic peptide
  XENP020680 vhCDR2
EIRTKANNHATYYAESVKG

SEQ ID NO: 20449 - protein, 10 aa, Artificial Sequence
  Description of Artificial Sequence: Synthetic peptide
  XENP020680 vhCDR3
LANWDWYFDV

SEQ ID NO: 20450 - protein, 218 aa, Artificial Sequence
  Description of Artificial Sequence: Synthetic polypeptide
  XENP020680 7G8_H0_L0.76_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQQNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20451 - protein, 111 aa, Artificial Sequence
  Description of Artificial Sequence: Synthetic polypeptide
  VL of XENP020680
DTVLTQSPASLAVSLGQRATISCKASQSVDYDGDSYMNWYQQKPGQPPKLLIYAASNLESGIPARLSGSGSGTDFTLNIHPVEEEDAATYYCQQQNEDPFTFGSGTKLEVK

SEQ ID NO: 20452 - protein, 15 aa, Artificial Sequence
  Description of Artificial Sequence: Synthetic peptide
  XENP020680 vlCDR1
KASQSVDYDGDSYMN

SEQ ID NO: 20453 - protein, 7 aa, Artificial Sequence
  Description of Artificial Sequence: Synthetic peptide
  XENP020680 vlCDR2
AASNLES

SEQ ID NO: 20454 - protein, 9 aa, Artificial Sequence
  Description of Artificial Sequence: Synthetic peptide
  XENP020680 vlCDR3
QQQNEDPFT

SEQ ID NO: 20455 - protein, 450 aa, Artificial Sequence; identical to SEQ ID NO: 17585
  Description of Artificial Sequence: Synthetic polypeptide
  XENP020681 7G8_H0_L0.77_IgG1_PVA_/S267K Heavy Chain

SEQ ID NO: 20456 - protein, 121 aa, Artificial Sequence; identical to SEQ ID NO: 17586
  Description of Artificial Sequence: Synthetic polypeptide
  VH of XENP020681

SEQ ID NO: 20457 - protein, 5 aa, Artificial Sequence
  Description of Artificial Sequence: Synthetic peptide
  XENP020681 vhCDR1
DAWMD

SEQ ID NO: 20458 - protein, 19 aa, Artificial Sequence
  Description of Artificial Sequence: Synthetic peptide
  XENP020681 vhCDR2
EIRTKANNHATYYAESVKG

SEQ ID NO: 20459 - protein, 10 aa, Artificial Sequence
  Description of Artificial Sequence: Synthetic peptide
  XENP020681 vhCDR3
LANWDWYFDV

SEQ ID NO: 20460 - protein, 218 aa, Artificial Sequence
  Description of Artificial Sequence: Synthetic polypeptide
  XENP020681 7G8_H0_L0.77_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQGNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20461 - protein, 111 aa, Artificial Sequence
  Description of Artificial Sequence: Synthetic polypeptide
  VL of XENP020681
DTVLTQSPASLAVSLGQRATISCKASQSVDYDGDSYMNWYQQKPGQPPKLLIYAASNLESGIPARLSGSGSGTDFTLNIHPVEEEDAATYYCQQGNEDPFTFGSGTKLEVK

SEQ ID NO: 20462 - protein, 15 aa, Artificial Sequence
  Description of Artificial Sequence: Synthetic peptide
  XENP020681 vlCDR1
KASQSVDYDGDSYMN

SEQ ID NO: 20463 - protein, 7 aa, Artificial Sequence
  Description of Artificial Sequence: Synthetic peptide
  XENP020681 vlCDR2
AASNLES

SEQ ID NO: 20464 - protein, 9 aa, Artificial Sequence
  Description of Artificial Sequence: Synthetic peptide
  XENP020681 vlCDR3
QQGNEDPFT

SEQ ID NO: 20465 - protein, 450 aa, Artificial Sequence; identical to SEQ ID NO: 17585
  Description of Artificial Sequence: Synthetic polypeptide
  XENP020682 7G8_H0_L0.78_IgG1_PVA_/S267K Heavy Chain

SEQ ID NO: 20466 - protein, 121 aa, Artificial Sequence; identical to SEQ ID NO: 17586
  Description of Artificial Sequence: Synthetic polypeptide
  VH of XENP020682

SEQ ID NO: 20467 - protein, 5 aa, Artificial Sequence
  Description of Artificial Sequence: Synthetic peptide
  XENP020682 vhCDR1
DAWMD

SEQ ID NO: 20468 - protein, 19 aa, Artificial Sequence
  Description of Artificial Sequence: Synthetic peptide
  XENP020682 vhCDR2
EIRTKANNHATYYAESVKG

SEQ ID NO: 20469 - protein, 10 aa, Artificial Sequence
  Description of Artificial Sequence: Synthetic peptide
  XENP020682 vhCDR3
LANWDWYFDV

SEQ ID NO: 20470 - protein, 218 aa, Artificial Sequence
  Description of Artificial Sequence: Synthetic polypeptide
  XENP020682 7G8_H0_L0.78_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQVNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20471 - protein, 111 aa, Artificial Sequence
  Description of Artificial Sequence: Synthetic polypeptide
  VL of XENP020682
DTVLTQSPASLAVSLGQRATISCKASQSVDYDGDSYMNWYQQKPGQPPKLLIYAASNLESGIPARLSGSGSGTDFTLNIHPVEEEDAATYYCQQVNEDPFTFGSGTKLEVK

SEQ ID NO: 20472 - protein, 15 aa, Artificial Sequence
  Description of Artificial Sequence: Synthetic peptide
  XENP020682 vlCDR1
KASQSVDYDGDSYMN

SEQ ID NO: 20473 - protein, 7 aa, Artificial Sequence
  Description of Artificial Sequence: Synthetic peptide
  XENP020682 vlCDR2
AASNLES

SEQ ID NO: 20474 - protein, 9 aa, Artificial Sequence
  Description of Artificial Sequence: Synthetic peptide
  XENP020682 vlCDR3
QQVNEDPFT

SEQ ID NO: 20475 - protein, 450 aa, Artificial Sequence; identical to SEQ ID NO: 17585
  Description of Artificial Sequence: Synthetic polypeptide
  XENP020683 7G8_H0_L0.79_IgG1_PVA_/S267K Heavy Chain

SEQ ID NO: 20476 - protein, 121 aa, Artificial Sequence; identical to SEQ ID NO: 17586
  Description of Artificial Sequence: Synthetic polypeptide
  VH of XENP020683

SEQ ID NO: 20477 - protein, 5 aa, Artificial Sequence
  Description of Artificial Sequence: Synthetic peptide
  XENP020683 vhCDR1
DAWMD

SEQ ID NO: 20478 - protein, 19 aa, Artificial Sequence
  Description of Artificial Sequence: Synthetic peptide
  XENP020683 vhCDR2
EIRTKANNHATYYAESVKG

SEQ ID NO: 20479 - protein, 10 aa, Artificial Sequence
  Description of Artificial Sequence: Synthetic peptide
  XENP020683 vhCDR3
LANWDWYFDV

SEQ ID NO: 20480 - protein, 218 aa, Artificial Sequence
  Description of Artificial Sequence: Synthetic polypeptide
  XENP020683 7G8_H0_L0.79_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQHNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20481 - protein, 111 aa, Artificial Sequence
  Description of Artificial Sequence: Synthetic polypeptide
  VL of XENP020683
DTVLTQSPASLAVSLGQRATISCKASQSVDYDGDSYMNWYQQKPGQPPKLLIYAASNLESGIPARLSGSGSGTDFTLNIHPVEEEDAATYYCQQHNEDPFTFGSGTKLEVK

SEQ ID NO: 20482 - protein, 15 aa, Artificial Sequence
  Description of Artificial Sequence: Synthetic peptide
  XENP020683 vlCDR1
KASQSVDYDGDSYMN

SEQ ID NO: 20483 - protein, 7 aa, Artificial Sequence
  Description of Artificial Sequence: Synthetic peptide
  XENP020683 vlCDR2
AASNLES

SEQ ID NO: 20484 - protein, 9 aa, Artificial Sequence
  Description of Artificial Sequence: Synthetic peptide
  XENP020683 vlCDR3
QQHNEDPFT

SEQ ID NO: 20485 - protein, 450 aa, Artificial Sequence; identical to SEQ ID NO: 17585
  Description of Artificial Sequence: Synthetic polypeptide
  XENP020684 7G8_H0_L0.80_IgG1_PVA_/S267K Heavy Chain

SEQ ID NO: 20486 - protein, 121 aa, Artificial Sequence; identical to SEQ ID NO: 17586
  Description of Artificial Sequence: Synthetic polypeptide
  VH of XENP020684

SEQ ID NO: 20487 - protein, 5 aa, Artificial Sequence
  Description of Artificial Sequence: Synthetic peptide
  XENP020684 vhCDR1
DAWMD

SEQ ID NO: 20488 - protein, 19 aa, Artificial Sequence
  Description of Artificial Sequence: Synthetic peptide
  XENP020684 vhCDR2
EIRTKANNHATYYAESVKG

SEQ ID NO: 20489 - protein, 10 aa, Artificial Sequence
  Description of Artificial Sequence: Synthetic peptide
  XENP020684 vhCDR3
LANWDWYFDV

SEQ ID NO: 20490 - protein, 218 aa, Artificial Sequence
  Description of Artificial Sequence: Synthetic polypeptide
  XENP020684 7G8_H0_L0.80_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQDNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20491 - protein, 111 aa, Artificial Sequence
  Description of Artificial Sequence: Synthetic polypeptide
  VL of XENP020684
DTVLTQSPASLAVSLGQRATISCKASQSVDYDGDSYMNWYQQKPGQPPKLLIYAASNLESGIPARLSGSGSGTDFTLNIHPVEEEDAATYYCQQDNEDPFTFGSGTKLEVK

SEQ ID NO: 20492 - protein, 15 aa, Artificial Sequence
  Description of Artificial Sequence: Synthetic peptide
  XENP020684 vlCDR1
KASQSVDYDGDSYMN

SEQ ID NO: 20493 - protein, 7 aa, Artificial Sequence
  Description of Artificial Sequence: Synthetic peptide
  XENP020684 vlCDR2
AASNLES

SEQ ID NO: 20494 - protein, 9 aa, Artificial Sequence
  Description of Artificial Sequence: Synthetic peptide
  XENP020684 vlCDR3
QQDNEDPFT

SEQ ID NO: 20495 - protein, 450 aa, Artificial Sequence; identical to SEQ ID NO: 17585
  Description of Artificial Sequence: Synthetic polypeptide
  XENP020685 7G8_H0_L0.81_IgG1_PVA_/S267K Heavy Chain

SEQ ID NO: 20496 - protein, 121 aa, Artificial Sequence; identical to SEQ ID NO: 17586
  Description of Artificial Sequence: Synthetic polypeptide
  VH of XENP020685

SEQ ID NO: 20497 - protein, 5 aa, Artificial Sequence
  Description of Artificial Sequence: Synthetic peptide
  XENP020685 vhCDR1
DAWMD

SEQ ID NO: 20498 - protein, 19 aa, Artificial Sequence
  Description of Artificial Sequence: Synthetic peptide
  XENP020685 vhCDR2
EIRTKANNHATYYAESVKG

SEQ ID NO: 20499 - protein, 10 aa, Artificial Sequence
  Description of Artificial Sequence: Synthetic peptide
  XENP020685 vhCDR3
LANWDWYFDV

SEQ ID NO: 20500 - protein, 218 aa, Artificial Sequence
  Description of Artificial Sequence: Synthetic polypeptide
  XENP020685 7G8_H0_L0.81_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQKNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20501 - protein, 111 aa, Artificial Sequence
  Description of Artificial Sequence: Synthetic polypeptide
  VL of XENP020685
DTVLTQSPASLAVSLGQRATISCKASQSVDYDGDSYMNWYQQKPGQPPKLLIYAASNLESGIPARLSGSGSGTDFTLNIHPVEEEDAATYYCQQKNEDPFTFGSGTKLEVK

SEQ ID NO: 20502 - protein, 15 aa, Artificial Sequence
  Description of Artificial Sequence: Synthetic peptide
  XENP020685 vlCDR1
KASQSVDYDGDSYMN

SEQ ID NO: 20503 - protein, 7 aa, Artificial Sequence
  Description of Artificial Sequence: Synthetic peptide
  XENP020685 vlCDR2
AASNLES

SEQ ID NO: 20504 - protein, 9 aa, Artificial Sequence
  Description of Artificial Sequence: Synthetic peptide
  XENP020685 vlCDR3
QQKNEDPFT

SEQ ID NO: 20505 - protein, 450 aa, Artificial Sequence; identical to SEQ ID NO: 17585
  Description of Artificial Sequence: Synthetic polypeptide
  XENP020686 7G8_H0_L0.82_IgG1_PVA_/S267K Heavy Chain

SEQ ID NO: 20506 - protein, 121 aa, Artificial Sequence; identical to SEQ ID NO: 17586
  Description of Artificial Sequence: Synthetic polypeptide
  VH of XENP020686

SEQ ID NO: 20507 - protein, 5 aa, Artificial Sequence
  Description of Artificial Sequence: Synthetic peptide
  XENP020686 vhCDR1
DAWMD

SEQ ID NO: 20508 - protein, 19 aa, Artificial Sequence
  Description of Artificial Sequence: Synthetic peptide
  XENP020686 vhCDR2
EIRTKANNHATYYAESVKG

SEQ ID NO: 20509 - protein, 10 aa, Artificial Sequence
  Description of Artificial Sequence: Synthetic peptide
  XENP020686 vhCDR3
LANWDWYFDV

SEQ ID NO: 20510 - protein, 218 aa, Artificial Sequence
  Description of Artificial Sequence: Synthetic polypeptide
  XENP020686 7G8_H0_L0.82_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQYNEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20511 - protein, 111 aa, Artificial Sequence
  Description of Artificial Sequence: Synthetic polypeptide
  VL of XENP020686
DTVLTQSPASLAVSLGQRATISCKASQSVDYDGDSYMNWYQQKPGQPPKLLIYAASNLESGIPARLSGSGSGTDFTLNIHPVEEEDAATYYCQQYNEDPFTFGSGTKLEVK

SEQ ID NO: 20512 - protein, 15 aa, Artificial Sequence
  Description of Artificial Sequence: Synthetic peptide
  XENP020686 vlCDR1
KASQSVDYDGDSYMN

SEQ ID NO: 20513 - protein, 7 aa, Artificial Sequence
  Description of Artificial Sequence: Synthetic peptide
  XENP020686 vlCDR2
AASNLES

SEQ ID NO: 20514 - protein, 9 aa, Artificial Sequence
  Description of Artificial Sequence: Synthetic peptide
  XENP020686 vlCDR3
QQYNEDPFT

SEQ ID NO: 20515 - protein, 450 aa, Artificial Sequence; identical to SEQ ID NO: 17585
  Description of Artificial Sequence: Synthetic polypeptide
  XENP020687 7G8_H0_L0.83_IgG1_PVA_/S267K Heavy Chain

SEQ ID NO: 20516 - protein, 121 aa, Artificial Sequence; identical to SEQ ID NO: 17586
  Description of Artificial Sequence: Synthetic polypeptide
  VH of XENP020687

SEQ ID NO: 20517 - protein, 5 aa, Artificial Sequence
  Description of Artificial Sequence: Synthetic peptide
  XENP020687 vhCDR1
DAWMD

SEQ ID NO: 20518 - protein, 19 aa, Artificial Sequence
  Description of Artificial Sequence: Synthetic peptide
  XENP020687 vhCDR2
EIRTKANNHATYYAESVKG

SEQ ID NO: 20519 - protein, 10 aa, Artificial Sequence
  Description of Artificial Sequence: Synthetic peptide
  XENP020687 vhCDR3
LANWDWYFDV

SEQ ID NO: 20520 - protein, 218 aa, Artificial Sequence
  Description of Artificial Sequence: Synthetic polypeptide
  XENP020687 7G8_H0_L0.83_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSDEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20521 - protein, 111 aa, Artificial Sequence
  Description of Artificial Sequence: Synthetic polypeptide
  VL of XENP020687
DTVLTQSPASLAVSLGQRATISCKASQSVDYDGDSYMNWYQQKPGQPPKLLIYAASNLESGIPARLSGSGSGTDFTLNIHPVEEEDAATYYCQQSDEDPFTFGSGTKLEVK

SEQ ID NO: 20522 - protein, 15 aa, Artificial Sequence
  Description of Artificial Sequence: Synthetic peptide
  XENP020687 vlCDR1
KASQSVDYDGDSYMN

SEQ ID NO: 20523 - protein, 7 aa, Artificial Sequence
  Description of Artificial Sequence: Synthetic peptide
  XENP020687 vlCDR2
AASNLES

SEQ ID NO: 20524 - protein, 9 aa, Artificial Sequence
  Description of Artificial Sequence: Synthetic peptide
  XENP020687 vlCDR3
QQSDEDPFT

SEQ ID NO: 20525 - protein, 450 aa, Artificial Sequence; identical to SEQ ID NO: 17585
  Description of Artificial Sequence: Synthetic polypeptide
  XENP020688 7G8_H0_L0.84_IgG1_PVA_/S267K Heavy Chain

SEQ ID NO: 20526 - protein, 121 aa, Artificial Sequence; identical to SEQ ID NO: 17586
  Description of Artificial Sequence: Synthetic polypeptide
  VH of XENP020688

SEQ ID NO: 20527 - protein, 5 aa, Artificial Sequence
  Description of Artificial Sequence: Synthetic peptide
  XENP020688 vhCDR1
DAWMD

SEQ ID NO: 20528 - protein, 19 aa, Artificial Sequence
  Description of Artificial Sequence: Synthetic peptide
  XENP020688 vhCDR2
EIRTKANNHATYYAESVKG

SEQ ID NO: 20529 - protein, 10 aa, Artificial Sequence
  Description of Artificial Sequence: Synthetic peptide
  XENP020688 vhCDR3
LANWDWYFDV

SEQ ID NO: 20530 - protein, 218 aa, Artificial Sequence
  Description of Artificial Sequence: Synthetic polypeptide
  XENP020688 7G8_H0_L0.84_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSHEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20531 - protein, 111 aa, Artificial Sequence
  Description of Artificial Sequence: Synthetic polypeptide
  VL of XENP020688
DTVLTQSPASLAVSLGQRATISCKASQSVDYDGDSYMNWYQQKPGQPPKLLIYAASNLESGIPARLSGSGSGTDFTLNIHPVEEEDAATYYCQQSHEDPFTFGSGTKLEVK

SEQ ID NO: 20532 - protein, 15 aa, Artificial Sequence
  Description of Artificial Sequence: Synthetic peptide
  XENP020688 vlCDR1
KASQSVDYDGDSYMN

SEQ ID NO: 20533 - protein, 7 aa, Artificial Sequence
  Description of Artificial Sequence: Synthetic peptide
  XENP020688 vlCDR2
AASNLES

SEQ ID NO: 20534 - protein, 9 aa, Artificial Sequence
  Description of Artificial Sequence: Synthetic peptide
  XENP020688 vlCDR3
QQSHEDPFT

SEQ ID NO: 20535 - protein, 450 aa, Artificial Sequence; identical to SEQ ID NO: 17585
  Description of Artificial Sequence: Synthetic polypeptide
  XENP020689 7G8_H0_L0.85_IgG1_PVA_/S267K Heavy Chain

SEQ ID NO: 20536 - protein, 121 aa, Artificial Sequence; identical to SEQ ID NO: 17586
  Description of Artificial Sequence: Synthetic polypeptide
  VH of XENP020689

SEQ ID NO: 20537 - protein, 5 aa, Artificial Sequence
  Description of Artificial Sequence: Synthetic peptide
  XENP020689 vhCDR1
DAWMD

SEQ ID NO: 20538 - protein, 19 aa, Artificial Sequence
  Description of Artificial Sequence: Synthetic peptide
  XENP020689 vhCDR2
EIRTKANNHATYYAESVKG

SEQ ID NO: 20539 - protein, 10 aa, Artificial Sequence
  Description of Artificial Sequence: Synthetic peptide
  XENP020689 vhCDR3
LANWDWYFDV

SEQ ID NO: 20540 - protein, 218 aa, Artificial Sequence
  Description of Artificial Sequence: Synthetic polypeptide
  XENP020689 7G8_H0_L0.85_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSEEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20541 - protein, 111 aa, Artificial Sequence
  Description of Artificial Sequence: Synthetic polypeptide
  VL of XENP020689
DTVLTQSPASLAVSLGQRATISCKASQSVDYDGDSYMNWYQQKPGQPPKLLIYAASNLESGIPARLSGSGSGTDFTLNIHPVEEEDAATYYCQQSEEDPFTFGSGTKLEVK

SEQ ID NO: 20542 - protein, 15 aa, Artificial Sequence
  Description of Artificial Sequence: Synthetic peptide
  XENP020689 vlCDR1
KASQSVDYDGDSYMN

SEQ ID NO: 20543 - protein, 7 aa, Artificial Sequence
  Description of Artificial Sequence: Synthetic peptide
  XENP020689 vlCDR2
AASNLES

SEQ ID NO: 20544 - protein, 9 aa, Artificial Sequence
  Description of Artificial Sequence: Synthetic peptide
  XENP020689 vlCDR3
QQSEEDPFT

SEQ ID NO: 20545 - protein, 450 aa, Artificial Sequence; identical to SEQ ID NO: 17585
  Description of Artificial Sequence: Synthetic polypeptide
  XENP020690 7G8_H0_L0.86_IgG1_PVA_/S267K Heavy Chain

SEQ ID NO: 20546 - protein, 121 aa, Artificial Sequence; identical to SEQ ID NO: 17586
  Description of Artificial Sequence: Synthetic polypeptide
  VH of XENP020690

SEQ ID NO: 20547 - protein, 5 aa, Artificial Sequence
  Description of Artificial Sequence: Synthetic peptide
  XENP020690 vhCDR1
DAWMD

SEQ ID NO: 20548 - protein, 19 aa, Artificial Sequence
  Description of Artificial Sequence: Synthetic peptide
  XENP020690 vhCDR2
EIRTKANNHATYYAESVKG

SEQ ID NO: 20549 - protein, 10 aa, Artificial Sequence
  Description of Artificial Sequence: Synthetic peptide
  XENP020690 vhCDR3
LANWDWYFDV

SEQ ID NO: 20550 - protein, 218 aa, Artificial Sequence
  Description of Artificial Sequence: Synthetic polypeptide
  XENP020690 7G8_H0_L0.86_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSSEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20551 - protein, 111 aa, Artificial Sequence
  Description of Artificial Sequence: Synthetic polypeptide
  VL of XENP020690
DTVLTQSPASLAVSLGQRATISCKASQSVDYDGDSYMNWYQQKPGQPPKLLIYAASNLESGIPARLSGSGSGTDFTLNIHPVEEEDAATYYCQQSSEDPFTFGSGTKLEVK

SEQ ID NO: 20552 - protein, 15 aa, Artificial Sequence
  Description of Artificial Sequence: Synthetic peptide
  XENP020690 vlCDR1
KASQSVDYDGDSYMN

SEQ ID NO: 20553 - protein, 7 aa, Artificial Sequence
  Description of Artificial Sequence: Synthetic peptide
  XENP020690 vlCDR2
AASNLES

SEQ ID NO: 20554 - protein, 9 aa, Artificial Sequence
  Description of Artificial Sequence: Synthetic peptide
  XENP020690 vlCDR3
QQSSEDPFT

SEQ ID NO: 20555 - protein, 450 aa, Artificial Sequence; identical to SEQ ID NO: 17585
  Description of Artificial Sequence: Synthetic polypeptide
  XENP020691 7G8_H0_L0.87_IgG1_PVA_/S267K Heavy Chain

SEQ ID NO: 20556 - protein, 121 aa, Artificial Sequence; identical to SEQ ID NO: 17586
  Description of Artificial Sequence: Synthetic polypeptide
  VH of XENP020691

SEQ ID NO: 20557 - protein, 5 aa, Artificial Sequence
  Description of Artificial Sequence: Synthetic peptide
  XENP020691 vhCDR1
DAWMD

SEQ ID NO: 20558 - protein, 19 aa, Artificial Sequence
  Description of Artificial Sequence: Synthetic peptide
  XENP020691 vhCDR2
EIRTKANNHATYYAESVKG

SEQ ID NO: 20559 - protein, 10 aa, Artificial Sequence
  Description of Artificial Sequence: Synthetic peptide
  XENP020691 vhCDR3
LANWDWYFDV

SEQ ID NO: 20560 - protein, 218 aa, Artificial Sequence
  Description of Artificial Sequence: Synthetic polypeptide
  XENP020691 7G8_H0_L0.87_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSREDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20561 - protein, 111 aa, Artificial Sequence
  Description of Artificial Sequence: Synthetic polypeptide
  VL of XENP020691
DTVLTQSPASLAVSLGQRATISCKASQSVDYDGDSYMNWYQQKPGQPPKLLIYAASNLESGIPARLSGSGSGTDFTLNIHPVEEEDAATYYCQQSREDPFTFGSGTKLEVK

SEQ ID NO: 20562 - protein, 15 aa, Artificial Sequence
  Description of Artificial Sequence: Synthetic peptide
  XENP020691 vlCDR1
KASQSVDYDGDSYMN

SEQ ID NO: 20563 - protein, 7 aa, Artificial Sequence
  Description of Artificial Sequence: Synthetic peptide
  XENP020691 vlCDR2
AASNLES

SEQ ID NO: 20564 - protein, 9 aa, Artificial Sequence
  Description of Artificial Sequence: Synthetic peptide
  XENP020691 vlCDR3
QQSREDPFT

SEQ ID NO: 20565 - protein, 450 aa, Artificial Sequence; identical to SEQ ID NO: 17585
  Description of Artificial Sequence: Synthetic polypeptide
  XENP020692 7G8_H0_L0.88_IgG1_PVA_/S267K Heavy Chain

SEQ ID NO: 20566 - protein, 121 aa, Artificial Sequence; identical to SEQ ID NO: 17586
  Description of Artificial Sequence: Synthetic polypeptide
  VH of XENP020692

SEQ ID NO: 20567 - protein, 5 aa, Artificial Sequence
  Description of Artificial Sequence: Synthetic peptide
  XENP020692 vhCDR1
DAWMD

SEQ ID NO: 20568 - protein, 19 aa, Artificial Sequence
  Description of Artificial Sequence: Synthetic peptide
  XENP020692 vhCDR2
EIRTKANNHATYYAESVKG

SEQ ID NO: 20569 - protein, 10 aa, Artificial Sequence
  Description of Artificial Sequence: Synthetic peptide
  XENP020692 vhCDR3
LANWDWYFDV

SEQ ID NO: 20570 - protein, 218 aa, Artificial Sequence
  Description of Artificial Sequence: Synthetic polypeptide
  XENP020692 7G8_H0_L0.88_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSLEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20571 - protein, 111 aa, Artificial Sequence
  Description of Artificial Sequence: Synthetic polypeptide
  VL of XENP020692
DTVLTQSPASLAVSLGQRATISCKASQSVDYDGDSYMNWYQQKPGQPPKLLIYAASNLESGIPARLSGSGSGTDFTLNIHPVEEEDAATYYCQQSLEDPFTFGSGTKLEVK

SEQ ID NO: 20572 - protein, 15 aa, Artificial Sequence
  Description of Artificial Sequence: Synthetic peptide
  XENP020692 vlCDR1
KASQSVDYDGDSYMN

SEQ ID NO: 20573 - protein, 7 aa, Artificial Sequence
  Description of Artificial Sequence: Synthetic peptide
  XENP020692 vlCDR2
AASNLES

SEQ ID NO: 20574 - protein, 9 aa, Artificial Sequence
  Description of Artificial Sequence: Synthetic peptide
  XENP020692 vlCDR3
QQSLEDPFT

SEQ ID NO: 20575 - protein, 450 aa, Artificial Sequence; identical to SEQ ID NO: 17585
  Description of Artificial Sequence: Synthetic polypeptide
  XENP020693 7G8_H0_L0.89_IgG1_PVA_/S267K Heavy Chain

SEQ ID NO: 20576 - protein, 121 aa, Artificial Sequence; identical to SEQ ID NO: 17586
  Description of Artificial Sequence: Synthetic polypeptide
  VH of XENP020693

SEQ ID NO: 20577 - protein, 5 aa, Artificial Sequence
  Description of Artificial Sequence: Synthetic peptide
  XENP020693 vhCDR1
DAWMD

SEQ ID NO: 20578 - protein, 19 aa, Artificial Sequence
  Description of Artificial Sequence: Synthetic peptide
  XENP020693 vhCDR2
EIRTKANNHATYYAESVKG

SEQ ID NO: 20579 - protein, 10 aa, Artificial Sequence
  Description of Artificial Sequence: Synthetic peptide
  XENP020693 vhCDR3
LANWDWYFDV

SEQ ID NO: 20580 - protein, 218 aa, Artificial Sequence
  Description of Artificial Sequence: Synthetic polypeptide
  XENP020693 7G8_H0_L0.89_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSTEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20581 - protein, 111 aa, Artificial Sequence
  Description of Artificial Sequence: Synthetic polypeptide
  VL of XENP020693
DTVLTQSPASLAVSLGQRATISCKASQSVDYDGDSYMNWYQQKPGQPPKLLIYAASNLESGIPARLSGSGSGTDFTLNIHPVEEEDAATYYCQQSTEDPFTFGSGTKLEVK

SEQ ID NO: 20582 - protein, 15 aa, Artificial Sequence
  Description of Artificial Sequence: Synthetic peptide
  XENP020693 vlCDR1
KASQSVDYDGDSYMN

SEQ ID NO: 20583 - protein, 7 aa, Artificial Sequence
  Description of Artificial Sequence: Synthetic peptide
  XENP020693 vlCDR2
AASNLES

SEQ ID NO: 20584 - protein, 9 aa, Artificial Sequence
  Description of Artificial Sequence: Synthetic peptide
  XENP020693 vlCDR3
QQSTEDPFT

SEQ ID NO: 20585 - protein, 450 aa, Artificial Sequence; identical to SEQ ID NO: 17585
  Description of Artificial Sequence: Synthetic polypeptide
  XENP020694 7G8_H0_L0.90_IgG1_PVA_/S267K Heavy Chain

SEQ ID NO: 20586 - protein, 121 aa, Artificial Sequence; identical to SEQ ID NO: 17586
  Description of Artificial Sequence: Synthetic polypeptide
  VH of XENP020694

SEQ ID NO: 20587 - protein, 5 aa, Artificial Sequence
  Description of Artificial Sequence: Synthetic peptide
  XENP020694 vhCDR1
DAWMD

SEQ ID NO: 20588 - protein, 19 aa, Artificial Sequence
  Description of Artificial Sequence: Synthetic peptide
  XENP020694 vhCDR2
EIRTKANNHATYYAESVKG

SEQ ID NO: 20589 - protein, 10 aa, Artificial Sequence
  Description of Artificial Sequence: Synthetic peptide
  XENP020694 vhCDR3
LANWDWYFDV

SEQ ID NO: 20590 - protein, 218 aa, Artificial Sequence
  Description of Artificial Sequence: Synthetic polypeptide
  XENP020694 7G8_H0_L0.90_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSGEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20591 - protein, 111 aa, Artificial Sequence
  Description of Artificial Sequence: Synthetic polypeptide
  VL of XENP020694
DTVLTQSPASLAVSLGQRATISCKASQSVDYDGDSYMNWYQQKPGQPPKLLIYAASNLESGIPARLSGSGSGTDFTLNIHPVEEEDAATYYCQQSGEDPFTFGSGTKLEVK

SEQ ID NO: 20592 - protein, 15 aa, Artificial Sequence
  Description of Artificial Sequence: Synthetic peptide
  XENP020694 vlCDR1
KASQSVDYDGDSYMN

SEQ ID NO: 20593 - protein, 7 aa, Artificial Sequence
  Description of Artificial Sequence: Synthetic peptide
  XENP020694 vlCDR2
AASNLES

SEQ ID NO: 20594 - protein, 9 aa, Artificial Sequence
  Description of Artificial Sequence: Synthetic peptide
  XENP020694 vlCDR3
QQSGEDPFT

SEQ ID NO: 20595 - protein, 450 aa, Artificial Sequence; identical to SEQ ID NO: 17585
  Description of Artificial Sequence: Synthetic polypeptide
  XENP020695 7G8_H0_L0.91_IgG1_PVA_/S267K Heavy Chain

SEQ ID NO: 20596 - protein, 121 aa, Artificial Sequence; identical to SEQ ID NO: 17586
  Description of Artificial Sequence: Synthetic polypeptide
  VH of XENP020695

SEQ ID NO: 20597 - protein, 5 aa, Artificial Sequence
  Description of Artificial Sequence: Synthetic peptide
  XENP020695 vhCDR1
DAWMD

SEQ ID NO: 20598 - protein, 19 aa, Artificial Sequence
  Description of Artificial Sequence: Synthetic peptide
  XENP020695 vhCDR2
EIRTKANNHATYYAESVKG

SEQ ID NO: 20599 - protein, 10 aa, Artificial Sequence
  Description of Artificial Sequence: Synthetic peptide
  XENP020695 vhCDR3
LANWDWYFDV

SEQ ID NO: 20600 - protein, 218 aa, Artificial Sequence
  Description of Artificial Sequence: Synthetic polypeptide
  XENP020695 7G8_H0_L0.91_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSYEDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20601 - protein, 111 aa, Artificial Sequence
  Description of Artificial Sequence: Synthetic polypeptide
  VL of XENP020695
DTVLTQSPASLAVSLGQRATISCKASQSVDYDGDSYMNWYQQKPGQPPKLLIYAASNLESGIPARLSGSGSGTDFTLNIHPVEEEDAATYYCQQSYEDPFTFGSGTKLEVK

SEQ ID NO: 20602 - protein, 15 aa, Artificial Sequence
  Description of Artificial Sequence: Synthetic peptide
  XENP020695 vlCDR1
KASQSVDYDGDSYMN

SEQ ID NO: 20603 - protein, 7 aa, Artificial Sequence
  Description of Artificial Sequence: Synthetic peptide
  XENP020695 vlCDR2
AASNLES

SEQ ID NO: 20604 - protein, 9 aa, Artificial Sequence
  Description of Artificial Sequence: Synthetic peptide
  XENP020695 vlCDR3
QQSYEDPFT

SEQ ID NO: 20605 - protein, 450 aa, Artificial Sequence; identical to SEQ ID NO: 17585
  Description of Artificial Sequence: Synthetic polypeptide
  XENP020696 7G8_H0_L0.92_IgG1_PVA_/S267K Heavy Chain

SEQ ID NO: 20606 - protein, 121 aa, Artificial Sequence; identical to SEQ ID NO: 17586
  Description of Artificial Sequence: Synthetic polypeptide
  VH of XENP020696

SEQ ID NO: 20607 - protein, 5 aa, Artificial Sequence
  Description of Artificial Sequence: Synthetic peptide
  XENP020696 vhCDR1
DAWMD

SEQ ID NO: 20608 - protein, 19 aa, Artificial Sequence
  Description of Artificial Sequence: Synthetic peptide
  XENP020696 vhCDR2
EIRTKANNHATYYAESVKG

SEQ ID NO: 20609 - protein, 10 aa, Artificial Sequence
  Description of Artificial Sequence: Synthetic peptide
  XENP020696 vhCDR3
LANWDWYFDV

SEQ ID NO: 20610 - protein, 218 aa, Artificial Sequence
  Description of Artificial Sequence: Synthetic polypeptide
  XENP020696 7G8_H0_L0.92_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNQDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20611 - protein, 111 aa, Artificial Sequence
  Description of Artificial Sequence: Synthetic polypeptide
  VL of XENP020696
DTVLTQSPASLAVSLGQRATISCKASQSVDYDGDSYMNWYQQKPGQPPKLLIYAASNLESGIPARLSGSGSGTDFTLNIHPVEEEDAATYYCQQSNQDPFTFGSGTKLEVK

SEQ ID NO: 20612 - protein, 15 aa, Artificial Sequence
  Description of Artificial Sequence: Synthetic peptide
  XENP020696 vlCDR1
KASQSVDYDGDSYMN

SEQ ID NO: 20613 - protein, 7 aa, Artificial Sequence
  Description of Artificial Sequence: Synthetic peptide
  XENP020696 vlCDR2
AASNLES

SEQ ID NO: 20614 - protein, 9 aa, Artificial Sequence
  Description of Artificial Sequence: Synthetic peptide
  XENP020696 vlCDR3
QQSNQDPFT

SEQ ID NO: 20615 - protein, 450 aa, Artificial Sequence; identical to SEQ ID NO: 17585
  Description of Artificial Sequence: Synthetic polypeptide
  XENP020701 7G8_H0_L0.93_IgG1_PVA_/S267K Heavy Chain

SEQ ID NO: 20616 - protein, 121 aa, Artificial Sequence; identical to SEQ ID NO: 17586
  Description of Artificial Sequence: Synthetic polypeptide
  VH of XENP020701

SEQ ID NO: 20617 - protein, 5 aa, Artificial Sequence
  Description of Artificial Sequence: Synthetic peptide
  XENP020701 vhCDR1
DAWMD

SEQ ID NO: 20618 - protein, 19 aa, Artificial Sequence
  Description of Artificial Sequence: Synthetic peptide
  XENP020701 vhCDR2
EIRTKANNHATYYAESVKG

SEQ ID NO: 20619 - protein, 10 aa, Artificial Sequence
  Description of Artificial Sequence: Synthetic peptide
  XENP020701 vhCDR3
LANWDWYFDV

SEQ ID NO: 20620 - protein, 218 aa, Artificial Sequence
  Description of Artificial Sequence: Synthetic polypeptide
  XENP020701 7G8_H0_L0.93_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNDDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20621 - protein, 111 aa, Artificial Sequence
  Description of Artificial Sequence: Synthetic polypeptide
  VL of XENP020701
DTVLTQSPASLAVSLGQRATISCKASQSVDYDGDSYMNWYQQKPGQPPKLLIYAASNLESGIPARLSGSGSGTDFTLNIHPVEEEDAATYYCQQSNDDPFTFGSGTKLEVK

SEQ ID NO: 20622 - protein, 15 aa, Artificial Sequence
  Description of Artificial Sequence: Synthetic peptide
  XENP020701 vlCDR1
KASQSVDYDGDSYMN

SEQ ID NO: 20623 - protein, 7 aa, Artificial Sequence
  Description of Artificial Sequence: Synthetic peptide
  XENP020701 vlCDR2
AASNLES

SEQ ID NO: 20624 - protein, 9 aa, Artificial Sequence
  Description of Artificial Sequence: Synthetic peptide
  XENP020701 vlCDR3
QQSNDDPFT

SEQ ID NO: 20625 - protein, 450 aa, Artificial Sequence; identical to SEQ ID NO: 17585
  Description of Artificial Sequence: Synthetic polypeptide
  XENP020702 7G8_H0_L0.94_IgG1_PVA_/S267K Heavy Chain

SEQ ID NO: 20626 - protein, 121 aa, Artificial Sequence; identical to SEQ ID NO: 17586
  Description of Artificial Sequence: Synthetic polypeptide
  VH of XENP020702

SEQ ID NO: 20627 - protein, 5 aa, Artificial Sequence
  Description of Artificial Sequence: Synthetic peptide
  XENP020702 vhCDR1
DAWMD

SEQ ID NO: 20628 - protein, 19 aa, Artificial Sequence
  Description of Artificial Sequence: Synthetic peptide
  XENP020702 vhCDR2
EIRTKANNHATYYAESVKG

SEQ ID NO: 20629 - protein, 10 aa, Artificial Sequence
  Description of Artificial Sequence: Synthetic peptide
  XENP020702 vhCDR3
LANWDWYFDV

SEQ ID NO: 20630 - protein, 218 aa, Artificial Sequence
  Description of Artificial Sequence: Synthetic polypeptide
  XENP020702 7G8_H0_L0.94_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNKDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20631 - protein, 111 aa, Artificial Sequence
  Description of Artificial Sequence: Synthetic polypeptide
  VL of XENP020702
DTVLTQSPASLAVSLGQRATISCKASQSVDYDGDSYMNWYQQKPGQPPKLLIYAASNLESGIPARLSGSGSGTDFTLNIHPVEEEDAATYYCQQSNKDPFTFGSGTKLEVK

SEQ ID NO: 20632 - protein, 15 aa, Artificial Sequence
  Description of Artificial Sequence: Synthetic peptide
  XENP020702 vlCDR1
KASQSVDYDGDSYMN

SEQ ID NO: 20633 - protein, 7 aa, Artificial Sequence
  Description of Artificial Sequence: Synthetic peptide
  XENP020702 vlCDR2
AASNLES

SEQ ID NO: 20634 - protein, 9 aa, Artificial Sequence
  Description of Artificial Sequence: Synthetic peptide
  XENP020702 vlCDR3
QQSNKDPFT

SEQ ID NO: 20635 - protein, 450 aa, Artificial Sequence; identical to SEQ ID NO: 17585
  Description of Artificial Sequence: Synthetic polypeptide
  XENP020703 7G8_H0_L0.95_IgG1_PVA_/S267K Heavy Chain

SEQ ID NO: 20636 - protein, 121 aa, Artificial Sequence; identical to SEQ ID NO: 17586
  Description of Artificial Sequence: Synthetic polypeptide
  VH of XENP020703

SEQ ID NO: 20637 - protein, 5 aa, Artificial Sequence
  Description of Artificial Sequence: Synthetic peptide
  XENP020703 vhCDR1
DAWMD

SEQ ID NO: 20638 - protein, 19 aa, Artificial Sequence
  Description of Artificial Sequence: Synthetic peptide
  XENP020703 vhCDR2
EIRTKANNHATYYAESVKG

SEQ ID NO: 20639 - protein, 10 aa, Artificial Sequence
  Description of Artificial Sequence: Synthetic peptide
  XENP020703 vhCDR3
LANWDWYFDV

SEQ ID NO: 20640 - protein, 218 aa, Artificial Sequence
  Description of Artificial Sequence: Synthetic polypeptide
  XENP020703 7G8_H0_L0.95_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNSDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20641 - protein, 111 aa, Artificial Sequence
  Description of Artificial Sequence: Synthetic polypeptide
  VL of XENP020703
DTVLTQSPASLAVSLGQRATISCKASQSVDYDGDSYMNWYQQKPGQPPKLLIYAASNLESGIPARLSGSGSGTDFTLNIHPVEEEDAATYYCQQSNSDPFTFGSGTKLEVK

SEQ ID NO: 20642 - protein, 15 aa, Artificial Sequence
  Description of Artificial Sequence: Synthetic peptide
  XENP020703 vlCDR1
KASQSVDYDGDSYMN

SEQ ID NO: 20643 - protein, 7 aa, Artificial Sequence
  Description of Artificial Sequence: Synthetic peptide
  XENP020703 vlCDR2
AASNLES

SEQ ID NO: 20644 - protein, 9 aa, Artificial Sequence
  Description of Artificial Sequence: Synthetic peptide
  XENP020703 vlCDR3
QQSNSDPFT

SEQ ID NO: 20645 - protein, 450 aa, Artificial Sequence; identical to SEQ ID NO: 17585
  Description of Artificial Sequence: Synthetic polypeptide
  XENP020704 7G8_H0_L0.96_IgG1_PVA_/S267K Heavy Chain

SEQ ID NO: 20646 - protein, 121 aa, Artificial Sequence; identical to SEQ ID NO: 17586
  Description of Artificial Sequence: Synthetic polypeptide
  VH of XENP020704

SEQ ID NO: 20647 - protein, 5 aa, Artificial Sequence
  Description of Artificial Sequence: Synthetic peptide
  XENP020704 vhCDR1
DAWMD

SEQ ID NO: 20648 - protein, 19 aa, Artificial Sequence
  Description of Artificial Sequence: Synthetic peptide
  XENP020704 vhCDR2
EIRTKANNHATYYAESVKG

SEQ ID NO: 20649 - protein, 10 aa, Artificial Sequence
  Description of Artificial Sequence: Synthetic peptide
  XENP020704 vhCDR3
LANWDWYFDV

SEQ ID NO: 20650 - protein, 218 aa, Artificial Sequence
  Description of Artificial Sequence: Synthetic polypeptide
  XENP020704 7G8_H0_L0.96_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNHDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20651 - protein, 111 aa, Artificial Sequence
  Description of Artificial Sequence: Synthetic polypeptide
  VL of XENP020704
DTVLTQSPASLAVSLGQRATISCKASQSVDYDGDSYMNWYQQKPGQPPKLLIYAASNLESGIPARLSGSGSGTDFTLNIHPVEEEDAATYYCQQSNHDPFTFGSGTKLEVK

SEQ ID NO: 20652 - protein, 15 aa, Artificial Sequence
  Description of Artificial Sequence: Synthetic peptide
  XENP020704 vlCDR1
KASQSVDYDGDSYMN

SEQ ID NO: 20653 - protein, 7 aa, Artificial Sequence
  Description of Artificial Sequence: Synthetic peptide
  XENP020704 vlCDR2
AASNLES

SEQ ID NO: 20654 - protein, 9 aa, Artificial Sequence
  Description of Artificial Sequence: Synthetic peptide
  XENP020704 vlCDR3
QQSNHDPFT

SEQ ID NO: 20655 - protein, 450 aa, Artificial Sequence; identical to SEQ ID NO: 17585
  Description of Artificial Sequence: Synthetic polypeptide
  XENP020705 7G8_H0_L0.97_IgG1_PVA_/S267K Heavy Chain

SEQ ID NO: 20656 - protein, 121 aa, Artificial Sequence; identical to SEQ ID NO: 17586
  Description of Artificial Sequence: Synthetic polypeptide
  VH of XENP020705

SEQ ID NO: 20657 - protein, 5 aa, Artificial Sequence
  Description of Artificial Sequence: Synthetic peptide
  XENP020705 vhCDR1
DAWMD

SEQ ID NO: 20658 - protein, 19 aa, Artificial Sequence
  Description of Artificial Sequence: Synthetic peptide
  XENP020705 vhCDR2
EIRTKANNHATYYAESVKG

SEQ ID NO: 20659 - protein, 10 aa, Artificial Sequence
  Description of Artificial Sequence: Synthetic peptide
  XENP020705 vhCDR3
LANWDWYFDV

SEQ ID NO: 20660 - protein, 218 aa, Artificial Sequence
  Description of Artificial Sequence: Synthetic polypeptide
  XENP020705 7G8_H0_L0.97_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNADPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20661 - protein, 111 aa, Artificial Sequence
  Description of Artificial Sequence: Synthetic polypeptide
  VL of XENP020705
DTVLTQSPASLAVSLGQRATISCKASQSVDYDGDSYMNWYQQKPGQPPKLLIYAASNLESGIPARLSGSGSGTDFTLNIHPVEEEDAATYYCQQSNADPFTFGSGTKLEVK

SEQ ID NO: 20662 - protein, 15 aa, Artificial Sequence
  Description of Artificial Sequence: Synthetic peptide
  XENP020705 vlCDR1
KASQSVDYDGDSYMN

SEQ ID NO: 20663 - protein, 7 aa, Artificial Sequence
  Description of Artificial Sequence: Synthetic peptide
  XENP020705 vlCDR2
AASNLES

SEQ ID NO: 20664 - protein, 9 aa, Artificial Sequence
  Description of Artificial Sequence: Synthetic peptide
  XENP020705 vlCDR3
QQSNADPFT

SEQ ID NO: 20665 - protein, 450 aa, Artificial Sequence; identical to SEQ ID NO: 17585
  Description of Artificial Sequence: Synthetic polypeptide
  XENP020706 7G8_H0_L0.98_IgG1_PVA_/S267K Heavy Chain

SEQ ID NO: 20666 - protein, 121 aa, Artificial Sequence; identical to SEQ ID NO: 17586
  Description of Artificial Sequence: Synthetic polypeptide
  VH of XENP020706

SEQ ID NO: 20667 - protein, 5 aa, Artificial Sequence
  Description of Artificial Sequence: Synthetic peptide
  XENP020706 vhCDR1
DAWMD

SEQ ID NO: 20668 - protein, 19 aa, Artificial Sequence
  Description of Artificial Sequence: Synthetic peptide
  XENP020706 vhCDR2
EIRTKANNHATYYAESVKG

SEQ ID NO: 20669 - protein, 10 aa, Artificial Sequence
  Description of Artificial Sequence: Synthetic peptide
  XENP020706 vhCDR3
LANWDWYFDV

SEQ ID NO: 20670 - protein, 218 aa, Artificial Sequence
  Description of Artificial Sequence: Synthetic polypeptide
  XENP020706 7G8_H0_L0.98_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNGDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20671 - protein, 111 aa, Artificial Sequence
  Description of Artificial Sequence: Synthetic polypeptide
  VL of XENP020706
DTVLTQSPASLAVSLGQRATISCKASQSVDYDGDSYMNWYQQKPGQPPKLLIYAASNLESGIPARLSGSGSGTDFTLNIHPVEEEDAATYYCQQSNGDPFTFGSGTKLEVK

SEQ ID NO: 20672 - protein, 15 aa, Artificial Sequence
  Description of Artificial Sequence: Synthetic peptide
  XENP020706 vlCDR1
KASQSVDYDGDSYMN

SEQ ID NO: 20673 - protein, 7 aa, Artificial Sequence
  Description of Artificial Sequence: Synthetic peptide
  XENP020706 vlCDR2
AASNLES

SEQ ID NO: 20674 - protein, 9 aa, Artificial Sequence
  Description of Artificial Sequence: Synthetic peptide
  XENP020706 vlCDR3
QQSNGDPFT

SEQ ID NO: 20675 - protein, 450 aa, Artificial Sequence; identical to SEQ ID NO: 17585
  Description of Artificial Sequence: Synthetic polypeptide
  XENP020707 7G8_H0_L0.99_IgG1_PVA_/S267K Heavy Chain

SEQ ID NO: 20676 - protein, 121 aa, Artificial Sequence; identical to SEQ ID NO: 17586
  Description of Artificial Sequence: Synthetic polypeptide
  VH of XENP020707

SEQ ID NO: 20677 - protein, 5 aa, Artificial Sequence
  Description of Artificial Sequence: Synthetic peptide
  XENP020707 vhCDR1
DAWMD

SEQ ID NO: 20678 - protein, 19 aa, Artificial Sequence
  Description of Artificial Sequence: Synthetic peptide
  XENP020707 vhCDR2
EIRTKANNHATYYAESVKG

SEQ ID NO: 20679 - protein, 10 aa, Artificial Sequence
  Description of Artificial Sequence: Synthetic peptide
  XENP020707 vhCDR3
LANWDWYFDV

SEQ ID NO: 20680 - protein, 218 aa, Artificial Sequence
  Description of Artificial Sequence: Synthetic polypeptide
  XENP020707 7G8_H0_L0.99_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNYDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20681 - protein, 111 aa, Artificial Sequence
  Description of Artificial Sequence: Synthetic polypeptide
  VL of XENP020707
DTVLTQSPASLAVSLGQRATISCKASQSVDYDGDSYMNWYQQKPGQPPKLLIYAASNLESGIPARLSGSGSGTDFTLNIHPVEEEDAATYYCQQSNYDPFTFGSGTKLEVK

SEQ ID NO: 20682 - protein, 15 aa, Artificial Sequence
  Description of Artificial Sequence: Synthetic peptide
  XENP020707 vlCDR1
KASQSVDYDGDSYMN

SEQ ID NO: 20683 - protein, 7 aa, Artificial Sequence
  Description of Artificial Sequence: Synthetic peptide
  XENP020707 vlCDR2
AASNLES

SEQ ID NO: 20684 - protein, 9 aa, Artificial Sequence
  Description of Artificial Sequence: Synthetic peptide
  XENP020707 vlCDR3
QQSNYDPFT

SEQ ID NO: 20685 - protein, 450 aa, Artificial Sequence; identical to SEQ ID NO: 17585
  Description of Artificial Sequence: Synthetic polypeptide
  XENP020708 7G8_H0_L0.100_IgG1_PVA_/S267K Heavy Chain

SEQ ID NO: 20686 - protein, 121 aa, Artificial Sequence; identical to SEQ ID NO: 17586
  Description of Artificial Sequence: Synthetic polypeptide
  VH of XENP020708

SEQ ID NO: 20687 - protein, 5 aa, Artificial Sequence
  Description of Artificial Sequence: Synthetic peptide
  XENP020708 vhCDR1
DAWMD

SEQ ID NO: 20688 - protein, 19 aa, Artificial Sequence
  Description of Artificial Sequence: Synthetic peptide
  XENP020708 vhCDR2
EIRTKANNHATYYAESVKG

SEQ ID NO: 20689 - protein, 10 aa, Artificial Sequence
  Description of Artificial Sequence: Synthetic peptide
  XENP020708 vhCDR3
LANWDWYFDV

SEQ ID NO: 20690 - protein, 218 aa, Artificial Sequence
  Description of Artificial Sequence: Synthetic polypeptide
  XENP020708 7G8_H0_L0.100_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNIDPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20691 - protein, 111 aa, Artificial Sequence
  Description of Artificial Sequence: Synthetic polypeptide
  VL of XENP020708
DTVLTQSPASLAVSLGQRATISCKASQSVDYDGDSYMNWYQQKPGQPPKLLIYAASNLESGIPARLSGSGSGTDFTLNIHPVEEEDAATYYCQQSNIDPFTFGSGTKLEVK

SEQ ID NO: 20692 - protein, 15 aa, Artificial Sequence
  Description of Artificial Sequence: Synthetic peptide
  XENP020708 vlCDR1
KASQSVDYDGDSYMN

SEQ ID NO: 20693 - protein, 7 aa, Artificial Sequence
  Description of Artificial Sequence: Synthetic peptide
  XENP020708 vlCDR2
AASNLES

SEQ ID NO: 20694 - protein, 9 aa, Artificial Sequence
  Description of Artificial Sequence: Synthetic peptide
  XENP020708 vlCDR3
QQSNIDPFT

SEQ ID NO: 20695 - protein, 450 aa, Artificial Sequence; identical to SEQ ID NO: 17585
  Description of Artificial Sequence: Synthetic polypeptide
  XENP020709 7G8_H0_L0.101_IgG1_PVA_/S267K Heavy Chain

SEQ ID NO: 20696 - protein, 121 aa, Artificial Sequence; identical to SEQ ID NO: 17586
  Description of Artificial Sequence: Synthetic polypeptide
  VH of XENP020709

SEQ ID NO: 20697 - protein, 5 aa, Artificial Sequence
  Description of Artificial Sequence: Synthetic peptide
  XENP020709 vhCDR1
DAWMD

SEQ ID NO: 20698 - protein, 19 aa, Artificial Sequence
  Description of Artificial Sequence: Synthetic peptide
  XENP020709 vhCDR2
EIRTKANNHATYYAESVKG

SEQ ID NO: 20699 - protein, 10 aa, Artificial Sequence
  Description of Artificial Sequence: Synthetic peptide
  XENP020709 vhCDR3
LANWDWYFDV

SEQ ID NO: 20700 - protein, 218 aa, Artificial Sequence
  Description of Artificial Sequence: Synthetic polypeptide
  XENP020709 7G8_H0_L0.101_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNENPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20701 - protein, 111 aa, Artificial Sequence
  Description of Artificial Sequence: Synthetic polypeptide
  VL of XENP020709
DTVLTQSPASLAVSLGQRATISCKASQSVDYDGDSYMNWYQQKPGQPPKLLIYAASNLESGIPARLSGSGSGTDFTLNIHPVEEEDAATYYCQQSNENPFTFGSGTKLEVK

SEQ ID NO: 20702 - protein, 15 aa, Artificial Sequence
  Description of Artificial Sequence: Synthetic peptide
  XENP020709 vlCDR1
KASQSVDYDGDSYMN

SEQ ID NO: 20703 - protein, 7 aa, Artificial Sequence
  Description of Artificial Sequence: Synthetic peptide
  XENP020709 vlCDR2
AASNLES

SEQ ID NO: 20704 - protein, 9 aa, Artificial Sequence
  Description of Artificial Sequence: Synthetic peptide
  XENP020709 vlCDR3
QQSNENPFT

SEQ ID NO: 20705 - protein, 450 aa, Artificial Sequence; identical to SEQ ID NO: 17585
  Description of Artificial Sequence: Synthetic polypeptide
  XENP020710 7G8_H0_L0.102_IgG1_PVA_/S267K Heavy Chain

SEQ ID NO: 20706 - protein, 121 aa, Artificial Sequence; identical to SEQ ID NO: 17586
  Description of Artificial Sequence: Synthetic polypeptide
  VH of XENP020710

SEQ ID NO: 20707 - protein, 5 aa, Artificial Sequence
  Description of Artificial Sequence: Synthetic peptide
  XENP020710 vhCDR1
DAWMD

SEQ ID NO: 20708 - protein, 19 aa, Artificial Sequence
  Description of Artificial Sequence: Synthetic peptide
  XENP020710 vhCDR2
EIRTKANNHATYYAESVKG

SEQ ID NO: 20709 - protein, 10 aa, Artificial Sequence
  Description of Artificial Sequence: Synthetic peptide
  XENP020710 vhCDR3
LANWDWYFDV

SEQ ID NO: 20710 - protein, 218 aa, Artificial Sequence
  Description of Artificial Sequence: Synthetic polypeptide
  XENP020710 7G8_H0_L0.102_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEEPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20711 - protein, 111 aa, Artificial Sequence
  Description of Artificial Sequence: Synthetic polypeptide
  VL of XENP020710
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEEPFTFGSGTKLEVK

SEQ ID NO: 20712 - protein, 15 aa, Artificial Sequence
  Description of Artificial Sequence: Synthetic peptide
  XENP020710 vlCDR1
KASQSVDYDGDSYMN

SEQ ID NO: 20713 - protein, 7 aa, Artificial Sequence
  Description of Artificial Sequence: Synthetic peptide
  XENP020710 vlCDR2
AASNLES

SEQ ID NO: 20714 - protein, 9 aa, Artificial Sequence
  Description of Artificial Sequence: Synthetic peptide
  XENP020710 vlCDR3
QQSNEEPFT

SEQ ID NO: 20715 - protein, 450 aa, Artificial Sequence; identical to SEQ ID NO: 17585
  Description of Artificial Sequence: Synthetic polypeptide
  XENP020711 7G8_H0_L0.103_IgG1_PVA_/S267K Heavy Chain

SEQ ID NO: 20716 - protein, 121 aa, Artificial Sequence; identical to SEQ ID NO: 17586
  Description of Artificial Sequence: Synthetic polypeptide
  VH of XENP020711

SEQ ID NO: 20717 - protein, 5 aa, Artificial Sequence
  Description of Artificial Sequence: Synthetic peptide
  XENP020711 vhCDR1
DAWMD

SEQ ID NO: 20718 - protein, 19 aa, Artificial Sequence
  Description of Artificial Sequence: Synthetic peptide
  XENP020711 vhCDR2
EIRTKANNHATYYAESVKG

SEQ ID NO: 20719 - protein, 10 aa, Artificial Sequence
  Description of Artificial Sequence: Synthetic peptide
  XENP020711 vhCDR3
LANWDWYFDV

SEQ ID NO: 20720 - protein, 218 aa, Artificial Sequence
  Description of Artificial Sequence: Synthetic polypeptide
  XENP020711 7G8_H0_L0.103_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEHPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20721 - protein, 111 aa, Artificial Sequence
  Description of Artificial Sequence: Synthetic polypeptide
  VL of XENP020711
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEHPFTFGSGTKLEVK

SEQ ID NO: 20722 - protein, 15 aa, Artificial Sequence
  Description of Artificial Sequence: Synthetic peptide
  XENP020711 vlCDR1
KASQSVDYDGDSYMN

SEQ ID NO: 20723 - protein, 7 aa, Artificial Sequence
  Description of Artificial Sequence: Synthetic peptide
  XENP020711 vlCDR2
AASNLES

SEQ ID NO: 20724 - protein, 9 aa, Artificial Sequence
  Description of Artificial Sequence: Synthetic peptide
  XENP020711 vlCDR3
QQSNEHPFT

SEQ ID NO: 20725 - protein, 450 aa, Artificial Sequence; identical to SEQ ID NO: 17585
  Description of Artificial Sequence: Synthetic polypeptide
  XENP020712 7G8_H0_L0.104_IgG1_PVA_/S267K Heavy Chain

SEQ ID NO: 20726 - protein, 121 aa, Artificial Sequence; identical to SEQ ID NO: 17586
  Description of Artificial Sequence: Synthetic polypeptide
  VH of XENP020712

SEQ ID NO: 20727 - protein, 5 aa, Artificial Sequence
  Description of Artificial Sequence: Synthetic peptide
  XENP020712 vhCDR1
DAWMD

SEQ ID NO: 20728 - protein, 19 aa, Artificial Sequence
  Description of Artificial Sequence: Synthetic peptide
  XENP020712 vhCDR2
EIRTKANNHATYYAESVKG

SEQ ID NO: 20729 - protein, 10 aa, Artificial Sequence
  Description of Artificial Sequence: Synthetic peptide
  XENP020712 vhCDR3
LANWDWYFDV

SEQ ID NO: 20730 - protein, 218 aa, Artificial Sequence
  Description of Artificial Sequence: Synthetic polypeptide
  XENP020712 7G8_H0_L0.104_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNERPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20731 - protein, 111 aa, Artificial Sequence
  Description of Artificial Sequence: Synthetic polypeptide
  VL of XENP020712
DTVLTQSPASLAVSLGQRATISCKASQSVDYDGDSYMNWYQQKPGQPPKLLIYAASNLESGIPARLSGSGSGTDFTLNIHPVEEEDAATYYCQQSNERPFTFGSGTKLEVK

SEQ ID NO: 20732 - protein, 15 aa, Artificial Sequence
  Description of Artificial Sequence: Synthetic peptide
  XENP020712 vlCDR1
KASQSVDYDGDSYMN

SEQ ID NO: 20733 - protein, 7 aa, Artificial Sequence
  Description of Artificial Sequence: Synthetic peptide
  XENP020712 vlCDR2
AASNLES

SEQ ID NO: 20734 - protein, 9 aa, Artificial Sequence
  Description of Artificial Sequence: Synthetic peptide
  XENP020712 vlCDR3
QQSNERPFT

SEQ ID NO: 20735 - protein, 450 aa, Artificial Sequence; identical to SEQ ID NO: 17585
  Description of Artificial Sequence: Synthetic polypeptide
  XENP020713 7G8_H0_L0.105_IgG1_PVA_/S267K Heavy Chain

SEQ ID NO: 20736 - protein, 121 aa, Artificial Sequence; identical to SEQ ID NO: 17586
  Description of Artificial Sequence: Synthetic polypeptide
  VH of XENP020713

SEQ ID NO: 20737 - protein, 5 aa, Artificial Sequence
  Description of Artificial Sequence: Synthetic peptide
  XENP020713 vhCDR1
DAWMD

SEQ ID NO: 20738 - protein, 19 aa, Artificial Sequence
  Description of Artificial Sequence: Synthetic peptide
  XENP020713 vhCDR2
EIRTKANNHATYYAESVKG

SEQ ID NO: 20739 - protein, 10 aa, Artificial Sequence
  Description of Artificial Sequence: Synthetic peptide
  XENP020713 vhCDR3
LANWDWYFDV

SEQ ID NO: 20740 - protein, 218 aa, Artificial Sequence
  Description of Artificial Sequence: Synthetic polypeptide
  XENP020713 7G8_H0_L0.105_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNELPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20741 - protein, 111 aa, Artificial Sequence
  Description of Artificial Sequence: Synthetic polypeptide
  VL of XENP020713
DTVLTQSPASLAVSLGQRATISCKASQSVDYDGDSYMNWYQQKPGQPPKLLIYAASNLESGIPARLSGSGSGTDFTLNIHPVEEEDAATYYCQQSNELPFTFGSGTKLEVK

SEQ ID NO: 20742 - protein, 15 aa, Artificial Sequence
  Description of Artificial Sequence: Synthetic peptide
  XENP020713 vlCDR1
KASQSVDYDGDSYMN

SEQ ID NO: 20743 - protein, 7 aa, Artificial Sequence
  Description of Artificial Sequence: Synthetic peptide
  XENP020713 vlCDR2
AASNLES

SEQ ID NO: 20744 - protein, 9 aa, Artificial Sequence
  Description of Artificial Sequence: Synthetic peptide
  XENP020713 vlCDR3
QQSNELPFT

SEQ ID NO: 20745 - protein, 450 aa, Artificial Sequence; identical to SEQ ID NO: 17585
  Description of Artificial Sequence: Synthetic polypeptide
  XENP020714 7G8_H0_L0.106_IgG1_PVA_/S267K Heavy Chain

SEQ ID NO: 20746 - protein, 121 aa, Artificial Sequence; identical to SEQ ID NO: 17586
  Description of Artificial Sequence: Synthetic polypeptide
  VH of XENP020714

SEQ ID NO: 20747 - protein, 5 aa, Artificial Sequence
  Description of Artificial Sequence: Synthetic peptide
  XENP020714 vhCDR1
DAWMD

SEQ ID NO: 20748 - protein, 19 aa, Artificial Sequence
  Description of Artificial Sequence: Synthetic peptide
  XENP020714 vhCDR2
EIRTKANNHATYYAESVKG

SEQ ID NO: 20749 - protein, 10 aa, Artificial Sequence
  Description of Artificial Sequence: Synthetic peptide
  XENP020714 vhCDR3
LANWDWYFDV

SEQ ID NO: 20750 - protein, 218 aa, Artificial Sequence
  Description of Artificial Sequence: Synthetic polypeptide
  XENP020714 7G8_H0_L0.106_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEGPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20751 - protein, 111 aa, Artificial Sequence
  Description of Artificial Sequence: Synthetic polypeptide
  VL of XENP020714
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEGPFTFGSGTKLEVK

SEQ ID NO: 20752 - protein, 15 aa, Artificial Sequence
  Description of Artificial Sequence: Synthetic peptide
  XENP020714 vlCDR1
KASQSVDYDGDSYMN

SEQ ID NO: 20753 - protein, 7 aa, Artificial Sequence
  Description of Artificial Sequence: Synthetic peptide
  XENP020714 vlCDR2
AASNLES

SEQ ID NO: 20754 - protein, 9 aa, Artificial Sequence
  Description of Artificial Sequence: Synthetic peptide
  XENP020714 vlCDR3
QQSNEGPFT

SEQ ID NO: 20755 - protein, 450 aa, Artificial Sequence; identical to SEQ ID NO: 17585
  Description of Artificial Sequence: Synthetic polypeptide
  XENP020715 7G8_H0_L0.107_IgG1_PVA_/S267K Heavy Chain

SEQ ID NO: 20756 - protein, 121 aa, Artificial Sequence; identical to SEQ ID NO: 17586
  Description of Artificial Sequence: Synthetic polypeptide
  VH of XENP020715

SEQ ID NO: 20757 - protein, 5 aa, Artificial Sequence
  Description of Artificial Sequence: Synthetic peptide
  XENP020715 vhCDR1
DAWMD

SEQ ID NO: 20758 - protein, 19 aa, Artificial Sequence
  Description of Artificial Sequence: Synthetic peptide
  XENP020715 vhCDR2
EIRTKANNHATYYAESVKG

SEQ ID NO: 20759 - protein, 10 aa, Artificial Sequence
  Description of Artificial Sequence: Synthetic peptide
  XENP020715 vhCDR3
LANWDWYFDV

SEQ ID NO: 20760 - protein, 218 aa, Artificial Sequence
  Description of Artificial Sequence: Synthetic polypeptide
  XENP020715 7G8_H0_L0.107_IgG1_PVA_/S267K Light Chain
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEYPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20761 - protein, 111 aa, Artificial Sequence
  Description of Artificial Sequence: Synthetic polypeptide
  VL of XENP020715
DTVLTQSPASLAVSLGQRATISCKASQSVDYDGDSYMNWYQQKPGQPPKLLIYAASNLESGIPARLSGSGSGTDFTLNIHPVEEEDAATYYCQQSNEYPFTFGSGTKLEVK

SEQ ID NO: 20762 - protein, 15 aa, Artificial Sequence
  Description of Artificial Sequence: Synthetic peptide
  XENP020715 vlCDR1
KASQSVDYDGDSYMN

SEQ ID NO: 20763 - protein, 7 aa, Artificial Sequence
  Description of Artificial Sequence: Synthetic peptide
  XENP020715 vlCDR2
AASNLES

SEQ ID NO: 20764 - protein, 9 aa, Artificial Sequence
  Description of Artificial Sequence: Synthetic peptide
  XENP020715 vlCDR3
QQSNEYPFT

SEQ ID NO: 20765 - protein, 446 aa, Artificial Sequence
  Description of Artificial Sequence: Synthetic polypeptide
  XENP016275 mAb8213_H0L0_IgG1_PVA_/S267K Heavy Chain
QVQLVQSGAEVKKPGASVKVSCKASGYTFTSYWMHWVRQAPGQGLEWMGEINPSNGRTNYNEKFKTRVTITADTSTSTAYMELSSLRSEDTAVYYCARGYYLYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20766 - protein, 117 aa, Artificial Sequence
  Description of Artificial Sequence: Synthetic polypeptide
  VH of XENP016275
QVQLVQSGAEVKKPGASVKVSCKASGYTFTSYWMHWVRQAPGQGLEWMGEINPSNGRTNYNEKFKTRVTITADTSTSTAYMELSSLRSEDTAVYYCARGYYLYFDYWGQGTLVTVSS

SEQ ID NO: 20767 - protein, 5 aa, Artificial Sequence
  Description of Artificial Sequence: Synthetic peptide
  XENP016275 vhCDR1
SYWMH

SEQ ID NO: 20768 - protein, 17 aa, Artificial Sequence
  Description of Artificial Sequence: Synthetic peptide
  XENP016275 vhCDR2
EINPSNGRTNYNEKFKT

SEQ ID NO: 20769 - protein, 8 aa, Artificial Sequence
  Description of Artificial Sequence: Synthetic peptide
  XENP016275 vhCDR3
GYYLYFDY

SEQ ID NO: 20770 - protein, 214 aa, Artificial Sequence
  Description of Artificial Sequence: Synthetic polypeptide
  XENP016275 mAb8213_H0L0_IgG1_PVA_/S267K Light Chain
DIQMTQSPSSLSASVGDRVTITCHASQGIRINIGWYQQKPGKAPKLLIYHGTNLEDGVPSRFSGSGSGTDFTLTISSLQPEDFATYYCVQYGQFPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20771 - protein, 107 aa, Artificial Sequence
  Description of Artificial Sequence: Synthetic polypeptide
  VL of XENP016275
DIQMTQSPSSLSASVGDRVTITCHASQGIRINIGWYQQKPGKAPKLLIYHGTNLEDGVPSRFSGSGSGTDFTLTISSLQPEDFATYYCVQYGQFPWTFGQGTKLEIK

SEQ ID NO: 20772 - protein, 11 aa, Artificial Sequence
  Description of Artificial Sequence: Synthetic peptide
  XENP016275 vlCDR1
HASQGIRINIG

SEQ ID NO: 20773 - protein, 7 aa, Artificial Sequence
  Description of Artificial Sequence: Synthetic peptide
  XENP016275 vlCDR2
HGTNLED

SEQ ID NO: 20774 - protein, 9 aa, Artificial Sequence
  Description of Artificial Sequence: Synthetic peptide
  XENP016275 vlCDR3
VQYGQFPWT

SEQ ID NO: 20775 - protein, 447 aa, Artificial Sequence
  Description of Artificial Sequence: Synthetic polypeptide
  XENP017973 ABTIM3_H0L0_IgG1_PVA_/S267K Heavy Chain
QVQLQQPGAELVKPGASVKMSCKASGYTFTSYNMHWIKQTPGQGLEWIGDIYPGNGDTSYNQKFKGKATLTADKSSSTVYMQLSSLTSEDSAVYYCARVGGAFPMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20776 - protein, 118 aa, Artificial Sequence
  Description of Artificial Sequence: Synthetic polypeptide
  VH of XENP017973
QVQLQQPGAELVKPGASVKMSCKASGYTFTSYNMHWIKQTPGQGLEWIGDIYPGNGDTSYNQKFKGKATLTADKSSSTVYMQLSSLTSEDSAVYYCARVGGAFPMDYWGQGTSVTVSS

SEQ ID NO: 20777 - protein, 5 aa, Artificial Sequence
  Description of Artificial Sequence: Synthetic peptide
  XENP017973 vhCDR1
SYNMH

SEQ ID NO: 20778 - protein, 17 aa, Artificial Sequence
  Description of Artificial Sequence: Synthetic peptide
  XENP017973 vhCDR2
DIYPGNGDTSYNQKFKG

SEQ ID NO: 20779 - protein, 9 aa, Artificial Sequence
  Description of Artificial Sequence: Synthetic peptide
  XENP017973 vhCDR3
VGGAFPMDY

SEQ ID NO: 20780 - protein, 218 aa, Artificial Sequence
  Description of Artificial Sequence: Synthetic polypeptide
  XENP017973 ABTIM3_H0L0_IgG1_PVA_/S267K Light Chain
DIVLTQSPASLAVSLGQRATISCRASESVEYYGTSLMQWYQQKPGQPPKLLIYAASNVESGVPARFSGSGSGTDFSLNIHPVEEDDIAIYFCQQSRKDPSTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20781 - protein, 111 aa, Artificial Sequence
  Description of Artificial Sequence: Synthetic polypeptide
  VL of XENP017973
DIVLTQSPASLAVSLGQRATISCRASESVEYYGTSLMQWYQQKPGQPPKLLIYAASNVESGVPARFSGSGSGTDFSLNIHPVEEDDIAIYFCQQSRKDPSTFGGGTKLEIK

SEQ ID NO: 20782 - protein, 15 aa, Artificial Sequence
  Description of Artificial Sequence: Synthetic peptide
  XENP017973 vlCDR1
RASESVEYYGTSLMQ

SEQ ID NO: 20783 - protein, 7 aa, Artificial Sequence
  Description of Artificial Sequence: Synthetic peptide
  XENP017973 vlCDR2
AASNVES

SEQ ID NO: 20784 - protein, 9 aa, Artificial Sequence
  Description of Artificial Sequence: Synthetic peptide
  XENP017973 vlCDR3
QQSRKDPST

SEQ ID NO: 20785 - protein, 447 aa, Artificial Sequence
  Description of Artificial Sequence: Synthetic polypeptide
  XENP017975 ABTIM3-hum11_H0L0_IgG1_PVA_/S267K Heavy Chain
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20786 - protein, 118 aa, Artificial Sequence
  Description of Artificial Sequence: Synthetic polypeptide
  VH of XENP017975
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSS

SEQ ID NO: 20787 - protein, 5 aa, Artificial Sequence
  Description of Artificial Sequence: Synthetic peptide
  XENP017975 vhCDR1
SYNMH

SEQ ID NO: 20788 - protein, 17 aa, Artificial Sequence
  Description of Artificial Sequence: Synthetic peptide
  XENP017975 vhCDR2
DIYPGNGDTSYNQKFKG

SEQ ID NO: 20789 - protein, 9 aa, Artificial Sequence
  Description of Artificial Sequence: Synthetic peptide
  XENP017975 vhCDR3
VGGAFPMDY

SEQ ID NO: 20790 - protein, 218 aa, Artificial Sequence
  Description of Artificial Sequence: Synthetic polypeptide
  XENP017975 ABTIM3-hum11_H0L0_IgG1_PVA_/S267K Light Chain
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20791 - protein, 111 aa, Artificial Sequence
  Description of Artificial Sequence: Synthetic polypeptide
  VL of XENP017975
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIK

SEQ ID NO: 20792 - protein, 15 aa, Artificial Sequence
  Description of Artificial Sequence: Synthetic peptide
  XENP017975 vlCDR1
RASESVEYYGTSLMQ

SEQ ID NO: 20793 - protein, 7 aa, Artificial Sequence
  Description of Artificial Sequence: Synthetic peptide
  XENP017975 vlCDR2
AASNVES

SEQ ID NO: 20794 - protein, 9 aa, Artificial Sequence
  Description of Artificial Sequence: Synthetic peptide
  XENP017975 vlCDR3
QQSRKDPST

SEQ ID NO: 20795 - protein, 446 aa, Artificial Sequence
  Description of Artificial Sequence: Synthetic polypeptide
  XENP020403 1B3_H0L0_IgG1_PVA_/S267K Heavy Chain
EVKLVESGGGLVKPGGSLTLSCAASEFTFSSYAMSWVRQTPEKRLEWVASISSGGRTYYPDSVKGRFTISRDNARNILYLQMSSLRSEDTAMYYCARGRGFDVMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20796 - protein, 117 aa, Artificial Sequence
  Description of Artificial Sequence: Synthetic polypeptide
  VH of XENP020403
EVKLVESGGGLVKPGGSLTLSCAASEFTFSSYAMSWVRQTPEKRLEWVASISSGGRTYYPDSVKGRFTISRDNARNILYLQMSSLRSEDTAMYYCARGRGFDVMDYWGQGTSVTVSS

SEQ ID NO: 20797 - protein, 5 aa, Artificial Sequence
  Description of Artificial Sequence: Synthetic peptide
  XENP020403 vhCDR1
SYAMS

SEQ ID NO: 20798 - protein, 16 aa, Artificial Sequence
  Description of Artificial Sequence: Synthetic peptide
  XENP020403 vhCDR2
SISSGGRTYYPDSVKG

SEQ ID NO: 20799 - protein, 9 aa, Artificial Sequence
  Description of Artificial Sequence: Synthetic peptide
  XENP020403 vhCDR3
GRGFDVMDY

SEQ ID NO: 20800 - protein, 214 aa, Artificial Sequence
  Description of Artificial Sequence: Synthetic polypeptide
  XENP020403 1B3_H0L0_IgG1_PVA_/S267K Light Chain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20801 - protein, 107 aa, Artificial Sequence
  Description of Artificial Sequence: Synthetic polypeptide
  VL of XENP020403
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIK

SEQ ID NO: 20802 - protein, 11 aa, Artificial Sequence
  Description of Artificial Sequence: Synthetic peptide
  XENP020403 vlCDR1
RASQDISNYLN

SEQ ID NO: 20803 - protein, 7 aa, Artificial Sequence
  Description of Artificial Sequence: Synthetic peptide
  XENP020403 vlCDR2
YTSRLHS

SEQ ID NO: 20804 - protein, 9 aa, Artificial Sequence
  Description of Artificial Sequence: Synthetic peptide
  XENP020403 vlCDR3
QQGNTLPYT

SEQ ID NO: 20805 - protein, 446 aa, Artificial Sequence
  Description of Artificial Sequence: Synthetic polypeptide
  XENP020404 1D12_H0L0_IgG1_PVA_/S267K Heavy Chain
QVQLQQSAADLARPGASVKLSCKASGYTFTSYTMHWVKQRPGQGLEWIGYLIPSSGYTDYNQRFKDKTTLTADKSSSTAYMQLSSLTSEDSAVYYCARGDSVYFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20806 - protein, 117 aa, Artificial Sequence
  Description of Artificial Sequence: Synthetic polypeptide
  VH of XENP020404
QVQLQQSAADLARPGASVKLSCKASGYTFTSYTMHWVKQRPGQGLEWIGYLIPSSGYTDYNQRFKDKTTLTADKSSSTAYMQLSSLTSEDSAVYYCARGDSVYFDYWGQGTALTVSS

SEQ ID NO: 20807 - protein, 5 aa, Artificial Sequence
  Description of Artificial Sequence: Synthetic peptide
  XENP020404 vhCDR1
SYTMH

SEQ ID NO: 20808 - protein, 17 aa, Artificial Sequence
  Description of Artificial Sequence: Synthetic peptide
  XENP020404 vhCDR2
YLIPSSGYTDYNQRFKD

SEQ ID NO: 20809 - protein, 8 aa, Artificial Sequence
  Description of Artificial Sequence: Synthetic peptide
  XENP020404 vhCDR3
GDSVYFDY

SEQ ID NO: 20810 - protein, 218 aa, Artificial Sequence
  Description of Artificial Sequence: Synthetic polypeptide
  XENP020404 1D12_H0L0_IgG1_PVA_/S267K Light Chain
DIVLTQSPASLAVSLGQRATISCRASESVEYYGTSLQQKYQQKPGQPPKLLIYAASNVESGVPARFSGSGSGTDFSLNIHPVEEDDIAQYFCQQSRKVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20811 - protein, 111 aa, Artificial Sequence
  Description of Artificial Sequence: Synthetic polypeptide
  VL of XENP020404
DIVLTQSPASLAVSLGQRATISCRASESVEYYGTSLQQKYQQKPGQPPKLLIYAASNVESGVPARFSGSGSGTDFSLNIHPVEEDDIAQYFCQQSRKVPWTFGGGTKLEIK

SEQ ID NO: 20812 - protein, 15 aa, Artificial Sequence
  Description of Artificial Sequence: Synthetic peptide
  XENP020404 vlCDR1
RASESVEYYGTSLQQ

SEQ ID NO: 20813 - protein, 7 aa, Artificial Sequence
  Description of Artificial Sequence: Synthetic peptide
  XENP020404 vlCDR2
AASNVES

SEQ ID NO: 20814 - protein, 9 aa, Artificial Sequence
  Description of Artificial Sequence: Synthetic peptide
  XENP020404 vlCDR3
QQSRKVPWT

SEQ ID NO: 20815 - protein, 446 aa, Artificial Sequence
  Description of Artificial Sequence: Synthetic polypeptide
  XENP020405 3H3_H0L0_IgG1_PVA_/S267K Heavy Chain
QVQLKESGPGLVAPSQSLSITCTVSGFSLNGYGVNWVRQPPGKGLEWLGYIIGDGSTDYNSALKSRLSISKDNSKSQVFLKMNSLQTDDTARYYCARSYYTSDEDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20816 - protein, 117 aa, Artificial Sequence
  Description of Artificial Sequence: Synthetic polypeptide
  VH of XENP020405
QVQLKESGPGLVAPSQSLSITCTVSGFSLNGYGVNWVRQPPGKGLEWLGYIIGDGSTDYNSALKSRLSISKDNSKSQVFLKMNSLQTDDTARYYCARSYYTSDEDYWGQGTLVTVSA

SEQ ID NO: 20817 - protein, 5 aa, Artificial Sequence
  Description of Artificial Sequence: Synthetic peptide
  XENP020405 vhCDR1
GYGVN

SEQ ID NO: 20818 - protein, 16 aa, Artificial Sequence
  Description of Artificial Sequence: Synthetic peptide
  XENP020405 vhCDR2
YIIGDGSTDYNSALKS

SEQ ID NO: 20819 - protein, 9 aa, Artificial Sequence
  Description of Artificial Sequence: Synthetic peptide
  XENP020405 vhCDR3
SYYTSDEDY

SEQ ID NO: 20820 - protein, 219 aa, Artificial Sequence
  Description of Artificial Sequence: Synthetic polypeptide
  XENP020405 3H3_H0L0_IgG1_PVA_/S267K Light Chain
DIVLSQSPSSLAVSAGEKVTISCKSSQSLLNSRTRKNYLAQYQQKPGQSPKLLIYSASTRESGVPDRFTGSGSGTDFTLTISSVLAEDLAVYYCKQSYSLRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20821 - protein, 112 aa, Artificial Sequence
  Description of Artificial Sequence: Synthetic polypeptide
  VL of XENP020405
DIVLSQSPSSLAVSAGEKVTISCKSSQSLLNSRTRKNYLAQYQQKPGQSPKLLIYSASTRESGVPDRFTGSGSGTDFTLTISSVLAEDLAVYYCKQSYSLRTFGGGTKLEIK

SEQ ID NO: 20822 - protein, 17 aa, Artificial Sequence
  Description of Artificial Sequence: Synthetic peptide
  XENP020405 vlCDR1
KSSQSLLNSRTRKNYLA

SEQ ID NO: 20823 - protein, 7 aa, Artificial Sequence
  Description of Artificial Sequence: Synthetic peptide
  XENP020405 vlCDR2
SASTRES

SEQ ID NO: 20824 - protein, 8 aa, Artificial Sequence
  Description of Artificial Sequence: Synthetic peptide
  XENP020405 vlCDR3
KQSYSLRT

SEQ ID NO: 20825 - protein, 446 aa, Artificial Sequence
  Description of Artificial Sequence: Synthetic polypeptide
  XENP020406 6D9_H0_1D12_L0_IgG1_PVA_/S267K Heavy Chain
QVQLKQSGPGLVQPSQSLSITCTVSGFSLTSYGVHWVRQSPGKGLEWLGVIISGGSTEYNAAFISRLSISKDNSKSQVFFKMNSLQADDTAIYYCARGGLLSPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20826 - protein, 117 aa, Artificial Sequence
  Description of Artificial Sequence: Synthetic polypeptide
  VH of XENP020406
QVQLKQSGPGLVQPSQSLSITCTVSGFSLTSYGVHWVRQSPGKGLEWLGVIISGGSTEYNAAFISRLSISKDNSKSQVFFKMNSLQADDTAIYYCARGGLLSPFDYWGQGTTLTVSS

SEQ ID NO: 20827 - protein, 5 aa, Artificial Sequence
  Description of Artificial Sequence: Synthetic peptide
  XENP020406 vhCDR1
SYGVH

SEQ ID NO: 20828 - protein, 16 aa, Artificial Sequence
  Description of Artificial Sequence: Synthetic peptide
  XENP020406 vhCDR2
VIISGGSTEYNAAFIS

SEQ ID NO: 20829 - protein, 9 aa, Artificial Sequence
  Description of Artificial Sequence: Synthetic peptide
  XENP020406 vhCDR3
GGLLSPFDY

SEQ ID NO: 20830 - protein, 218 aa, Artificial Sequence; identical to SEQ ID NO: 20810
  Description of Artificial Sequence: Synthetic polypeptide
  XENP020406 6D9_H0_1D12_L0_IgG1_PVA_/S267K Light Chain

SEQ ID NO: 20831 - protein, 111 aa, Artificial Sequence; identical to SEQ ID NO: 20811
  Description of Artificial Sequence: Synthetic polypeptide
  VL of XENP020406

SEQ ID NO: 20832 - protein, 15 aa, Artificial Sequence
  Description of Artificial Sequence: Synthetic peptide
  XENP020406 vlCDR1
RASESVEYYGTSLQQ

SEQ ID NO: 20833 - protein, 7 aa, Artificial Sequence
  Description of Artificial Sequence: Synthetic peptide
  XENP020406 vlCDR2
AASNVES

SEQ ID NO: 20834 - protein, 9 aa, Artificial Sequence
  Description of Artificial Sequence: Synthetic peptide
  XENP020406 vlCDR3
QQSRKVPWT

SEQ ID NO: 20835 - protein, 447 aa, Artificial Sequence
  Description of Artificial Sequence: Synthetic polypeptide
  XENP020407 7B11_H0L0_IgG1_PVA_/S267K Heavy Chain
QVQLKQSGPGLVQPSQSLSITCTVSGFSLTSYAVNWVRQSPGKGLEWLGVIWSGGSTDYNAAFISRLSISKDNSKSQVFFKMNSLQANDTAIYYCVSLYYRYDGFDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20836 - protein, 118 aa, Artificial Sequence
  Description of Artificial Sequence: Synthetic polypeptide
  VH of XENP020407
QVQLKQSGPGLVQPSQSLSITCTVSGFSLTSYAVNWVRQSPGKGLEWLGVIWSGGSTDYNAAFISRLSISKDNSKSQVFFKMNSLQANDTAIYYCVSLYYRYDGFDYWGQGTLVTVSA

SEQ ID NO: 20837 - protein, 5 aa, Artificial Sequence
  Description of Artificial Sequence: Synthetic peptide
  XENP020407 vhCDR1
SYAVN

SEQ ID NO: 20838 - protein, 16 aa, Artificial Sequence
  Description of Artificial Sequence: Synthetic peptide
  XENP020407 vhCDR2
VIWSGGSTDYNAAFIS

SEQ ID NO: 20839 - protein, 10 aa, Artificial Sequence
  Description of Artificial Sequence: Synthetic peptide
  XENP020407 vhCDR3
LYYRYDGFDY

SEQ ID NO: 20840 - protein, 214 aa, Artificial Sequence
  Description of Artificial Sequence: Synthetic polypeptide
  XENP020407 7B11_H0L0_IgG1_PVA_/S267K Light Chain
DIVLTQSQKFLSTSVGDRVSVTCKASQNVGTHVARYQQKPGQSPKALVYSASYRYSGVPDRFTGSGSGTDFTLTISNVQSEDLAEYFCQQYNSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20841 - protein, 107 aa, Artificial Sequence
  Description of Artificial Sequence: Synthetic polypeptide
  VL of XENP020407
DIVLTQSQKFLSTSVGDRVSVTCKASQNVGTHVARYQQKPGQSPKALVYSASYRYSGVPDRFTGSGSGTDFTLTISNVQSEDLAEYFCQQYNSYPLTFGGGTKLEIK

SEQ ID NO: 20842 - protein, 11 aa, Artificial Sequence
  Description of Artificial Sequence: Synthetic peptide
  XENP020407 vlCDR1
KASQNVGTHVA

SEQ ID NO: 20843 - protein, 7 aa, Artificial Sequence
  Description of Artificial Sequence: Synthetic peptide
  XENP020407 vlCDR2
SASYRYS

SEQ ID NO: 20844 - protein, 9 aa, Artificial Sequence
  Description of Artificial Sequence: Synthetic peptide
  XENP020407 vlCDR3
QQYNSYPLT

SEQ ID NO: 20845 - protein, 447 aa, Artificial Sequence
  Description of Artificial Sequence: Synthetic polypeptide
  XENP020408 7B11var_H0L0_IgG1_PVA_/S267K Heavy Chain
QVQLKQSGPGLVQPSQSLSITCTVSGFSLTSYAVNWVRQSPGKGLEWLGVIWSGGSTDYNAAFISRLSISKDNSKSQVFFKMNSLQADDTAIYYCVSLYYRYDGFDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20846 - protein, 118 aa, Artificial Sequence
  Description of Artificial Sequence: Synthetic polypeptide
  VH of XENP020408
QVQLKQSGPGLVQPSQSLSITCTVSGFSLTSYAVNWVRQSPGKGLEWLGVIWSGGSTDYNAAFISRLSISKDNSKSQVFFKMNSLQADDTAIYYCVSLYYRYDGFDYWGQGTLVTVSA

SEQ ID NO: 20847 - protein, 5 aa, Artificial Sequence
  Description of Artificial Sequence: Synthetic peptide
  XENP020408 vhCDR1
SYAVN

SEQ ID NO: 20848 - protein, 16 aa, Artificial Sequence
  Description of Artificial Sequence: Synthetic peptide
  XENP020408 vhCDR2
VIWSGGSTDYNAAFIS

SEQ ID NO: 20849 - protein, 10 aa, Artificial Sequence
  Description of Artificial Sequence: Synthetic peptide
  XENP020408 vhCDR3
LYYRYDGFDY

SEQ ID NO: 20850 - protein, 214 aa, Artificial Sequence; identical to SEQ ID NO: 20840
  Description of Artificial Sequence: Synthetic polypeptide
  XENP020408 7B11var_H0L0_IgG1_PVA_/S267K Light Chain

SEQ ID NO: 20851 - protein, 107 aa, Artificial Sequence; identical to SEQ ID NO: 20841
  Description of Artificial Sequence: Synthetic polypeptide
  VL of XENP020408

SEQ ID NO: 20852 - protein, 11 aa, Artificial Sequence
  Description of Artificial Sequence: Synthetic peptide
  XENP020408 vlCDR1
KASQNVGTHVA

SEQ ID NO: 20853 - protein, 7 aa, Artificial Sequence
  Description of Artificial Sequence: Synthetic peptide
  XENP020408 vlCDR2
SASYRYS

SEQ ID NO: 20854 - protein, 9 aa, Artificial Sequence
  Description of Artificial Sequence: Synthetic peptide
  XENP020408 vlCDR3
QQYNSYPLT

SEQ ID NO: 20855 - protein, 446 aa, Artificial Sequence
  Description of Artificial Sequence: Synthetic polypeptide
  XENP020409 6C8_H0L0_IgG1_PVA_/S267K Heavy Chain
QVQLQQSGAELVRPGTSVKISCKAAGYTFTNYAIGWVKQRPGHGLEWIGDFYPGGGYTNYNEKFKGKATLTADTSSSTAYMQLSSLTSEDSAIYFCARGYYRVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20856 - protein, 117 aa, Artificial Sequence
  Description of Artificial Sequence: Synthetic polypeptide
  VH of XENP020409
QVQLQQSGAELVRPGTSVKISCKAAGYTFTNYAIGWVKQRPGHGLEWIGDFYPGGGYTNYNEKFKGKATLTADTSSSTAYMQLSSLTSEDSAIYFCARGYYRVFDYWGQGTTLTVSS

SEQ ID NO: 20857 - protein, 5 aa, Artificial Sequence
  Description of Artificial Sequence: Synthetic peptide
  XENP020409 vhCDR1
NYAIG

SEQ ID NO: 20858 - protein, 17 aa, Artificial Sequence
  Description of Artificial Sequence: Synthetic peptide
  XENP020409 vhCDR2
DFYPGGGYTNYNEKFKG

SEQ ID NO: 20859 - protein, 8 aa, Artificial Sequence
  Description of Artificial Sequence: Synthetic peptide
  XENP020409 vhCDR3
GYYRVFDY

SEQ ID NO: 20860 - protein, 214 aa, Artificial Sequence
  Description of Artificial Sequence: Synthetic polypeptide
  XENP020409 6C8_H0L0_IgG1_PVA_/S267K Light Chain
DIVLTQSQKFLSTSVGDRVSVTCKASQNVGSNVARCQQKPGQSPKALIYSASFRYSGVPDRFTGSGSGTDFTLTISNVQSEDLAEYFCQQYNSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20861 - protein, 107 aa, Artificial Sequence
  Description of Artificial Sequence: Synthetic polypeptide
  VL of XENP020409
DIVLTQSQKFLSTSVGDRVSVTCKASQNVGSNVARCQQKPGQSPKALIYSASFRYSGVPDRFTGSGSGTDFTLTISNVQSEDLAEYFCQQYNSYPYTFGGGTKLEIK

SEQ ID NO: 20862 - protein, 11 aa, Artificial Sequence
  Description of Artificial Sequence: Synthetic peptide
  XENP020409 vlCDR1
KASQNVGSNVA

SEQ ID NO: 20863 - protein, 7 aa, Artificial Sequence
  Description of Artificial Sequence: Synthetic peptide
  XENP020409 vlCDR2
SASFRYS

SEQ ID NO: 20864 - protein, 9 aa, Artificial Sequence
  Description of Artificial Sequence: Synthetic peptide
  XENP020409 vlCDR3
QQYNSYPYT

SEQ ID NO: 20865 - protein, 446 aa, Artificial Sequence
  Description of Artificial Sequence: Synthetic polypeptide
  XENP020410 7C2_H0L0_IgG1_PVA_/S267K Heavy Chain
EVKVVESGGGLVKPGGSLKLSCAASGFTFSRYAISWVRQTPEKRLEWVASISSGGSTYYPDSVQGRFTISRDNARNILYLQMSSLRSEDTAMYYCARGDYEGYFDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20866 - protein, 117 aa, Artificial Sequence
  Description of Artificial Sequence: Synthetic polypeptide
  VH of XENP020410
EVKVVESGGGLVKPGGSLKLSCAASGFTFSRYAISWVRQTPEKRLEWVASISSGGSTYYPDSVQGRFTISRDNARNILYLQMSSLRSEDTAMYYCARGDYEGYFDYWGQGTSLTVSS

SEQ ID NO: 20867 - protein, 5 aa, Artificial Sequence
  Description of Artificial Sequence: Synthetic peptide
  XENP020410 vhCDR1
RYAIS

SEQ ID NO: 20868 - protein, 16 aa, Artificial Sequence
  Description of Artificial Sequence: Synthetic peptide
  XENP020410 vhCDR2
SISSGGSTYYPDSVQG

SEQ ID NO: 20869 - protein, 9 aa, Artificial Sequence
  Description of Artificial Sequence: Synthetic peptide
  XENP020410 vhCDR3
GDYEGYFDY

SEQ ID NO: 20870 - protein, 220 aa, Artificial Sequence
  Description of Artificial Sequence: Synthetic polypeptide
  XENP020410 7C2_H0L0_IgG1_PVA_/S267K Light Chain
DIVLTQSPSSLATSVGQKVTVSCKSSQSLLNSINQKNYLAGYQQKPGQSPKLLVYFASTRESGVPDRFIGSGSGTDFTLTISSVQAEDLADYFCQQHYSTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20871 - protein, 113 aa, Artificial Sequence
  Description of Artificial Sequence: Synthetic polypeptide
  VL of XENP020410
DIVLTQSPSSLATSVGQKVTVSCKSSQSLLNSINQKNYLAGYQQKPGQSPKLLVYFASTRESGVPDRFIGSGSGTDFTLTISSVQAEDLADYFCQQHYSTPLTFGAGTKLELK

SEQ ID NO: 20872 - protein, 17 aa, Artificial Sequence
  Description of Artificial Sequence: Synthetic peptide
  XENP020410 vlCDR1
KSSQSLLNSINQKNYLA

SEQ ID NO: 20873 - protein, 7 aa, Artificial Sequence
  Description of Artificial Sequence: Synthetic peptide
  XENP020410 vlCDR2
FASTRES

SEQ ID NO: 20874 - protein, 9 aa, Artificial Sequence
  Description of Artificial Sequence: Synthetic peptide
  XENP020410 vlCDR3
QQHYSTPLT

SEQ ID NO: 20875 - protein, 442 aa, Artificial Sequence
  Description of Artificial Sequence: Synthetic polypeptide
  XENP020411 1D10_H0L0_IgG1_PVA_/S267K Heavy Chain
EVQLVESGGGLVKPGGSLKFSCAASGFAFSSFDISWVRQTPEKRLEWVAYISSDGASTFYPDTMKGRFTISRDNAKNTLYLQMSSLKSEDTAMYYCTRLGAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20876 - protein, 113 aa, Artificial Sequence
  Description of Artificial Sequence: Synthetic polypeptide
  VH of XENP020411
EVQLVESGGGLVKPGGSLKFSCAASGFAFSSFDISWVRQTPEKRLEWVAYISSDGASTFYPDTMKGRFTISRDNAKNTLYLQMSSLKSEDTAMYYCTRLGAYWGQGTLVTVSA

SEQ ID NO: 20877 - protein, 5 aa, Artificial Sequence
  Description of Artificial Sequence: Synthetic peptide
  XENP020411 vhCDR1
SFDIS

SEQ ID NO: 20878 - protein, 17 aa, Artificial Sequence
  Description of Artificial Sequence: Synthetic peptide
  XENP020411 vhCDR2
YISSDGASTFYPDTMKG

SEQ ID NO: 20879 - protein, 4 aa, Artificial Sequence
  Description of Artificial Sequence: Synthetic peptide
  XENP020411 vhCDR3
LGAY

SEQ ID NO: 20880 - protein, 219 aa, Artificial Sequence
  Description of Artificial Sequence: Synthetic polypeptide
  XENP020411 1D10_H0L0_IgG1_PVA_/S267K Light Chain
DVVLTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20881 - protein, 112 aa, Artificial Sequence
  Description of Artificial Sequence: Synthetic polypeptide
  VL of XENP020411
DVVLTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 20882 - protein, 16 aa, Artificial Sequence
  Description of Artificial Sequence: Synthetic peptide
  XENP020411 vlCDR1
KSSQSLLDSDGKTYLN

SEQ ID NO: 20883 - protein, 7 aa, Artificial Sequence
  Description of Artificial Sequence: Synthetic peptide
  XENP020411 vlCDR2
LVSKLDS

SEQ ID NO: 20884 - protein, 9 aa, Artificial Sequence
  Description of Artificial Sequence: Synthetic peptide
  XENP020411 vlCDR3
WQGTHFPYT

SEQ ID NO: 20885 - protein, 448 aa, Artificial Sequence
  Description of Artificial Sequence: Synthetic polypeptide
  XENP017883 4C7_H0L0_IgG1_PVA_/S267K Heavy Chain
QVQLQESGPGLVKPSETLSLTCTVHGGSINHYYWSWIRQPPGKGLEWIGYIYYSGSTKYNPSLKSRVSISVDTSKNQFSLKLTSVTAADTAVYYCAREWPYYYYEMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20886 - protein, 119 aa, Artificial Sequence
  Description of Artificial Sequence: Synthetic polypeptide
  VH of XENP017883
QVQLQESGPGLVKPSETLSLTCTVHGGSINHYYWSWIRQPPGKGLEWIGYIYYSGSTKYNPSLKSRVSISVDTSKNQFSLKLTSVTAADTAVYYCAREWPYYYYEMDVWGQGTTVTVSS

SEQ ID NO: 20887 - protein, 5 aa, Artificial Sequence
  Description of Artificial Sequence: Synthetic peptide
  XENP017883 vhCDR1
HYYWS

SEQ ID NO: 20888 - protein, 16 aa, Artificial Sequence
  Description of Artificial Sequence: Synthetic peptide
  XENP017883 vhCDR2
YIYYSGSTKYNPSLKS

SEQ ID NO: 20889 - protein, 11 aa, Artificial Sequence
  Description of Artificial Sequence: Synthetic peptide
  XENP017883 vhCDR3
EWPYYYYEMDV

SEQ ID NO: 20890 - protein, 215 aa, Artificial Sequence
  Description of Artificial Sequence: Synthetic polypeptide
  XENP017883 4C7_H0L0_IgG1_PVA_/S267K Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20891 - protein, 108 aa, Artificial Sequence
  Description of Artificial Sequence: Synthetic polypeptide
  VL of XENP017883
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFRTFGQGTKVEIK

SEQ ID NO: 20892 - protein, 12 aa, Artificial Sequence
  Description of Artificial Sequence: Synthetic peptide
  XENP017883 vlCDR1
RASQSVSSSYLA

SEQ ID NO: 20893 - protein, 7 aa, Artificial Sequence
  Description of Artificial Sequence: Synthetic peptide
  XENP017883 vlCDR2
GASSRAT

SEQ ID NO: 20894 - protein, 9 aa, Artificial Sequence
  Description of Artificial Sequence: Synthetic peptide
  XENP017883 vlCDR3
QQYGSSFRT

SEQ ID NO: 20895 - protein, 450 aa, Artificial Sequence
  Description of Artificial Sequence: Synthetic polypeptide
  XENP017884 8D5_H0L0_IgG1_PVA_/S267K Heavy Chain
EVQLVESGGGLVQPGGSLRLSCAASGFTISSYDMHWVRQATGKGLEWVSVIGPAGDTYYPGSVKGRFTISRENAKNSLYLQMNSLRAGDTAVYYCAREGMAAHNYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20896 - protein, 121 aa, Artificial Sequence
  Description of Artificial Sequence: Synthetic polypeptide
  VH of XENP017884
EVQLVESGGGLVQPGGSLRLSCAASGFTISSYDMHWVRQATGKGLEWVSVIGPAGDTYYPGSVKGRFTISRENAKNSLYLQMNSLRAGDTAVYYCAREGMAAHNYYGMDVWGQGTTVTVSS

SEQ ID NO: 20897 - protein, 5 aa, Artificial Sequence
  Description of Artificial Sequence: Synthetic peptide
  XENP017884 vhCDR1
SYDMH

SEQ ID NO: 20898 - protein, 16 aa, Artificial Sequence
  Description of Artificial Sequence: Synthetic peptide
  XENP017884 vhCDR2
VIGPAGDTYYPGSVKG

SEQ ID NO: 20899 - protein, 13 aa, Artificial Sequence
  Description of Artificial Sequence: Synthetic peptide
  XENP017884 vhCDR3
EGMAAHNYYGMDV

SEQ ID NO: 20900 - protein, 215 aa, Artificial Sequence
  Description of Artificial Sequence: Synthetic polypeptide
  XENP017884 8D5_H0L0_IgG1_PVA_/S267K Light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20901 - protein, 108 aa, Artificial Sequence
  Description of Artificial Sequence: Synthetic polypeptide
  VL of XENP017884
EIVLTQSPATLSLSPGERATLSCRASQSVSSYLAWYQQKPGQAPRLLIYDASNRATGIPARFSGSGSGTDFTLTISSLEPEDFAVYYCQQRSNWPPITFGQGTRLEIK

SEQ ID NO: 20902 - protein, 11 aa, Artificial Sequence
  Description of Artificial Sequence: Synthetic peptide
  XENP017884 vlCDR1
RASQSVSSYLA

SEQ ID NO: 20903 - protein, 7 aa, Artificial Sequence
  Description of Artificial Sequence: Synthetic peptide
  XENP017884 vlCDR2
DASNRAT

SEQ ID NO: 20904 - protein, 10 aa, Artificial Sequence
  Description of Artificial Sequence: Synthetic peptide
  XENP017884 vlCDR3
QQRSNWPPIT

SEQ ID NO: 20905 - protein, 457 aa, Artificial Sequence
  Description of Artificial Sequence: Synthetic polypeptide
  XENP017885 E8D9_H0L0_IgG1_PVA_/S267K Heavy Chain
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHTSITEVRGAIIYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20906 - protein, 128 aa, Artificial Sequence
  Description of Artificial Sequence: Synthetic polypeptide
  VH of XENP017885
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHTSITEVRGAIIYYYGMDVWGQGTTVTVSS

SEQ ID NO: 20907 - protein, 7 aa, Artificial Sequence
  Description of Artificial Sequence: Synthetic peptide
  XENP017885 vhCDR1
TSGVGVG

SEQ ID NO: 20908 - protein, 16 aa, Artificial Sequence
  Description of Artificial Sequence: Synthetic peptide
  XENP017885 vhCDR2
LIYWDDDKRYSPSLKS

SEQ ID NO: 20909 - protein, 18 aa, Artificial Sequence
  Description of Artificial Sequence: Synthetic peptide
  XENP017885 vhCDR3
TSITEVRGAIIYYYGMDV

SEQ ID NO: 20910 - protein, 214 aa, Artificial Sequence
  Description of Artificial Sequence: Synthetic polypeptide
  XENP017885 E8D9_H0L0_IgG1_PVA_/S267K Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGHSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20911 - protein, 107 aa, Artificial Sequence
  Description of Artificial Sequence: Synthetic polypeptide
  VL of XENP017885
EIVLTQSPGTLSLSPGERATLSCRASQSVSSSYLAWYQQKPGQAPRLLIYGASSRATGIPDRFSGSGSGTDFTLTISRLEPEDFAVYYCQQYGHSLTFGGGTKVEIK

SEQ ID NO: 20912 - protein, 12 aa, Artificial Sequence
  Description of Artificial Sequence: Synthetic peptide
  XENP017885 vlCDR1
RASQSVSSSYLA

SEQ ID NO: 20913 - protein, 7 aa, Artificial Sequence
  Description of Artificial Sequence: Synthetic peptide
  XENP017885 vlCDR2
GASSRAT

SEQ ID NO: 20914 - protein, 8 aa, Artificial Sequence
  Description of Artificial Sequence: Synthetic peptide
  XENP017885 vlCDR3
QQYGHSLT

SEQ ID NO: 20915 - protein, 449 aa, Artificial Sequence
  Description of Artificial Sequence: Synthetic polypeptide
  XENP020267 3F6_H0L0_anti-BTLA_IgG1_PVA_/S267K Heavy Chain
EVQLQESGPSLVKPSQTLSLTCSVTGDSITSGYWNWIRKFPGNKLEYMGYLSYSGSTYYNPSLKSRISITRDTSKNQYYLQLNSVTTEDTATYYCARYFYGSYYEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20916 - protein, 120 aa, Artificial Sequence
  Description of Artificial Sequence: Synthetic polypeptide
  VH of XENP020267
EVQLQESGPSLVKPSQTLSLTCSVTGDSITSGYWNWIRKFPGNKLEYMGYLSYSGSTYYNPSLKSRISITRDTSKNQYYLQLNSVTTEDTATYYCARYFYGSYYEAMDYWGQGTSVTVSS

SEQ ID NO: 20917 - protein, 5 aa, Artificial Sequence
  Description of Artificial Sequence: Synthetic peptide
  XENP020267 vhCDR1
SGYWN

SEQ ID NO: 20918 - protein, 16 aa, Artificial Sequence
  Description of Artificial Sequence: Synthetic peptide
  XENP020267 vhCDR2
YLSYSGSTYYNPSLKS

SEQ ID NO: 20919 - protein, 12 aa, Artificial Sequence
  Description of Artificial Sequence: Synthetic peptide
  XENP020267 vhCDR3
YFYGSYYEAMDY

SEQ ID NO: 20920 - protein, 214 aa, Artificial Sequence
  Description of Artificial Sequence: Synthetic polypeptide
  XENP020267 3F6_H0L0_anti-BTLA_IgG1_PVA_/S267K Light Chain
DVQITQSPSYLAASPGETISINCRASKSISKYLAWYQEKPGKTNKLLIYSGSTLQSGIPSRFSGSGSGTDFTLTISSLEPEDFAMYYCQQHNEYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20921 - protein, 107 aa, Artificial Sequence
  Description of Artificial Sequence: Synthetic polypeptide
  VL of XENP020267
DVQITQSPSYLAASPGETISINCRASKSISKYLAWYQEKPGKTNKLLIYSGSTLQSGIPSRFSGSGSGTDFTLTISSLEPEDFAMYYCQQHNEYPWTFGGGTKLEIK

SEQ ID NO: 20922 - protein, 11 aa, Artificial Sequence
  Description of Artificial Sequence: Synthetic peptide
  XENP020267 vlCDR1
RASKSISKYLA

SEQ ID NO: 20923 - protein, 7 aa, Artificial Sequence
  Description of Artificial Sequence: Synthetic peptide
  XENP020267 vlCDR2
SGSTLQS

SEQ ID NO: 20924 - protein, 9 aa, Artificial Sequence
  Description of Artificial Sequence: Synthetic peptide
  XENP020267 vlCDR3
QQHNEYPWT

SEQ ID NO: 20925 - protein, 448 aa, Artificial Sequence
  Description of Artificial Sequence: Synthetic polypeptide
  XENP020268 1A9_H0L0_anti-BTLA_IgG1_PVA_/S267K Heavy Chain
DVQLVESGGGLVQPGGSRKLSCAASGFTFSSFGMHWVRQAPEKGLEWVAYISSGISTIYYADTVKGRFTISRDNPKNTLFLQMTSLRSEDTAMYYCARDWLRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20926 - protein, 119 aa, Artificial Sequence
  Description of Artificial Sequence: Synthetic polypeptide
  VH of XENP020268
DVQLVESGGGLVQPGGSRKLSCAASGFTFSSFGMHWVRQAPEKGLEWVAYISSGISTIYYADTVKGRFTISRDNPKNTLFLQMTSLRSEDTAMYYCARDWLRGYAMDYWGQGTSVTVSS

SEQ ID NO: 20927 - protein, 5 aa, Artificial Sequence
  Description of Artificial Sequence: Synthetic peptide
  XENP020268 vhCDR1
SFGMH

SEQ ID NO: 20928 - protein, 17 aa, Artificial Sequence
  Description of Artificial Sequence: Synthetic peptide
  XENP020268 vhCDR2
YISSGISTIYYADTVKG

SEQ ID NO: 20929 - protein, 10 aa, Artificial Sequence
  Description of Artificial Sequence: Synthetic peptide
  XENP020268 vhCDR3
DWLRGYAMDY

SEQ ID NO: 20930 - protein, 218 aa, Artificial Sequence
  Description of Artificial Sequence: Synthetic polypeptide
  XENP020268 1A9_H0L0_anti-BTLA_IgG1_PVA_/S267K Light Chain
DIVLTQSPASLAVSLGQRATISCKASQSIDYDGDSYMNWYQQKPGQPPKLLIYAASNLDFGIPARFSGSGSGTDFTLNIHPVEEEDAATYYCQQSNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20931 - protein, 111 aa, Artificial Sequence
  Description of Artificial Sequence: Synthetic polypeptide
  VL of XENP020268
DIVLTQSPASLAVSLGQRATISCKASQSIDYDGDSYMNWYQQKPGQPPKLLIYAASNLDFGIPARFSGSGSGTDFTLNIHPVEEEDAATYYCQQSNEDPWTFGGGTKLEIK

SEQ ID NO: 20932 - protein, 15 aa, Artificial Sequence
  Description of Artificial Sequence: Synthetic peptide
  XENP020268 vlCDR1
KASQSIDYDGDSYMN

SEQ ID NO: 20933 - protein, 7 aa, Artificial Sequence
  Description of Artificial Sequence: Synthetic peptide
  XENP020268 vlCDR2
AASNLDF

SEQ ID NO: 20934 - protein, 9 aa, Artificial Sequence
  Description of Artificial Sequence: Synthetic peptide
  XENP020268 vlCDR3
QQSNEDPWT

SEQ ID NO: 20935 - protein, 447 aa, Artificial Sequence
  Description of Artificial Sequence: Synthetic polypeptide
  XENP020269 9C6_H0L0_anti-BTLA_IgG1_PVA_/S267K Heavy Chain
QVQLKESGPGLVAPSQSLSITCTVSGFSLTGYGVNWVRQPPGKGLEWLGMIWIDGSTDYNSALKSRLSINKDNSKSQVFLKMNSLQTDDTARYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20936 - protein, 118 aa, Artificial Sequence
  Description of Artificial Sequence: Synthetic polypeptide
  VH of XENP020269
QVQLKESGPGLVAPSQSLSITCTVSGFSLTGYGVNWVRQPPGKGLEWLGMIWIDGSTDYNSALKSRLSINKDNSKSQVFLKMNSLQTDDTARYYCARDRPDGRAMDYWGQGTSVTVSS

SEQ ID NO: 20937 - protein, 5 aa, Artificial Sequence
  Description of Artificial Sequence: Synthetic peptide
  XENP020269 vhCDR1
GYGVN

SEQ ID NO: 20938 - protein, 16 aa, Artificial Sequence
  Description of Artificial Sequence: Synthetic peptide
  XENP020269 vhCDR2
MIWIDGSTDYNSALKS

SEQ ID NO: 20939 - protein, 10 aa, Artificial Sequence
  Description of Artificial Sequence: Synthetic peptide
  XENP020269 vhCDR3
DRPDGRAMDY

SEQ ID NO: 20940 - protein, 213 aa, Artificial Sequence
  Description of Artificial Sequence: Synthetic polypeptide
  XENP020269 9C6_H0L0_anti-BTLA_IgG1_PVA_/S267K Light Chain
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20941 - protein, 106 aa, Artificial Sequence
  Description of Artificial Sequence: Synthetic polypeptide
  VL of XENP020269
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPTFGGGTKLEIK

SEQ ID NO: 20942 - protein, 11 aa, Artificial Sequence
  Description of Artificial Sequence: Synthetic peptide
  XENP020269 vlCDR1
KASQSVSNDVA

SEQ ID NO: 20943 - protein, 7 aa, Artificial Sequence
  Description of Artificial Sequence: Synthetic peptide
  XENP020269 vlCDR2
YASNRYT

SEQ ID NO: 20944 - protein, 8 aa, Artificial Sequence
  Description of Artificial Sequence: Synthetic peptide
  XENP020269 vlCDR3
QQDYSSPT

SEQ ID NO: 20945 - protein, 447 aa, Artificial Sequence; identical to SEQ ID NO: 20935
  Description of Artificial Sequence: Synthetic polypeptide
  XENP020270 7H2_H0L0_anti-BTLA_IgG1_PVA_/S267K Heavy Chain

SEQ ID NO: 20946 - protein, 118 aa, Artificial Sequence; identical to SEQ ID NO: 20936
  Description of Artificial Sequence: Synthetic polypeptide
  VH of XENP020270

SEQ ID NO: 20947 - protein, 5 aa, Artificial Sequence
  Description of Artificial Sequence: Synthetic peptide
  XENP020270 vhCDR1
GYGVN

SEQ ID NO: 20948 - protein, 16 aa, Artificial Sequence
  Description of Artificial Sequence: Synthetic peptide
  XENP020270 vhCDR2
MIWIDGSTDYNSALKS

SEQ ID NO: 20949 - protein, 10 aa, Artificial Sequence
  Description of Artificial Sequence: Synthetic peptide
  XENP020270 vhCDR3
DRPDGRAMDY

SEQ ID NO: 20950 - protein, 213 aa, Artificial Sequence
  Description of Artificial Sequence: Synthetic polypeptide
  XENP020270 7H2_H0L0_anti-BTLA_IgG1_PVA_/S267K Light Chain
SIVMTQTPKFLLVSAGDRVTITCKASQSVSNDVAWYQQKPGQSPKLLIYYASNRYTGVPDRFTGSGYGTDFTFTISTVQAEDLAVYFCQQDYNSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20951 - protein, 106 aa, Artificial Sequence
  Description of Artificial Sequence: Synthetic polypeptide
  VL of XENP020270
SIVMTQTPKFLLVSAGDRVTITCKASQSVSNDVAWYQQKPGQSPKLLIYYASNRYTGVPDRFTGSGYGTDFTFTISTVQAEDLAVYFCQQDYNSPTFGGGTKLEIK

SEQ ID NO: 20952 - protein, 11 aa, Artificial Sequence
  Description of Artificial Sequence: Synthetic peptide
  XENP020270 vlCDR1
KASQSVSNDVA

SEQ ID NO: 20953 - protein, 7 aa, Artificial Sequence
  Description of Artificial Sequence: Synthetic peptide
  XENP020270 vlCDR2
YASNRYT

SEQ ID NO: 20954 - protein, 8 aa, Artificial Sequence
  Description of Artificial Sequence: Synthetic peptide
  XENP020270 vlCDR3
QQDYNSPT

SEQ ID NO: 20955 - protein, 447 aa, Artificial Sequence
  Description of Artificial Sequence: Synthetic polypeptide
  XENP020271 6C3_H0L0_anti-BTLA_IgG1_PVA_/S267K Heavy Chain
EVQLQQSGAELVRSGASVKLSCTASGFNIKDYYMHWVKQRPEQGLEWIGWLDPENGDTVYVPKFQGKATMTADTSSNTAYLQLTSLTSEDSAVYYCNAGDYGSSFNYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20956 - protein, 118 aa, Artificial Sequence
  Description of Artificial Sequence: Synthetic polypeptide
  VH of XENP020271
EVQLQQSGAELVRSGASVKLSCTASGFNIKDYYMHWVKQRPEQGLEWIGWLDPENGDTVYVPKFQGKATMTADTSSNTAYLQLTSLTSEDSAVYYCNAGDYGSSFNYWGQGTTLTVSS

SEQ ID NO: 20957 - protein, 5 aa, Artificial Sequence
  Description of Artificial Sequence: Synthetic peptide
  XENP020271 vhCDR1
DYYMH

SEQ ID NO: 20958 - protein, 17 aa, Artificial Sequence
  Description of Artificial Sequence: Synthetic peptide
  XENP020271 vhCDR2
WLDPENGDTVYVPKFQG

SEQ ID NO: 20959 - protein, 9 aa, Artificial Sequence
  Description of Artificial Sequence: Synthetic peptide
  XENP020271 vhCDR3
GDYGSSFNY

SEQ ID NO: 20960 - protein, 219 aa, Artificial Sequence
  Description of Artificial Sequence: Synthetic polypeptide
  XENP020271 6C3_H0L0_anti-BTLA_IgG1_PVA_/S267K Light Chain
DIVMSQSPSSLAVSVGEKVTMSCKSSQSLLYSGNQKNYLAWYQQRPGQSPKLLIYWASTRESGVPDRFTGSGSGTDFTLTISSVKTEDLAVYYCQQYYTYHTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20961 - protein, 112 aa, Artificial Sequence
  Description of Artificial Sequence: Synthetic polypeptide
  VL of XENP020271
DIVMSQSPSSLAVSVGEKVTMSCKSSQSLLYSGNQKNYLAWYQQRPGQSPKLLIYWASTRESGVPDRFTGSGSGTDFTLTISSVKTEDLAVYYCQQYYTYHTFGGGTKLEIK

SEQ ID NO: 20962 - protein, 17 aa, Artificial Sequence
  Description of Artificial Sequence: Synthetic peptide
  XENP020271 vlCDR1
KSSQSLLYSGNQKNYLA

SEQ ID NO: 20963 - protein, 7 aa, Artificial Sequence
  Description of Artificial Sequence: Synthetic peptide
  XENP020271 vlCDR2
WASTRES

SEQ ID NO: 20964 - protein, 8 aa, Artificial Sequence
  Description of Artificial Sequence: Synthetic peptide
  XENP020271 vlCDR3
QQYYTYHT

SEQ ID NO: 20965 - protein, 449 aa, Artificial Sequence
  Description of Artificial Sequence: Synthetic polypeptide
  XENP020272 9C10_H0L0_anti-BTLA_IgG1_PVA_/S267K Heavy Chain
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARYYYGSYYEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20966 - protein, 120 aa, Artificial Sequence
  Description of Artificial Sequence: Synthetic polypeptide
  VH of XENP020272
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARYYYGSYYEAMDYWGQGTSVTVSS

SEQ ID NO: 20967 - protein, 5 aa, Artificial Sequence
  Description of Artificial Sequence: Synthetic peptide
  XENP020272 vhCDR1
SGYWN

SEQ ID NO: 20968 - protein, 16 aa, Artificial Sequence
  Description of Artificial Sequence: Synthetic peptide
  XENP020272 vhCDR2
YISYSGSTYYNPSLKS

SEQ ID NO: 20969 - protein, 12 aa, Artificial Sequence
  Description of Artificial Sequence: Synthetic peptide
  XENP020272 vhCDR3
YYYGSYYEAMDY

SEQ ID NO: 20970 - protein, 214 aa, Artificial Sequence
  Description of Artificial Sequence: Synthetic polypeptide
  XENP020272 9C10_H0L0_anti-BTLA_IgG1_PVA_/S267K Light Chain
DVQITQSPSYLAASPGETITINCRASKSISKYLAWYQEKPGKTNKLLLYSGSTLQSGIPSRFSGSGSGTDFTLTISSLEPEDFAMYYCQQHNEYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20971 - protein, 107 aa, Artificial Sequence
  Description of Artificial Sequence: Synthetic polypeptide
  VL of XENP020272
DVQITQSPSYLAASPGETITINCRASKSISKYLAWYQEKPGKTNKLLLYSGSTLQSGIPSRFSGSGSGTDFTLTISSLEPEDFAMYYCQQHNEYPWTFGGGTKLEIK

SEQ ID NO: 20972 - protein, 11 aa, Artificial Sequence
  Description of Artificial Sequence: Synthetic peptide
  XENP020272 vlCDR1
RASKSISKYLA

SEQ ID NO: 20973 - protein, 7 aa, Artificial Sequence
  Description of Artificial Sequence: Synthetic peptide
  XENP020272 vlCDR2
SGSTLQS

SEQ ID NO: 20974 - protein, 9 aa, Artificial Sequence
  Description of Artificial Sequence: Synthetic peptide
  XENP020272 vlCDR3
QQHNEYPWT

SEQ ID NO: 20975 - protein, 443 aa, Artificial Sequence
  Description of Artificial Sequence: Synthetic polypeptide
  XENP020273 12E6_H0L0_anti-BTLA_IgG1_PVA_/S267K Heavy Chain
QVQLQQSGAELMKPGASVKISCKATGYTFSNYWIEWVKQRPGHGLEWIGEILPGSGGTNYNEKFKGKATFTADTSSNTAYMQLSGLTSEDSAVYYCASPRYDLWGQGTSVTASSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20976 - protein, 114 aa, Artificial Sequence
  Description of Artificial Sequence: Synthetic polypeptide
  VH of XENP020273
QVQLQQSGAELMKPGASVKISCKATGYTFSNYWIEWVKQRPGHGLEWIGEILPGSGGTNYNEKFKGKATFTADTSSNTAYMQLSGLTSEDSAVYYCASPRYDLWGQGTSVTASS

SEQ ID NO: 20977 - protein, 5 aa, Artificial Sequence
  Description of Artificial Sequence: Synthetic peptide
  XENP020273 vhCDR1
NYWIE

SEQ ID NO: 20978 - protein, 17 aa, Artificial Sequence
  Description of Artificial Sequence: Synthetic peptide
  XENP020273 vhCDR2
EILPGSGGTNYNEKFKG

SEQ ID NO: 20979 - protein, 5 aa, Artificial Sequence
  Description of Artificial Sequence: Synthetic peptide
  XENP020273 vhCDR3
PRYDL

SEQ ID NO: 20980 - protein, 219 aa, Artificial Sequence
  Description of Artificial Sequence: Synthetic polypeptide
  XENP020273 12E6_H0L0_anti-BTLA_IgG1_PVA_/S267K Light Chain
DVVMTQTPLTLSVTVGQPASISCKSSQSLLHSDGETYLNWFLQRPGQSPKRLIYLVSKRDSGVPDRFTGSGSGTDFTLKISRVEAEDLGVYYCWQGIHFPQTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20981 - protein, 112 aa, Artificial Sequence
  Description of Artificial Sequence: Synthetic polypeptide
  VL of XENP020273
DVVMTQTPLTLSVTVGQPASISCKSSQSLLHSDGETYLNWFLQRPGQSPKRLIYLVSKRDSGVPDRFTGSGSGTDFTLKISRVEAEDLGVYYCWQGIHFPQTFGRGTKLEIK

SEQ ID NO: 20982 - protein, 16 aa, Artificial Sequence
  Description of Artificial Sequence: Synthetic peptide
  XENP020273 vlCDR1
KSSQSLLHSDGETYLN

SEQ ID NO: 20983 - protein, 7 aa, Artificial Sequence
  Description of Artificial Sequence: Synthetic peptide
  XENP020273 vlCDR2
LVSKRDS

SEQ ID NO: 20984 - protein, 9 aa, Artificial Sequence
  Description of Artificial Sequence: Synthetic peptide
  XENP020273 vlCDR3
WQGIHFPQT

SEQ ID NO: 20985 - protein, 442 aa, Artificial Sequence
  Description of Artificial Sequence: Synthetic polypeptide
  XENP020274 4C11A_H0L0_anti-BTLA_IgG1_PVA_/S267K Heavy Chain
QVQLQQSGAELVKPGASVKLSCKASGYTFTSYYMDWVKQRPGQGLEWIGEINPSNGDTKFNEKFKSKATLTVDKSSTTAYMQLSSLTSEDSAVYYCTRDYGYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20986 - protein, 113 aa, Artificial Sequence
  Description of Artificial Sequence: Synthetic polypeptide
  VH of XENP020274
QVQLQQSGAELVKPGASVKLSCKASGYTFTSYYMDWVKQRPGQGLEWIGEINPSNGDTKFNEKFKSKATLTVDKSSTTAYMQLSSLTSEDSAVYYCTRDYGYWGQGTTLTVSS

SEQ ID NO: 20987 - protein, 5 aa, Artificial Sequence
  Description of Artificial Sequence: Synthetic peptide
  XENP020274 vhCDR1
SYYMD

SEQ ID NO: 20988 - protein, 17 aa, Artificial Sequence
  Description of Artificial Sequence: Synthetic peptide
  XENP020274 vhCDR2
EINPSNGDTKFNEKFKS

SEQ ID NO: 20989 - protein, 4 aa, Artificial Sequence
  Description of Artificial Sequence: Synthetic peptide
  XENP020274 vhCDR3
DYGY

SEQ ID NO: 20990 - protein, 214 aa, Artificial Sequence
  Description of Artificial Sequence: Synthetic polypeptide
  XENP020274 4C11A_H0L0_anti-BTLA_IgG1_PVA_/S267K Light Chain
DIVMTQSPATLSVTPGDRVSLSCRASQSISDYLHWYQQKSHESPRLLIKYASQSISGIPSRFSGSGSGSDFTLNINGVEPEDVGVYYCQNGHSFPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20991 - protein, 107 aa, Artificial Sequence
  Description of Artificial Sequence: Synthetic polypeptide
  VL of XENP020274
DIVMTQSPATLSVTPGDRVSLSCRASQSISDYLHWYQQKSHESPRLLIKYASQSISGIPSRFSGSGSGSDFTLNINGVEPEDVGVYYCQNGHSFPPTFGGGTKLEIK

SEQ ID NO: 20992 - protein, 11 aa, Artificial Sequence
  Description of Artificial Sequence: Synthetic peptide
  XENP020274 vlCDR1
RASQSISDYLH

SEQ ID NO: 20993 - protein, 7 aa, Artificial Sequence
  Description of Artificial Sequence: Synthetic peptide
  XENP020274 vlCDR2
YASQSIS

SEQ ID NO: 20994 - protein, 9 aa, Artificial Sequence
  Description of Artificial Sequence: Synthetic peptide
  XENP020274 vlCDR3
QNGHSFPPT

SEQ ID NO: 20995 - protein, 442 aa, Artificial Sequence; identical to SEQ ID NO: 20985
  Description of Artificial Sequence: Synthetic polypeptide
  XENP020275 4C11B_H0L0_anti-BTLA_IgG1_PVA_/S267K Heavy Chain

SEQ ID NO: 20996 - protein, 113 aa, Artificial Sequence; identical to SEQ ID NO: 20986
  Description of Artificial Sequence: Synthetic polypeptide
  VH of XENP020275

SEQ ID NO: 20997 - protein, 5 aa, Artificial Sequence
  Description of Artificial Sequence: Synthetic peptide
  XENP020275 vhCDR1
SYYMD

SEQ ID NO: 20998 - protein, 17 aa, Artificial Sequence
  Description of Artificial Sequence: Synthetic peptide
  XENP020275 vhCDR2
EINPSNGDTKFNEKFKS

SEQ ID NO: 20999 - protein, 4 aa, Artificial Sequence
  Description of Artificial Sequence: Synthetic peptide
  XENP020275 vhCDR3
DYGY

SEQ ID NO: 21000 - protein, 213 aa, Artificial Sequence; identical to SEQ ID NO: 20940
  Description of Artificial Sequence: Synthetic polypeptide
  XENP020275 4C11B_H0L0_anti-BTLA_IgG1_PVA_/S267K Light Chain

SEQ ID NO: 21001 - protein, 106 aa, Artificial Sequence; identical to SEQ ID NO: 20941
  Description of Artificial Sequence: Synthetic polypeptide
  VL of XENP020275

SEQ ID NO: 21002 - protein, 11 aa, Artificial Sequence
  Description of Artificial Sequence: Synthetic peptide
  XENP020275 vlCDR1
KASQSVSNDVA

SEQ ID NO: 21003 - protein, 7 aa, Artificial Sequence
  Description of Artificial Sequence: Synthetic peptide
  XENP020275 vlCDR2
YASNRYT

SEQ ID NO: 21004 - protein, 8 aa, Artificial Sequence
  Description of Artificial Sequence: Synthetic peptide
  XENP020275 vlCDR3
QQDYSSPT

SEQ ID NO: 21005 - protein, 449 aa, Artificial Sequence
  Description of Artificial Sequence: Synthetic polypeptide
  XENP020276 7B10_H0L0_anti-BTLA_IgG1_PVA_/S267K Heavy Chain
QVTLKESGPGILQPSQTLSLTCSFSGFSLSTFGMGVNWIRQPSGKGLEWLAHIYWDDDKHYNPSLKSRLTISKDTSNNQVFLKITTVDTADTATYYCARYYRYDVPYIMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 21006 - protein, 122 aa, Artificial Sequence
  Description of Artificial Sequence: Synthetic polypeptide
  VH of XENP020276
QVTLKESGPGILQPSQTLSLTCSFSGFSLSTFGMGVNWIRQPSGKGLEWLAHIYWDDDKHYNPSLKSRLTISKDTSNNQVFLKITTVDTADTATYYCARYYRYDVPYIMDYWGQGTSVTVSS

SEQ ID NO: 21007 - protein, 7 aa, Artificial Sequence
  Description of Artificial Sequence: Synthetic peptide
  XENP020276 vhCDR1
TFGMGVN

SEQ ID NO: 21008 - protein, 16 aa, Artificial Sequence
  Description of Artificial Sequence: Synthetic peptide
  XENP020276 vhCDR2
HIYWDDDKHYNPSLKS

SEQ ID NO: 21009 - protein, 12 aa, Artificial Sequence
  Description of Artificial Sequence: Synthetic peptide
  XENP020276 vhCDR3
YYRYDVPYIMDY

SEQ ID NO: 21010 - protein, 219 aa, Artificial Sequence
  Description of Artificial Sequence: Synthetic polypeptide
  XENP020276 7B10_H0L0_anti-BTLA_IgG1_PVA_/S267K Light Chain
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCHQYYSYYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21011 - protein, 112 aa, Artificial Sequence
  Description of Artificial Sequence: Synthetic polypeptide
  VL of XENP020276
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCHQYYSYYTFGGGTKLEIK

SEQ ID NO: 21012 - protein, 17 aa, Artificial Sequence
  Description of Artificial Sequence: Synthetic peptide
  XENP020276 vlCDR1
KSSQSLLYSSNQKNYLA

SEQ ID NO: 21013 - protein, 7 aa, Artificial Sequence
  Description of Artificial Sequence: Synthetic peptide
  XENP020276 vlCDR2
WASTRES

SEQ ID NO: 21014 - protein, 8 aa, Artificial Sequence
  Description of Artificial Sequence: Synthetic peptide
  XENP020276 vlCDR3
HQYYSYYT

SEQ ID NO: 21015 - protein, 449 aa, Artificial Sequence
  Description of Artificial Sequence: Synthetic polypeptide
  XENP020277 8C1A_H0L0_anti-BTLA_IgG1_PVA_/S267K Heavy Chain
EVQLQESGPSLVKPSQTLSLTCSVTGDSVTSGYWNWIRKFPGNKLEYMGYINYSGSTYYNPSLKSRISITRDTSKNQYYLQLNSVTTEDTATYYCARSFIATVGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21016 - protein, 120 aa, Artificial Sequence
  Description of Artificial Sequence: Synthetic polypeptide
  VH of XENP020277
EVQLQESGPSLVKPSQTLSLTCSVTGDSVTSGYWNWIRKFPGNKLEYMGYINYSGSTYYNPSLKSRISITRDTSKNQYYLQLNSVTTEDTATYYCARSFIATVGYAMDYWGQGTSVTVSS

SEQ ID NO: 21017 - protein, 5 aa, Artificial Sequence
  Description of Artificial Sequence: Synthetic peptide
  XENP020277 vhCDR1
SGYWN

SEQ ID NO: 21018 - protein, 16 aa, Artificial Sequence
  Description of Artificial Sequence: Synthetic peptide
  XENP020277 vhCDR2
YINYSGSTYYNPSLKS

SEQ ID NO: 21019 - protein, 12 aa, Artificial Sequence
  Description of Artificial Sequence: Synthetic peptide
  XENP020277 vhCDR3
SFIATVGYAMDY

SEQ ID NO: 21020 - protein, 214 aa, Artificial Sequence
  Description of Artificial Sequence: Synthetic polypeptide
  XENP020277 8C1A_H0L0_anti-BTLA_IgG1_PVA_/S267K Light Chain
SIVMTQTPKFLLVSAGDRVTITCKASQSVNNDVSWYQQKPGQSPKLLIYSASNRYTGVPDRFTGSGYGTDFTFTISTVQAEDLAVYFCQQDYSSPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21021 - protein, 107 aa, Artificial Sequence
  Description of Artificial Sequence: Synthetic polypeptide
  VL of XENP020277
SIVMTQTPKFLLVSAGDRVTITCKASQSVNNDVSWYQQKPGQSPKLLIYSASNRYTGVPDRFTGSGYGTDFTFTISTVQAEDLAVYFCQQDYSSPWTFGGGTKLEIK

SEQ ID NO: 21022 - protein, 11 aa, Artificial Sequence
  Description of Artificial Sequence: Synthetic peptide
  XENP020277 vlCDR1
KASQSVNNDVS

SEQ ID NO: 21023 - protein, 7 aa, Artificial Sequence
  Description of Artificial Sequence: Synthetic peptide
  XENP020277 vlCDR2
SASNRYT

SEQ ID NO: 21024 - protein, 9 aa, Artificial Sequence
  Description of Artificial Sequence: Synthetic peptide
  XENP020277 vlCDR3
QQDYSSPWT

SEQ ID NO: 21025 - protein, 441 aa, Artificial Sequence
  Description of Artificial Sequence: Synthetic polypeptide
  XENP020278 8C1B_H0L0_anti-BTLA_IgG1_PVA_/S267K Heavy Chain
QVQLQQPGAELVRPGASVRLSCKASGYTFTSYWIHWVKQRPGQGLEWIGNIYSSDSYTNYNQKFKDKATLTVDKSSSTAYIHLSSPTSEDSAVYYCTRVDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21026 - protein, 112 aa, Artificial Sequence
  Description of Artificial Sequence: Synthetic polypeptide
  VH of XENP020278
QVQLQQPGAELVRPGASVRLSCKASGYTFTSYWIHWVKQRPGQGLEWIGNIYSSDSYTNYNQKFKDKATLTVDKSSSTAYIHLSSPTSEDSAVYYCTRVDYWGQGTTLTVSS

SEQ ID NO: 21027 - protein, 5 aa, Artificial Sequence
  Description of Artificial Sequence: Synthetic peptide
  XENP020278 vhCDR1
SYWIH

SEQ ID NO: 21028 - protein, 17 aa, Artificial Sequence
  Description of Artificial Sequence: Synthetic peptide
  XENP020278 vhCDR2
NIYSSDSYTNYNQKFKD

SEQ ID NO: 21029 - protein, 3 aa, Artificial Sequence
  Description of Artificial Sequence: Synthetic peptide
  XENP020278 vhCDR3
VDY

SEQ ID NO: 21030 - protein, 214 aa, Artificial Sequence; identical to SEQ ID NO: 21020
  Description of Artificial Sequence: Synthetic polypeptide
  XENP020278 8C1B_H0L0_anti-BTLA_IgG1_PVA_/S267K Light Chain

SEQ ID NO: 21031 - protein, 107 aa, Artificial Sequence; identical to SEQ ID NO: 21021
  Description of Artificial Sequence: Synthetic polypeptide
  VL of XENP020278

SEQ ID NO: 21032 - protein, 11 aa, Artificial Sequence
  Description of Artificial Sequence: Synthetic peptide
  XENP020278 vlCDR1
KASQSVNNDVS

SEQ ID NO: 21033 - protein, 7 aa, Artificial Sequence
  Description of Artificial Sequence: Synthetic peptide
  XENP020278 vlCDR2
SASNRYT

SEQ ID NO: 21034 - protein, 9 aa, Artificial Sequence
  Description of Artificial Sequence: Synthetic peptide
  XENP020278 vlCDR3
QQDYSSPWT

SEQ ID NO: 21035 - protein, 447 aa, Artificial Sequence
  Description of Artificial Sequence: Synthetic polypeptide
  XENP020279 10B6_H0L0_anti-BTLA_IgG1_PVA_/S267K Heavy Chain
QVQLKESGPGLVAPSQSLSITCTVSGFSLTGYGVNWVRQPPGKGLEWLGMIWIDGSTDYNSALKSRLSISKDNSKSQVFLKMNSLQTDDTARYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21036 - protein, 118 aa, Artificial Sequence
  Description of Artificial Sequence: Synthetic polypeptide
  VH of XENP020279
QVQLKESGPGLVAPSQSLSITCTVSGFSLTGYGVNWVRQPPGKGLEWLGMIWIDGSTDYNSALKSRLSISKDNSKSQVFLKMNSLQTDDTARYYCARDRPDGRAMDYWGQGTSVTVSS

SEQ ID NO: 21037 - protein, 5 aa, Artificial Sequence
  Description of Artificial Sequence: Synthetic peptide
  XENP020279 vhCDR1
GYGVN

SEQ ID NO: 21038 - protein, 16 aa, Artificial Sequence
  Description of Artificial Sequence: Synthetic peptide
  XENP020279 vhCDR2
MIWIDGSTDYNSALKS

SEQ ID NO: 21039 - protein, 10 aa, Artificial Sequence
  Description of Artificial Sequence: Synthetic peptide
  XENP020279 vhCDR3
DRPDGRAMDY

SEQ ID NO: 21040 - protein, 213 aa, Artificial Sequence
  Description of Artificial Sequence: Synthetic polypeptide
  XENP020279 10B6_H0L0_anti-BTLA_IgG1_PVA_/S267K Light Chain
SIVMTQTPKFLLVSAGDRVTITCKASQTVSNDVTWYQQKPGQSPKLLIYYASNRYTGVPDRFTGSGYGTDFTFTISTVQAEDLAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21041 - protein, 106 aa, Artificial Sequence
  Description of Artificial Sequence: Synthetic polypeptide
  VL of XENP020279
SIVMTQTPKFLLVSAGDRVTITCKASQTVSNDVTWYQQKPGQSPKLLIYYASNRYTGVPDRFTGSGYGTDFTFTISTVQAEDLAVYFCQQDYSSPTFGGGTKLEIK

SEQ ID NO: 21042 - protein, 11 aa, Artificial Sequence
  Description of Artificial Sequence: Synthetic peptide
  XENP020279 vlCDR1
KASQTVSNDVT

SEQ ID NO: 21043 - protein, 7 aa, Artificial Sequence
  Description of Artificial Sequence: Synthetic peptide
  XENP020279 vlCDR2
YASNRYT

SEQ ID NO: 21044 - protein, 8 aa, Artificial Sequence
  Description of Artificial Sequence: Synthetic peptide
  XENP020279 vlCDR3
QQDYSSPT

SEQ ID NO: 21045 - protein, 447 aa, Artificial Sequence; identical to SEQ ID NO: 20935
  Description of Artificial Sequence: Synthetic polypeptide
  XENP020744 9C6_H0L1_anti-BTLA_IgG1_PVA_/S267K Heavy Chain

SEQ ID NO: 21046 - protein, 118 aa, Artificial Sequence; identical to SEQ ID NO: 20936
  Description of Artificial Sequence: Synthetic polypeptide
  VH of XENP020744

SEQ ID NO: 21047 - protein, 5 aa, Artificial Sequence
  Description of Artificial Sequence: Synthetic peptide
  XENP020744 vhCDR1
GYGVN

SEQ ID NO: 21048 - protein, 16 aa, Artificial Sequence
  Description of Artificial Sequence: Synthetic peptide
  XENP020744 vhCDR2
MIWIDGSTDYNSALKS

SEQ ID NO: 21049 - protein, 10 aa, Artificial Sequence
  Description of Artificial Sequence: Synthetic peptide
  XENP020744 vhCDR3
DRPDGRAMDY

SEQ ID NO: 21050 - protein, 213 aa, Artificial Sequence
  Description of Artificial Sequence: Synthetic polypeptide
  XENP020744 9C6_H0L1_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21051 - protein, 106 aa, Artificial Sequence
  Description of Artificial Sequence: Synthetic polypeptide
  VL of XENP020744
SIVMTQSPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 21052 - protein, 11 aa, Artificial Sequence
  Description of Artificial Sequence: Synthetic peptide
  XENP020744 vlCDR1
KASQSVSNDVA

SEQ ID NO: 21053 - protein, 7 aa, Artificial Sequence
  Description of Artificial Sequence: Synthetic peptide
  XENP020744 vlCDR2
YASNRYT

SEQ ID NO: 21054 - protein, 8 aa, Artificial Sequence
  Description of Artificial Sequence: Synthetic peptide
  XENP020744 vlCDR3
QQDYSSPT

SEQ ID NO: 21055 - protein, 447 aa, Artificial Sequence; identical to SEQ ID NO: 20935
  Description of Artificial Sequence: Synthetic polypeptide
  XENP020745 9C6_H0L2_anti-BTLA_IgG1_PVA_/S267K Heavy Chain

SEQ ID NO: 21056 - protein, 118 aa, Artificial Sequence; identical to SEQ ID NO: 20936
  Description of Artificial Sequence: Synthetic polypeptide
  VH of XENP020745

SEQ ID NO: 21057 - protein, 5 aa, Artificial Sequence
  Description of Artificial Sequence: Synthetic peptide
  XENP020745 vhCDR1
GYGVN

SEQ ID NO: 21058 - protein, 16 aa, Artificial Sequence
  Description of Artificial Sequence: Synthetic peptide
  XENP020745 vhCDR2
MIWIDGSTDYNSALKS

SEQ ID NO: 21059 - protein, 10 aa, Artificial Sequence
  Description of Artificial Sequence: Synthetic peptide
  XENP020745 vhCDR3
DRPDGRAMDY

SEQ ID NO: 21060 - protein, 213 aa, Artificial Sequence
  Description of Artificial Sequence: Synthetic polypeptide
  XENP020745 9C6_H0L2_anti-BTLA_IgG1_PVA_/S267K Light Chain
SIVMTQSPLSLPVTPGEPASISCRASQSVSNDVAWYLQKPGQSPQLLIYYASNRYTGVPDRFTGSGYGTDFTLKISRVEAEDVGVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21061 - protein, 106 aa, Artificial Sequence
  Description of Artificial Sequence: Synthetic polypeptide
  VL of XENP020745
SIVMTQSPLSLPVTPGEPASISCRASQSVSNDVAWYLQKPGQSPQLLIYYASNRYTGVPDRFTGSGYGTDFTLKISRVEAEDVGVYFCQQDYSSPTFGGGTKLEIK

SEQ ID NO: 21062 - protein, 11 aa, Artificial Sequence
  Description of Artificial Sequence: Synthetic peptide
  XENP020745 vlCDR1
RASQSVSNDVA

SEQ ID NO: 21063 - protein, 7 aa, Artificial Sequence
  Description of Artificial Sequence: Synthetic peptide
  XENP020745 vlCDR2
YASNRYT

SEQ ID NO: 21064 - protein, 8 aa, Artificial Sequence
  Description of Artificial Sequence: Synthetic peptide
  XENP020745 vlCDR3
QQDYSSPT

SEQ ID NO: 21065 - protein, 447 aa, Artificial Sequence
  Description of Artificial Sequence: Synthetic polypeptide
  XENP020746 9C6_H1L0_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21066 - protein, 118 aa, Artificial Sequence
  Description of Artificial Sequence: Synthetic polypeptide
  VH of XENP020746
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 21067 - protein, 5 aa, Artificial Sequence
  Description of Artificial Sequence: Synthetic peptide
  XENP020746 vhCDR1
GYGVN

SEQ ID NO: 21068 - protein, 16 aa, Artificial Sequence
  Description of Artificial Sequence: Synthetic peptide
  XENP020746 vhCDR2
MIWIDGSTDYNSKFQG

SEQ ID NO: 21069 - protein, 10 aa, Artificial Sequence
  Description of Artificial Sequence: Synthetic peptide
  XENP020746 vhCDR3
DRPDGRAMDY

SEQ ID NO: 21070 - protein, 213 aa, Artificial Sequence; identical to SEQ ID NO: 20940
  Description of Artificial Sequence: Synthetic polypeptide
  XENP020746 9C6_H1L0_anti-BTLA_IgG1_PVA_/S267K Light Chain

SEQ ID NO: 21071 - protein, 106 aa, Artificial Sequence; identical to SEQ ID NO: 20941
  Description of Artificial Sequence: Synthetic polypeptide
  VL of XENP020746

SEQ ID NO: 21072 - protein, 11 aa, Artificial Sequence
  Description of Artificial Sequence: Synthetic peptide
  XENP020746 vlCDR1
KASQSVSNDVA

SEQ ID NO: 21073 - protein, 7 aa, Artificial Sequence
  Description of Artificial Sequence: Synthetic peptide
  XENP020746 vlCDR2
YASNRYT

SEQ ID NO: 21074 - protein, 8 aa, Artificial Sequence
  Description of Artificial Sequence: Synthetic peptide
  XENP020746 vlCDR3
QQDYSSPT

SEQ ID NO: 21075 - protein, 447 aa, Artificial Sequence; identical to SEQ ID NO: 21065
  Description of Artificial Sequence: Synthetic polypeptide
  XENP020747 9C6_H1L1_anti-BTLA_IgG1_PVA_/S267K Heavy Chain

SEQ ID NO: 21076 - protein, 118 aa, Artificial Sequence; identical to SEQ ID NO: 21066
  Description of Artificial Sequence: Synthetic polypeptide
  VH of XENP020747

SEQ ID NO: 21077 - protein, 5 aa, Artificial Sequence
  Description of Artificial Sequence: Synthetic peptide
  XENP020747 vhCDR1
GYGVN

SEQ ID NO: 21078 - protein, 16 aa, Artificial Sequence
  Description of Artificial Sequence: Synthetic peptide
  XENP020747 vhCDR2
MIWIDGSTDYNSKFQG

SEQ ID NO: 21079 - protein, 10 aa, Artificial Sequence
  Description of Artificial Sequence: Synthetic peptide
  XENP020747 vhCDR3
DRPDGRAMDY

SEQ ID NO: 21080 - protein, 213 aa, Artificial Sequence; identical to SEQ ID NO: 21050
  Description of Artificial Sequence: Synthetic polypeptide
  XENP020747 9C6_H1L1_anti-BTLA_IgG1_PVA_/S267K Light Chain

SEQ ID NO: 21081 - protein, 106 aa, Artificial Sequence; identical to SEQ ID NO: 21051
  Description of Artificial Sequence: Synthetic polypeptide
  VL of XENP020747

SEQ ID NO: 21082 - protein, 11 aa, Artificial Sequence
  Description of Artificial Sequence: Synthetic peptide
  XENP020747 vlCDR1
KASQSVSNDVA

SEQ ID NO: 21083 - protein, 7 aa, Artificial Sequence
  Description of Artificial Sequence: Synthetic peptide
  XENP020747 vlCDR2
YASNRYT

SEQ ID NO: 21084 - protein, 8 aa, Artificial Sequence
  Description of Artificial Sequence: Synthetic peptide
  XENP020747 vlCDR3
QQDYSSPT

SEQ ID NO: 21085 - protein, 447 aa, Artificial Sequence; identical to SEQ ID NO: 21065
  Description of Artificial Sequence: Synthetic polypeptide
  XENP020748 9C6_H1L2_anti-BTLA_IgG1_PVA_/S267K Heavy Chain

SEQ ID NO: 21086 - protein, 118 aa, Artificial Sequence; identical to SEQ ID NO: 21066
  Description of Artificial Sequence: Synthetic polypeptide
  VH of XENP020748

SEQ ID NO: 21087 - protein, 5 aa, Artificial Sequence
  Description of Artificial Sequence: Synthetic peptide
  XENP020748 vhCDR1
GYGVN

SEQ ID NO: 21088 - protein, 16 aa, Artificial Sequence
  Description of Artificial Sequence: Synthetic peptide
  XENP020748 vhCDR2
MIWIDGSTDYNSKFQG

SEQ ID NO: 21089 - protein, 10 aa, Artificial Sequence
  Description of Artificial Sequence: Synthetic peptide
  XENP020748 vhCDR3
DRPDGRAMDY

SEQ ID NO: 21090 - protein, 213 aa, Artificial Sequence; identical to SEQ ID NO: 21060
  Description of Artificial Sequence: Synthetic polypeptide
  XENP020748 9C6_H1L2_anti-BTLA_IgG1_PVA_/S267K Light Chain

SEQ ID NO: 21091 - protein, 106 aa, Artificial Sequence; identical to SEQ ID NO: 21061
  Description of Artificial Sequence: Synthetic polypeptide
  VL of XENP020748

SEQ ID NO: 21092 - protein, 11 aa, Artificial Sequence
  Description of Artificial Sequence: Synthetic peptide
  XENP020748 vlCDR1
RASQSVSNDVA

SEQ ID NO: 21093 - protein, 7 aa, Artificial Sequence
  Description of Artificial Sequence: Synthetic peptide
  XENP020748 vlCDR2
YASNRYT

SEQ ID NO: 21094 - protein, 8 aa, Artificial Sequence
  Description of Artificial Sequence: Synthetic peptide
  XENP020748 vlCDR3
QQDYSSPT

SEQ ID NO: 21095 - protein, 447 aa, Artificial Sequence
  Description of Artificial Sequence: Synthetic polypeptide
  XENP020749 9C6_H2L0_anti-BTLA_IgG1_PVA_/S267K Heavy Chain
EVQLVESGGGLVQPGGSLRLSCAVSGFSLTGYGVNWVRQAPGKGLEWVSMIWIDGSTDYNPSVKGRFTISKDNSKSTVYLQMNSLRAEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21096 - protein, 118 aa, Artificial Sequence
  Description of Artificial Sequence: Synthetic polypeptide
  VH of XENP020749
EVQLVESGGGLVQPGGSLRLSCAVSGFSLTGYGVNWVRQAPGKGLEWVSMIWIDGSTDYNPSVKGRFTISKDNSKSTVYLQMNSLRAEDTAVYYCARDRPDGRAMDYWGQGTMVTVSS

SEQ ID NO: 21097 - protein, 5 aa, Artificial Sequence
  Description of Artificial Sequence: Synthetic peptide
  XENP020749 vhCDR1
GYGVN

SEQ ID NO: 21098 - protein, 16 aa, Artificial Sequence
  Description of Artificial Sequence: Synthetic peptide
  XENP020749 vhCDR2
MIWIDGSTDYNPSVKG

SEQ ID NO: 21099 - protein, 10 aa, Artificial Sequence
  Description of Artificial Sequence: Synthetic peptide
  XENP020749 vhCDR3
DRPDGRAMDY

SEQ ID NO: 21100 - protein, 213 aa, Artificial Sequence; identical to SEQ ID NO: 20940
  Description of Artificial Sequence: Synthetic polypeptide
  XENP020749 9C6_H2L0_anti-BTLA_IgG1_PVA_/S267K Light Chain

SEQ ID NO: 21101 - protein, 106 aa, Artificial Sequence; identical to SEQ ID NO: 20941
  Description of Artificial Sequence: Synthetic polypeptide
  VL of XENP020749

SEQ ID NO: 21102 - protein, 11 aa, Artificial Sequence
  Description of Artificial Sequence: Synthetic peptide
  XENP020749 vlCDR1
KASQSVSNDVA

SEQ ID NO: 21103 - protein, 7 aa, Artificial Sequence
  Description of Artificial Sequence: Synthetic peptide
  XENP020749 vlCDR2
YASNRYT

SEQ ID NO: 21104 - protein, 8 aa, Artificial Sequence
  Description of Artificial Sequence: Synthetic peptide
  XENP020749 vlCDR3
QQDYSSPT

SEQ ID NO: 21105 - protein, 447 aa, Artificial Sequence; identical to SEQ ID NO: 21095
  Description of Artificial Sequence: Synthetic polypeptide
  XENP020750 9C6_H2L1_anti-BTLA_IgG1_PVA_/S267K Heavy Chain

SEQ ID NO: 21106 - protein, 118 aa, Artificial Sequence; identical to SEQ ID NO: 21096
  Description of Artificial Sequence: Synthetic polypeptide
  VH of XENP020750

SEQ ID NO: 21107 - protein, 5 aa, Artificial Sequence
  Description of Artificial Sequence: Synthetic peptide
  XENP020750 vhCDR1
GYGVN

SEQ ID NO: 21108 - protein, 16 aa, Artificial Sequence
  Description of Artificial Sequence: Synthetic peptide
  XENP020750 vhCDR2
MIWIDGSTDYNPSVKG

SEQ ID NO: 21109 - protein, 10 aa, Artificial Sequence
  Description of Artificial Sequence: Synthetic peptide
  XENP020750 vhCDR3
DRPDGRAMDY

SEQ ID NO: 21110 - protein, 213 aa, Artificial Sequence; identical to SEQ ID NO: 21050
  Description of Artificial Sequence: Synthetic polypeptide
  XENP020750 9C6_H2L1_anti-BTLA_IgG1_PVA_/S267K Light Chain

SEQ ID NO: 21111 - protein, 106 aa, Artificial Sequence; identical to SEQ ID NO: 21051
  Description of Artificial Sequence: Synthetic polypeptide
  VL of XENP020750

SEQ ID NO: 21112 - protein, 11 aa, Artificial Sequence
  Description of Artificial Sequence: Synthetic peptide
  XENP020750 vlCDR1
KASQSVSNDVA

SEQ ID NO: 21113 - protein, 7 aa, Artificial Sequence
  Description of Artificial Sequence: Synthetic peptide
  XENP020750 vlCDR2
YASNRYT

SEQ ID NO: 21114 - protein, 8 aa, Artificial Sequence
  Description of Artificial Sequence: Synthetic peptide
  XENP020750 vlCDR3
QQDYSSPT

SEQ ID NO: 21115 - protein, 447 aa, Artificial Sequence; identical to SEQ ID NO: 21095
  Description of Artificial Sequence: Synthetic polypeptide
  XENP020751 9C6_H2L2_anti-BTLA_IgG1_PVA_/S267K Heavy Chain

SEQ ID NO: 21116 - protein, 118 aa, Artificial Sequence; identical to SEQ ID NO: 21096
  Description of Artificial Sequence: Synthetic polypeptide
  VH of XENP020751

SEQ ID NO: 21117 - protein, 5 aa, Artificial Sequence
  Description of Artificial Sequence: Synthetic peptide
  XENP020751 vhCDR1
GYGVN

SEQ ID NO: 21118 - protein, 16 aa, Artificial Sequence
  Description of Artificial Sequence: Synthetic peptide
  XENP020751 vhCDR2
MIWIDGSTDYNPSVKG

SEQ ID NO: 21119 - protein, 10 aa, Artificial Sequence
  Description of Artificial Sequence: Synthetic peptide
  XENP020751 vhCDR3
DRPDGRAMDY

SEQ ID NO: 21120 - protein, 213 aa, Artificial Sequence; identical to SEQ ID NO: 21060
  Description of Artificial Sequence: Synthetic polypeptide
  XENP020751 9C6_H2L2_anti-BTLA_IgG1_PVA_/S267K Light Chain

SEQ ID NO: 21121 - protein, 106 aa, Artificial Sequence; identical to SEQ ID NO: 21061
  Description of Artificial Sequence: Synthetic polypeptide
  VL of XENP020751

SEQ ID NO: 21122 - protein, 11 aa, Artificial Sequence
  Description of Artificial Sequence: Synthetic peptide
  XENP020751 vlCDR1
RASQSVSNDVA

SEQ ID NO: 21123 - protein, 7 aa, Artificial Sequence
  Description of Artificial Sequence: Synthetic peptide
  XENP020751 vlCDR2
YASNRYT

SEQ ID NO: 21124 - protein, 8 aa, Artificial Sequence
  Description of Artificial Sequence: Synthetic peptide
  XENP020751 vlCDR3
QQDYSSPT

SEQ ID NO: 21125 - protein, 447 aa, Artificial Sequence
  Description of Artificial Sequence: Synthetic polypeptide
  XENP020752 9C6_H3L0_anti-BTLA_IgG1_PVA_/S267K Heavy Chain
QVTLKESGPVLVKPTETLTLTCTVSGFSLTGYGVNWVRQPPGKGLEWLAMIWIDGSTDYNPSLKSRLTISKDNSKSQVVLTMTNMDPVDTATYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21126 - protein, 118 aa, Artificial Sequence
  Description of Artificial Sequence: Synthetic polypeptide
  VH of XENP020752
QVTLKESGPVLVKPTETLTLTCTVSGFSLTGYGVNWVRQPPGKGLEWLAMIWIDGSTDYNPSLKSRLTISKDNSKSQVVLTMTNMDPVDTATYYCARDRPDGRAMDYWGQGTMVTVSS

SEQ ID NO: 21127 - protein, 5 aa, Artificial Sequence
  Description of Artificial Sequence: Synthetic peptide
  XENP020752 vhCDR1
GYGVN

SEQ ID NO: 21128 - protein, 16 aa, Artificial Sequence
  Description of Artificial Sequence: Synthetic peptide
  XENP020752 vhCDR2
MIWIDGSTDYNPSLKS

SEQ ID NO: 21129 - protein, 10 aa, Artificial Sequence
  Description of Artificial Sequence: Synthetic peptide
  XENP020752 vhCDR3
DRPDGRAMDY

SEQ ID NO: 21130 - protein, 213 aa, Artificial Sequence; identical to SEQ ID NO: 20940
  Description of Artificial Sequence: Synthetic polypeptide
  XENP020752 9C6_H3L0_anti-BTLA_IgG1_PVA_/S267K Light Chain

SEQ ID NO: 21131 - protein, 106 aa, Artificial Sequence; identical to SEQ ID NO: 20941
  Description of Artificial Sequence: Synthetic polypeptide
  VL of XENP020752

SEQ ID NO: 21132 - protein, 11 aa, Artificial Sequence
  Description of Artificial Sequence: Synthetic peptide
  XENP020752 vlCDR1
KASQSVSNDVA

SEQ ID NO: 21133 - protein, 7 aa, Artificial Sequence
  Description of Artificial Sequence: Synthetic peptide
  XENP020752 vlCDR2
YASNRYT

SEQ ID NO: 21134 - protein, 8 aa, Artificial Sequence
  Description of Artificial Sequence: Synthetic peptide
  XENP020752 vlCDR3
QQDYSSPT

SEQ ID NO: 21135 - protein, 447 aa, Artificial Sequence; identical to SEQ ID NO: 21125
  Description of Artificial Sequence: Synthetic polypeptide
  XENP020753 9C6_H3L1_anti-BTLA_IgG1_PVA_/S267K Heavy Chain

SEQ ID NO: 21136 - protein, 118 aa, Artificial Sequence; identical to SEQ ID NO: 21126
  Description of Artificial Sequence: Synthetic polypeptide
  VH of XENP020753

SEQ ID NO: 21137 - protein, 5 aa, Artificial Sequence
  Description of Artificial Sequence: Synthetic peptide
  XENP020753 vhCDR1
GYGVN

SEQ ID NO: 21138 - protein, 16 aa, Artificial Sequence
  Description of Artificial Sequence: Synthetic peptide
  XENP020753 vhCDR2
MIWIDGSTDYNPSLKS

SEQ ID NO: 21139 - protein, 10 aa, Artificial Sequence
  Description of Artificial Sequence: Synthetic peptide
  XENP020753 vhCDR3
DRPDGRAMDY

SEQ ID NO: 21140 - protein, 213 aa, Artificial Sequence; identical to SEQ ID NO: 21050
  Description of Artificial Sequence: Synthetic polypeptide
  XENP020753 9C6_H3L1_anti-BTLA_IgG1_PVA_/S267K Light Chain

SEQ ID NO: 21141 - protein, 106 aa, Artificial Sequence; identical to SEQ ID NO: 21051
  Description of Artificial Sequence: Synthetic polypeptide
  VL of XENP020753

SEQ ID NO: 21142 - protein, 11 aa, Artificial Sequence
  Description of Artificial Sequence: Synthetic peptide
  XENP020753 vlCDR1
KASQSVSNDVA

SEQ ID NO: 21143 - protein, 7 aa, Artificial Sequence
  Description of Artificial Sequence: Synthetic peptide
  XENP020753 vlCDR2
YASNRYT

SEQ ID NO: 21144 - protein, 8 aa, Artificial Sequence
  Description of Artificial Sequence: Synthetic peptide
  XENP020753 vlCDR3
QQDYSSPT

SEQ ID NO: 21145 - protein, 447 aa, Artificial Sequence; identical to SEQ ID NO: 21125
  Description of Artificial Sequence: Synthetic polypeptide
  XENP020754 9C6_H3L2_anti-BTLA_IgG1_PVA_/S267K Heavy Chain

SEQ ID NO: 21146 - protein, 118 aa, Artificial Sequence; identical to SEQ ID NO: 21126
  Description of Artificial Sequence: Synthetic polypeptide
  VH of XENP020754

SEQ ID NO: 21147 - protein, 5 aa, Artificial Sequence
  Description of Artificial Sequence: Synthetic peptide
  XENP020754 vhCDR1
GYGVN

SEQ ID NO: 21148 - protein, 16 aa, Artificial Sequence
  Description of Artificial Sequence: Synthetic peptide
  XENP020754 vhCDR2
MIWIDGSTDYNPSLKS

SEQ ID NO: 21149 - protein, 10 aa, Artificial Sequence
  Description of Artificial Sequence: Synthetic peptide
  XENP020754 vhCDR3
DRPDGRAMDY

SEQ ID NO: 21150 - protein, 213 aa, Artificial Sequence; identical to SEQ ID NO: 21060
  Description of Artificial Sequence: Synthetic polypeptide
  XENP020754 9C6_H3L2_anti-BTLA_IgG1_PVA_/S267K Light Chain

SEQ ID NO: 21151 - protein, 106 aa, Artificial Sequence; identical to SEQ ID NO: 21061
  Description of Artificial Sequence: Synthetic polypeptide
  VL of XENP020754

SEQ ID NO: 21152 - protein, 11 aa, Artificial Sequence
  Description of Artificial Sequence: Synthetic peptide
  XENP020754 vlCDR1
RASQSVSNDVA

SEQ ID NO: 21153 - protein, 7 aa, Artificial Sequence
  Description of Artificial Sequence: Synthetic peptide
  XENP020754 vlCDR2
YASNRYT

SEQ ID NO: 21154 - protein, 8 aa, Artificial Sequence
  Description of Artificial Sequence: Synthetic peptide
  XENP020754 vlCDR3
QQDYSSPT

SEQ ID NO: 21155 - protein, 443 aa, Artificial Sequence; identical to SEQ ID NO: 20975
  Description of Artificial Sequence: Synthetic polypeptide
  XENP020758 12E6_H0L1_anti-BTLA_IgG1_PVA_/S267K Heavy Chain

SEQ ID NO: 21156 - protein, 5 aa, Artificial Sequence
  Description of Artificial Sequence: Synthetic peptide
  XENP020758 vhCDR1
NYWIE

SEQ ID NO: 21157 - protein, 17 aa, Artificial Sequence
  Description of Artificial Sequence: Synthetic peptide
  XENP020758 vhCDR2
EILPGSGGTNYNEKFKG

SEQ ID NO: 21158 - protein, 5 aa, Artificial Sequence
  Description of Artificial Sequence: Synthetic peptide
  XENP020758 vhCDR3
PRYDL

SEQ ID NO: 21159 - protein, 219 aa, Artificial Sequence
  Description of Artificial Sequence: Synthetic polypeptide
  XENP020758 12E6_H0L1_anti-BTLA_IgG1_PVA_/S267K Light Chain
DVVLTQSPLSLPVTLGQPASISCRSSQSLLHSDGETYLNYFQQRPGQSPRRLIYLVSKRDSGVPDRFTGSGSGTDFTLKISRVEAEDVGVYYCWQGIHFPQTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21160 - protein, 112 aa, Artificial Sequence
  Description of Artificial Sequence: Synthetic polypeptide
  VL of XENP020758
DVVLTQSPLSLPVTLGQPASISCRSSQSLLHSDGETYLNYFQQRPGQSPRRLIYLVSKRDSGVPDRFTGSGSGTDFTLKISRVEAEDVGVYYCWQGIHFPQTFGRGTKLEIK

SEQ ID NO: 21161 - protein, 16 aa, Artificial Sequence
  Description of Artificial Sequence: Synthetic peptide
  XENP020758 vlCDR1
RSSQSLLHSDGETYLN

SEQ ID NO: 21162 - protein, 7 aa, Artificial Sequence
  Description of Artificial Sequence: Synthetic peptide
  XENP020758 vlCDR2
LVSKRDS

SEQ ID NO: 21163 - protein, 9 aa, Artificial Sequence
  Description of Artificial Sequence: Synthetic peptide
  XENP020758 vlCDR3
WQGIHFPQT

SEQ ID NO: 21164 - protein, 443 aa, Artificial Sequence
  Description of Artificial Sequence: Synthetic polypeptide
  XENP020759 12E6_H1L0_anti-BTLA_IgG1_PVA_/S267K Heavy Chain
QVQLVQSGAEVKKPGASVKVSCKASGYTFSNYGIEWVRQAPGQGLEWMGEILPGSGGTNYNEKFQGRVTMTADTSINTAYMELSRLRSDDTAVYYCASPRYDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21165 - protein, 114 aa, Artificial Sequence
  Description of Artificial Sequence: Synthetic polypeptide
  VH of XENP020759
QVQLVQSGAEVKKPGASVKVSCKASGYTFSNYGIEWVRQAPGQGLEWMGEILPGSGGTNYNEKFQGRVTMTADTSINTAYMELSRLRSDDTAVYYCASPRYDLWGQGTLVTVSS

SEQ ID NO: 21166 - protein, 5 aa, Artificial Sequence
  Description of Artificial Sequence: Synthetic peptide
  XENP020759 vhCDR1
NYGIE

SEQ ID NO: 21167 - protein, 17 aa, Artificial Sequence
  Description of Artificial Sequence: Synthetic peptide
  XENP020759 vhCDR2
EILPGSGGTNYNEKFQG

SEQ ID NO: 21168 - protein, 5 aa, Artificial Sequence
  Description of Artificial Sequence: Synthetic peptide
  XENP020759 vhCDR3
PRYDL

SEQ ID NO: 21169 - protein, 219 aa, Artificial Sequence; identical to SEQ ID NO: 20980
  Description of Artificial Sequence: Synthetic polypeptide
  XENP020759 12E6_H1L0_anti-BTLA_IgG1_PVA_/S267K Light Chain

SEQ ID NO: 21170 - protein, 112 aa, Artificial Sequence; identical to SEQ ID NO: 20981
  Description of Artificial Sequence: Synthetic polypeptide
  VL of XENP020759

SEQ ID NO: 21171 - protein, 16 aa, Artificial Sequence
  Description of Artificial Sequence: Synthetic peptide
  XENP020759 vlCDR1
KSSQSLLHSDGETYLN

SEQ ID NO: 21172 - protein, 7 aa, Artificial Sequence
  Description of Artificial Sequence: Synthetic peptide
  XENP020759 vlCDR2
LVSKRDS

SEQ ID NO: 21173 - protein, 9 aa, Artificial Sequence
  Description of Artificial Sequence: Synthetic peptide
  XENP020759 vlCDR3
WQGIHFPQT

SEQ ID NO: 21174 - protein, 443 aa, Artificial Sequence; identical to SEQ ID NO: 21164
  Description of Artificial Sequence: Synthetic polypeptide
  XENP020760 12E6_H1L1_anti-BTLA_IgG1_PVA_/S267K Heavy Chain

SEQ ID NO: 21175 - protein, 114 aa, Artificial Sequence; identical to SEQ ID NO: 21165
  Description of Artificial Sequence: Synthetic polypeptide
  VH of XENP020760

SEQ ID NO: 21176 - protein, 5 aa, Artificial Sequence
  Description of Artificial Sequence: Synthetic peptide
  XENP020760 vhCDR1
NYGIE

SEQ ID NO: 21177 - protein, 17 aa, Artificial Sequence
  Description of Artificial Sequence: Synthetic peptide
  XENP020760 vhCDR2
EILPGSGGTNYNEKFQG

SEQ ID NO: 21178 - protein, 5 aa, Artificial Sequence
  Description of Artificial Sequence: Synthetic peptide
  XENP020760 vhCDR3
PRYDL

SEQ ID NO: 21179 - protein, 219 aa, Artificial Sequence; identical to SEQ ID NO: 21159
  Description of Artificial Sequence: Synthetic polypeptide
  XENP020760 12E6_H1L1_anti-BTLA_IgG1_PVA_/S267K Light Chain

SEQ ID NO: 21180 - protein, 112 aa, Artificial Sequence; identical to SEQ ID NO: 21160
  Description of Artificial Sequence: Synthetic polypeptide
  VL of XENP020760

SEQ ID NO: 21181 - protein, 16 aa, Artificial Sequence
  Description of Artificial Sequence: Synthetic peptide
  XENP020760 vlCDR1
RSSQSLLHSDGETYLN

SEQ ID NO: 21182 - protein, 7 aa, Artificial Sequence
  Description of Artificial Sequence: Synthetic peptide
  XENP020760 vlCDR2
LVSKRDS

SEQ ID NO: 21183 - protein, 9 aa, Artificial Sequence
  Description of Artificial Sequence: Synthetic peptide
  XENP020760 vlCDR3
WQGIHFPQT

SEQ ID NO: 21184 - protein, 443 aa, Artificial Sequence
  Description of Artificial Sequence: Synthetic polypeptide
  XENP020761 12E6_H2L0_anti-BTLA_IgG1_PVA_/S267K Heavy Chain
EVQLLESGGGLVQPGGSLRLSCAASGYTFSNYGIEWVRQAPGKGLEWVSEILPGSGGTNYNPSVKGRFTISADTSKNTAYLQMNSLRAEDTAVYYCASPRYDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21185 - protein, 114 aa, Artificial Sequence
  Description of Artificial Sequence: Synthetic polypeptide
  VH of XENP020761
EVQLLESGGGLVQPGGSLRLSCAASGYTFSNYGIEWVRQAPGKGLEWVSEILPGSGGTNYNPSVKGRFTISADTSKNTAYLQMNSLRAEDTAVYYCASPRYDLWGQGTLVTVSS

SEQ ID NO: 21186 - protein, 5 aa, Artificial Sequence
  Description of Artificial Sequence: Synthetic peptide
  XENP020761 vhCDR1
NYGIE

SEQ ID NO: 21187 - protein, 17 aa, Artificial Sequence
  Description of Artificial Sequence: Synthetic peptide
  XENP020761 vhCDR2
EILPGSGGTNYNPSVKG

SEQ ID NO: 21188 - protein, 5 aa, Artificial Sequence
  Description of Artificial Sequence: Synthetic peptide
  XENP020761 vhCDR3
PRYDL

SEQ ID NO: 21189 - protein, 219 aa, Artificial Sequence; identical to SEQ ID NO: 20980
  Description of Artificial Sequence: Synthetic polypeptide
  XENP020761 12E6_H2L0_anti-BTLA_IgG1_PVA_/S267K Light Chain

SEQ ID NO: 21190 - protein, 112 aa, Artificial Sequence; identical to SEQ ID NO: 20981
  Description of Artificial Sequence: Synthetic polypeptide
  VL of XENP020761

SEQ ID NO: 21191 - protein, 16 aa, Artificial Sequence
  Description of Artificial Sequence: Synthetic peptide
  XENP020761 vlCDR1
KSSQSLLHSDGETYLN

SEQ ID NO: 21192 - protein, 7 aa, Artificial Sequence
  Description of Artificial Sequence: Synthetic peptide
  XENP020761 vlCDR2
LVSKRDS

SEQ ID NO: 21193 - protein, 9 aa, Artificial Sequence
  Description of Artificial Sequence: Synthetic peptide
  XENP020761 vlCDR3
WQGIHFPQT

SEQ ID NO: 21194 - protein, 443 aa, Artificial Sequence; identical to SEQ ID NO: 21184
  Description of Artificial Sequence: Synthetic polypeptide
  XENP020762 12E6_H2L1_anti-BTLA_IgG1_PVA_/S267K Heavy Chain

SEQ ID NO: 21195 - protein, 114 aa, Artificial Sequence; identical to SEQ ID NO: 21185
  Description of Artificial Sequence: Synthetic polypeptide
  VH of XENP020762

SEQ ID NO: 21196 - protein, 5 aa, Artificial Sequence
  Description of Artificial Sequence: Synthetic peptide
  XENP020762 vhCDR1
NYGIE

SEQ ID NO: 21197 - protein, 17 aa, Artificial Sequence
  Description of Artificial Sequence: Synthetic peptide
  XENP020762 vhCDR2
EILPGSGGTNYNPSVKG

SEQ ID NO: 21198 - protein, 5 aa, Artificial Sequence
  Description of Artificial Sequence: Synthetic peptide
  XENP020762 vhCDR3
PRYDL

SEQ ID NO: 21199 - protein, 219 aa, Artificial Sequence; identical to SEQ ID NO: 21159
  Description of Artificial Sequence: Synthetic polypeptide
  XENP020762 12E6_H2L1_anti-BTLA_IgG1_PVA_/S267K Light Chain

SEQ ID NO: 21200 - protein, 112 aa, Artificial Sequence; identical to SEQ ID NO: 21160
  Description of Artificial Sequence: Synthetic polypeptide
  VL of XENP020762

SEQ ID NO: 21201 - protein, 16 aa, Artificial Sequence
  Description of Artificial Sequence: Synthetic peptide
  XENP020762 vlCDR1
RSSQSLLHSDGETYLN

SEQ ID NO: 21202 - protein, 7 aa, Artificial Sequence
  Description of Artificial Sequence: Synthetic peptide
  XENP020762 vlCDR2
LVSKRDS

SEQ ID NO: 21203 - protein, 9 aa, Artificial Sequence
  Description of Artificial Sequence: Synthetic peptide
  XENP020762 vlCDR3
WQGIHFPQT

SEQ ID NO: 21204 - protein, 447 aa, Artificial Sequence
  Description of Artificial Sequence: Synthetic polypeptide
  XENP020872 9C6_H1.1_L1_anti-BTLA_IgG1_PVA_/S267K Heavy Chain
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21205 - protein, 118 aa, Artificial Sequence
  Description of Artificial Sequence: Synthetic polypeptide
  VH of XENP020872
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 21206 - protein, 5 aa, Artificial Sequence
  Description of Artificial Sequence: Synthetic peptide
  XENP020872 vhCDR1
GYGVN

SEQ ID NO: 21207 - protein, 16 aa, Artificial Sequence
  Description of Artificial Sequence: Synthetic peptide
  XENP020872 vhCDR2
MIWIDGSTDYNSKFQG

SEQ ID NO: 21208 - protein, 10 aa, Artificial Sequence
  Description of Artificial Sequence: Synthetic peptide
  XENP020872 vhCDR3
DRPDGRAMDY

SEQ ID NO: 21209 - protein, 213 aa, Artificial Sequence; identical to SEQ ID NO: 21050
  Description of Artificial Sequence: Synthetic polypeptide
  XENP020872 9C6_H1.1_L1_anti-BTLA_IgG1_PVA_/S267K Light Chain

SEQ ID NO: 21210 - protein, 106 aa, Artificial Sequence; identical to SEQ ID NO: 21051
  Description of Artificial Sequence: Synthetic polypeptide
  VL of XENP020872

SEQ ID NO: 21211 - protein, 11 aa, Artificial Sequence
  Description of Artificial Sequence: Synthetic peptide
  XENP020872 vlCDR1
KASQSVSNDVA

SEQ ID NO: 21212 - protein, 7 aa, Artificial Sequence
  Description of Artificial Sequence: Synthetic peptide
  XENP020872 vlCDR2
YASNRYT

SEQ ID NO: 21213 - protein, 8 aa, Artificial Sequence
  Description of Artificial Sequence: Synthetic peptide
  XENP020872 vlCDR3
QQDYSSPT

SEQ ID NO: 21214 - protein, 447 aa, Artificial Sequence
  Description of Artificial Sequence: Synthetic polypeptide
  XENP020873 9C6_H1.2_L1_anti-BTLA_IgG1_PVA_/S267K Heavy Chain
QVQLVQSGPGLVAPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21215 - protein, 118 aa, Artificial Sequence
  Description of Artificial Sequence: Synthetic polypeptide
  VH of XENP020873
QVQLVQSGPGLVAPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 21216 - protein, 5 aa, Artificial Sequence
  Description of Artificial Sequence: Synthetic peptide
  XENP020873 vhCDR1
GYGVN

SEQ ID NO: 21217 - protein, 16 aa, Artificial Sequence
  Description of Artificial Sequence: Synthetic peptide
  XENP020873 vhCDR2
MIWIDGSTDYNSKFQG

SEQ ID NO: 21218 - protein, 10 aa, Artificial Sequence
  Description of Artificial Sequence: Synthetic peptide
  XENP020873 vhCDR3
DRPDGRAMDY

SEQ ID NO: 21219 - protein, 213 aa, Artificial Sequence; identical to SEQ ID NO: 21050
  Description of Artificial Sequence: Synthetic polypeptide
  XENP020873 9C6_H1.2_L1_anti-BTLA_IgG1_PVA_/S267K Light Chain

SEQ ID NO: 21220 - protein, 106 aa, Artificial Sequence; identical to SEQ ID NO: 21051
  Description of Artificial Sequence: Synthetic polypeptide
  VL of XENP020873

SEQ ID NO: 21221 - protein, 11 aa, Artificial Sequence
  Description of Artificial Sequence: Synthetic peptide
  XENP020873 vlCDR1
KASQSVSNDVA

SEQ ID NO: 21222 - protein, 7 aa, Artificial Sequence
  Description of Artificial Sequence: Synthetic peptide
  XENP020873 vlCDR2
YASNRYT

SEQ ID NO: 21223 - protein, 8 aa, Artificial Sequence
  Description of Artificial Sequence: Synthetic peptide
  XENP020873 vlCDR3
QQDYSSPT

SEQ ID NO: 21224 - protein, 447 aa, Artificial Sequence
  Description of Artificial Sequence: Synthetic polypeptide
  XENP020874 9C6_H1.3_L1_anti-BTLA_IgG1_PVA_/S267K Heavy Chain
QVQLVQSGAEVKKPSQSVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21225 - protein, 118 aa, Artificial Sequence
  Description of Artificial Sequence: Synthetic polypeptide
  VH of XENP020874
QVQLVQSGAEVKKPSQSVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 21226 - protein, 5 aa, Artificial Sequence
  Description of Artificial Sequence: Synthetic peptide
  XENP020874 vhCDR1
GYGVN

SEQ ID NO: 21227 - protein, 16 aa, Artificial Sequence
  Description of Artificial Sequence: Synthetic peptide
  XENP020874 vhCDR2
MIWIDGSTDYNSKFQG

SEQ ID NO: 21228 - protein, 10 aa, Artificial Sequence
  Description of Artificial Sequence: Synthetic peptide
  XENP020874 vhCDR3
DRPDGRAMDY

SEQ ID NO: 21229 - protein, 213 aa, Artificial Sequence; identical to SEQ ID NO: 21050
  Description of Artificial Sequence: Synthetic polypeptide
  XENP020874 9C6_H1.3_L1_anti-BTLA_IgG1_PVA_/S267K Light Chain

SEQ ID NO: 21230 - protein, 106 aa, Artificial Sequence; identical to SEQ ID NO: 21051
  Description of Artificial Sequence: Synthetic polypeptide
  VL of XENP020874

SEQ ID NO: 21231 - protein, 11 aa, Artificial Sequence
  Description of Artificial Sequence: Synthetic peptide
  XENP020874 vlCDR1
KASQSVSNDVA

SEQ ID NO: 21232 - protein, 7 aa, Artificial Sequence
  Description of Artificial Sequence: Synthetic peptide
  XENP020874 vlCDR2
YASNRYT

SEQ ID NO: 21233 - protein, 8 aa, Artificial Sequence
  Description of Artificial Sequence: Synthetic peptide
  XENP020874 vlCDR3
QQDYSSPT

SEQ ID NO: 21234 - protein, 447 aa, Artificial Sequence
  Description of Artificial Sequence: Synthetic polypeptide
  XENP020875 9C6_H1.4_L1_anti-BTLA_IgG1_PVA_/S267K Heavy Chain
QVQLVQSGAEVKKPGASLSITCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21235 - protein, 118 aa, Artificial Sequence
  Description of Artificial Sequence: Synthetic polypeptide
  VH of XENP020875
QVQLVQSGAEVKKPGASLSITCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 21236 - protein, 5 aa, Artificial Sequence
  Description of Artificial Sequence: Synthetic peptide
  XENP020875 vhCDR1
GYGVN

SEQ ID NO: 21237 - protein, 16 aa, Artificial Sequence
  Description of Artificial Sequence: Synthetic peptide
  XENP020875 vhCDR2
MIWIDGSTDYNSKFQG

SEQ ID NO: 21238 - protein, 10 aa, Artificial Sequence
  Description of Artificial Sequence: Synthetic peptide
  XENP020875 vhCDR3
DRPDGRAMDY

SEQ ID NO: 21239 - protein, 213 aa, Artificial Sequence; identical to SEQ ID NO: 21050
  Description of Artificial Sequence: Synthetic polypeptide
  XENP020875 9C6_H1.4_L1_anti-BTLA_IgG1_PVA_/S267K Light Chain

SEQ ID NO: 21240 - protein, 106 aa, Artificial Sequence; identical to SEQ ID NO: 21051
  Description of Artificial Sequence: Synthetic polypeptide
  VL of XENP020875

SEQ ID NO: 21241 - protein, 11 aa, Artificial Sequence
  Description of Artificial Sequence: Synthetic peptide
  XENP020875 vlCDR1
KASQSVSNDVA

SEQ ID NO: 21242 - protein, 7 aa, Artificial Sequence
  Description of Artificial Sequence: Synthetic peptide
  XENP020875 vlCDR2
YASNRYT

SEQ ID NO: 21243 - protein, 8 aa, Artificial Sequence
  Description of Artificial Sequence: Synthetic peptide
  XENP020875 vlCDR3
QQDYSSPT

SEQ ID NO: 21244 - protein, 447 aa, Artificial Sequence
  Description of Artificial Sequence: Synthetic polypeptide
  XENP020876 9C6_H1.5_L1_anti-BTLA_IgG1_PVA_/S267K Heavy Chain
QVQLVQSGAEVKKPGASVKVSCTVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21245 - protein, 118 aa, Artificial Sequence
  Description of Artificial Sequence: Synthetic polypeptide
  VH of XENP020876
QVQLVQSGAEVKKPGASVKVSCTVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSS

SEQ ID NO: 21246 - protein, 5 aa, Artificial Sequence
  Description of Artificial Sequence: Synthetic peptide
  XENP020876 vhCDR1
GYGVN

SEQ ID NO: 21247 - protein, 16 aa, Artificial Sequence
  Description of Artificial Sequence: Synthetic peptide
  XENP020876 vhCDR2
MIWIDGSTDYNSKFQG

SEQ ID NO: 21248 - protein, 10 aa, Artificial Sequence
  Description of Artificial Sequence: Synthetic peptide
  XENP020876 vhCDR3
DRPDGRAMDY

SEQ ID NO: 21249 - protein, 213 aa, Artificial Sequence; identical to SEQ ID NO: 21050
  Description of Artificial Sequence: Synthetic polypeptide
  XENP020876 9C6_H1.5_L1_anti-BTLA_IgG1_PVA_/S267K Light Chain

SEQ ID NO: 21250 - protein, 106 aa, Artificial Sequence; identical to SEQ ID NO: 21051
  Description of Artificial Sequence: Synthetic polypeptide
  VL of XENP020876

SEQ ID NO: 21251 - protein, 11 aa, Artificial Sequence
  Description of Artificial Sequence: Synthetic peptide
  XENP020876 vlCDR1
KASQSVSNDVA

SEQ ID NO: 21252 - protein, 7 aa, Artificial Sequence
  Description of Artificial Sequence: Synthetic peptide
  XENP020876 vlCDR2
YASNRYT

SEQ ID NO: 21253 - protein, 8 aa, Artificial Sequence
  Description of Artificial Sequence: Synthetic peptide
  XENP020876 vlCDR3
QQDYSSPT

SEQ ID NO: 21254 - protein, 447 aa, Artificial Sequence
  Description of Artificial Sequence: Synthetic polypeptide
  XENP020877 9C6_H1.6_L1_anti-BTLA_IgG1_PVA_/S267K Heavy Chain
QVQLVQSGAEVKKPGASVKVSCKVSGFSLTGYGVNWVRQPPGKGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21255 - protein, 118 aa, Artificial Sequence
  Description of Artificial Sequence: Synthetic polypeptide
  VH of XENP020877
QVQLVQSGAEVKKPGASVKVSCKVSGFSLTGYGVNWVRQPPGKGLEWMGMIWIDGSTDYNSKFQGRVTMTKDNSKSTVYMELSSLRSEDTAVYYCARDRPDGRAMDYWGQGTMVTVSS

SEQ ID NO: 21256 - protein, 5 aa, Artificial Sequence
  Description of Artificial Sequence: Synthetic peptide
  XENP020877 vhCDR1
GYGVN

SEQ ID NO: 21257 - protein, 16 aa, Artificial Sequence
  Description of Artificial Sequence: Synthetic peptide
  XENP020877 vhCDR2
MIWIDGSTDYNSKFQG

SEQ ID NO: 21258 - protein, 10 aa, Artificial Sequence
  Description of Artificial Sequence: Synthetic peptide
  XENP020877 vhCDR3
DRPDGRAMDY

SEQ ID NO: 21259 - protein, 213 aa, Artificial Sequence; identical to SEQ ID NO: 21050
  Description of Artificial Sequence: Synthetic polypeptide
  XENP020877 9C6_H1.6_L1_anti-BTLA_IgG1_PVA_/S267K Light Chain

SEQ ID NO: 21260 - protein, 106 aa, Artificial Sequence; identical to SEQ ID NO: 21051
  Description of Artificial Sequence: Synthetic polypeptide
  VL of XENP020877

SEQ ID NO: 21261 - protein, 11 aa, Artificial Sequence
  Description of Artificial Sequence: Synthetic peptide
  XENP020877 vlCDR1
KASQSVSNDVA

SEQ ID NO: 21262 - protein, 7 aa, Artificial Sequence
  Description of Artificial Sequence: Synthetic peptide
  XENP020877 vlCDR2
YASNRYT

SEQ ID NO: 21263 - protein, 8 aa, Artificial Sequence
  Description of Artificial Sequence: Synthetic peptide
  XENP020877 vlCDR3
QQDYSSPT

SEQ ID NO: 21264 - protein, 447 aa, Artificial Sequence
  Description of Artificial Sequence: Synthetic polypeptide
  XENP020878 9C6_H1.7_L1_anti-BTLA_IgG1_PVA_/S267K Heavy Chain
QVQLVQSGAEVKKPGASVKVSCKVSGFSLTGYGVNWVRQAPGQGLEWLGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21265 - protein, 118 aa, Artificial Sequence
  Description of Artificial Sequence: Synthetic polypeptide
  VH of XENP020878
QVQLVQSGAEVKKPGASVKVSCKVSGFSLTGYGVNWVRQAPGQGLEWLGMIWIDGSTDYNSKFQGRVTMTKDNSKSTVYMELSSLRSEDTAVYYCARDRPDGRAMDYWGQGTMVTVSS

SEQ ID NO: 21266 - protein, 5 aa, Artificial Sequence
  Description of Artificial Sequence: Synthetic peptide
  XENP020878 vhCDR1
GYGVN

SEQ ID NO: 21267 - protein, 16 aa, Artificial Sequence
  Description of Artificial Sequence: Synthetic peptide
  XENP020878 vhCDR2
MIWIDGSTDYNSKFQG

SEQ ID NO: 21268 - protein, 10 aa, Artificial Sequence
  Description of Artificial Sequence: Synthetic peptide
  XENP020878 vhCDR3
DRPDGRAMDY

SEQ ID NO: 21269 - protein, 213 aa, Artificial Sequence; identical to SEQ ID NO: 21050
  Description of Artificial Sequence: Synthetic polypeptide
  XENP020878 9C6_H1.7_L1_anti-BTLA_IgG1_PVA_/S267K Light Chain

SEQ ID NO: 21270 - protein, 106 aa, Artificial Sequence; identical to SEQ ID NO: 21051
  Description of Artificial Sequence: Synthetic polypeptide
  VL of XENP020878

SEQ ID NO: 21271 - protein, 11 aa, Artificial Sequence
  Description of Artificial Sequence: Synthetic peptide
  XENP020878 vlCDR1
KASQSVSNDVA

SEQ ID NO: 21272 - protein, 7 aa, Artificial Sequence
  Description of Artificial Sequence: Synthetic peptide
  XENP020878 vlCDR2
YASNRYT

SEQ ID NO: 21273 - protein, 8 aa, Artificial Sequence
  Description of Artificial Sequence: Synthetic peptide
  XENP020878 vlCDR3
QQDYSSPT

SEQ ID NO: 21274 - protein, 447 aa, Artificial Sequence
  Description of Artificial Sequence: Synthetic polypeptide
  XENP020879 9C6_H1.8_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSAFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21275 - protein, 118 aa, Artificial Sequence
  Description of Artificial Sequence: Synthetic polypeptide
  VH of XENP020879
QVQLVQSGAEVKKPGASVKVSCKVSGFSLTGYGVNWVRQAPGQGLEWMGMIWIDGSTDYNSAFQGRVTMTKDNSKSTVYMELSSLRSEDTAVYYCARDRPDGRAMDYWGQGTMVTVSS

SEQ ID NO: 21276 - protein, 5 aa, Artificial Sequence
  Description of Artificial Sequence: Synthetic peptide
  XENP020879 vhCDR1
GYGVN

SEQ ID NO: 21277 - protein, 16 aa, Artificial Sequence
  Description of Artificial Sequence: Synthetic peptide
  XENP020879 vhCDR2
MIWIDGSTDYNSAFQG

SEQ ID NO: 21278 - protein, 10 aa, Artificial Sequence
  Description of Artificial Sequence: Synthetic peptide
  XENP020879 vhCDR3
DRPDGRAMDY

SEQ ID NO: 21279 - protein, 213 aa, Artificial Sequence; identical to SEQ ID NO: 21050
  Description of Artificial Sequence: Synthetic polypeptide
  XENP020879 9C6_H1.8_L1_anti-BTLA_IgG1_PVA_/S267K Light Chain

SEQ ID NO: 21280 - protein, 106 aa, Artificial Sequence; identical to SEQ ID NO: 21051
  Description of Artificial Sequence: Synthetic polypeptide
  VL of XENP020879

SEQ ID NO: 21281 - protein, 11 aa, Artificial Sequence
  Description of Artificial Sequence: Synthetic peptide
  XENP020879 vlCDR1
KASQSVSNDVA

SEQ ID NO: 21282 - protein, 7 aa, Artificial Sequence
  Description of Artificial Sequence: Synthetic peptide
  XENP020879 vlCDR2
YASNRYT

SEQ ID NO: 21283 - protein, 8 aa, Artificial Sequence
  Description of Artificial Sequence: Synthetic peptide
  XENP020879 vlCDR3
QQDYSSPT

SEQ ID NO: 21284 - protein, 447 aa, Artificial Sequence
  Description of Artificial Sequence: Synthetic polypeptide
  XENP020880 9C6_H1.9_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSALKSRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21285 - protein, 118 aa, Artificial Sequence
  Description of Artificial Sequence: Synthetic polypeptide
  VH of XENP020880
QVQLVQSGAEVKKPGASVKVSCKVSGFSLTGYGVNWVRQAPGQGLEWMGMIWIDGSTDYNSALKSRVTMTKDNSKSTVYMELSSLRSEDTAVYYCARDRPDGRAMDYWGQGTMVTVSS

SEQ ID NO: 21286 - protein, 5 aa, Artificial Sequence
  Description of Artificial Sequence: Synthetic peptide
  XENP020880 vhCDR1
GYGVN

SEQ ID NO: 21287 - protein, 16 aa, Artificial Sequence
  Description of Artificial Sequence: Synthetic peptide
  XENP020880 vhCDR2
MIWIDGSTDYNSALKS

SEQ ID NO: 21288 - protein, 10 aa, Artificial Sequence
  Description of Artificial Sequence: Synthetic peptide
  XENP020880 vhCDR3
DRPDGRAMDY

SEQ ID NO: 21289 - protein, 213 aa, Artificial Sequence; identical to SEQ ID NO: 21050
  Description of Artificial Sequence: Synthetic polypeptide
  XENP020880 9C6_H1.9_L1_anti-BTLA_IgG1_PVA_/S267K Light Chain

SEQ ID NO: 21290 - protein, 106 aa, Artificial Sequence; identical to SEQ ID NO: 21051
  Description of Artificial Sequence: Synthetic polypeptide
  VL of XENP020880

SEQ ID NO: 21291 - protein, 11 aa, Artificial Sequence
  Description of Artificial Sequence: Synthetic peptide
  XENP020880 vlCDR1
KASQSVSNDVA

SEQ ID NO: 21292 - protein, 7 aa, Artificial Sequence
  Description of Artificial Sequence: Synthetic peptide
  XENP020880 vlCDR2
YASNRYT

SEQ ID NO: 21293 - protein, 8 aa, Artificial Sequence
  Description of Artificial Sequence: Synthetic peptide
  XENP020880 vlCDR3
QQDYSSPT

SEQ ID NO: 21294 - protein, 447 aa, Artificial Sequence
  Description of Artificial Sequence: Synthetic polypeptide
  XENP020881 9C6_H1.10_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFKGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21295 - protein, 118 aa, Artificial Sequence
  Description of Artificial Sequence: Synthetic polypeptide
  VH of XENP020881
QVQLVQSGAEVKKPGASVKVSCKVSGFSLTGYGVNWVRQAPGQGLEWMGMIWIDGSTDYNSKFKGRVTMTKDNSKSTVYMELSSLRSEDTAVYYCARDRPDGRAMDYWGQGTMVTVSS

SEQ ID NO: 21296 - protein, 5 aa, Artificial Sequence
  Description of Artificial Sequence: Synthetic peptide
  XENP020881 vhCDR1
GYGVN

SEQ ID NO: 21297 - protein, 16 aa, Artificial Sequence
  Description of Artificial Sequence: Synthetic peptide
  XENP020881 vhCDR2
MIWIDGSTDYNSKFKG

SEQ ID NO: 21298 - protein, 10 aa, Artificial Sequence
  Description of Artificial Sequence: Synthetic peptide
  XENP020881 vhCDR3
DRPDGRAMDY

SEQ ID NO: 21299 - protein, 213 aa, Artificial Sequence; identical to SEQ ID NO: 21050
  Description of Artificial Sequence: Synthetic polypeptide
  XENP020881 9C6_H1.10_L1_anti-BTLA_IgG1_PVA_/S267K Light Chain

SEQ ID NO: 21300 - protein, 106 aa, Artificial Sequence; identical to SEQ ID NO: 21051
  Description of Artificial Sequence: Synthetic polypeptide
  VL of XENP020881

SEQ ID NO: 21301 - protein, 11 aa, Artificial Sequence
  Description of Artificial Sequence: Synthetic peptide
  XENP020881 vlCDR1
KASQSVSNDVA

SEQ ID NO: 21302 - protein, 7 aa, Artificial Sequence
  Description of Artificial Sequence: Synthetic peptide
  XENP020881 vlCDR2
YASNRYT

SEQ ID NO: 21303 - protein, 8 aa, Artificial Sequence
  Description of Artificial Sequence: Synthetic peptide
  XENP020881 vlCDR3
QQDYSSPT

SEQ ID NO: 21304 - protein, 447 aa, Artificial Sequence
  Description of Artificial Sequence: Synthetic polypeptide
  XENP020882 9C6_H1.11_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRLSINKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21305 - protein, 118 aa, Artificial Sequence
  Description of Artificial Sequence: Synthetic polypeptide
  VH of XENP020882
QVQLVQSGAEVKKPGASVKVSCKVSGFSLTGYGVNWVRQAPGQGLEWMGMIWIDGSTDYNSKFQGRLSINKDNSKSTVYMELSSLRSEDTAVYYCARDRPDGRAMDYWGQGTMVTVSS

SEQ ID NO: 21306 - protein, 5 aa, Artificial Sequence
  Description of Artificial Sequence: Synthetic peptide
  XENP020882 vhCDR1
GYGVN

SEQ ID NO: 21307 - protein, 16 aa, Artificial Sequence
  Description of Artificial Sequence: Synthetic peptide
  XENP020882 vhCDR2
MIWIDGSTDYNSKFQG

SEQ ID NO: 21308 - protein, 10 aa, Artificial Sequence
  Description of Artificial Sequence: Synthetic peptide
  XENP020882 vhCDR3
DRPDGRAMDY

SEQ ID NO: 21309 - protein, 213 aa, Artificial Sequence; identical to SEQ ID NO: 21050
  Description of Artificial Sequence: Synthetic polypeptide
  XENP020882 9C6_H1.11_L1_anti-BTLA_IgG1_PVA_/S267K Light Chain

SEQ ID NO: 21310 - protein, 106 aa, Artificial Sequence; identical to SEQ ID NO: 21051
  Description of Artificial Sequence: Synthetic polypeptide
  VL of XENP020882

SEQ ID NO: 21311 - protein, 11 aa, Artificial Sequence
  Description of Artificial Sequence: Synthetic peptide
  XENP020882 vlCDR1
KASQSVSNDVA

SEQ ID NO: 21312 - protein, 7 aa, Artificial Sequence
  Description of Artificial Sequence: Synthetic peptide
  XENP020882 vlCDR2
YASNRYT

SEQ ID NO: 21313 - protein, 8 aa, Artificial Sequence
  Description of Artificial Sequence: Synthetic peptide
  XENP020882 vlCDR3
QQDYSSPT

SEQ ID NO: 21314 - protein, 447 aa, Artificial Sequence
  Description of Artificial Sequence: Synthetic polypeptide
  XENP020883 9C6_H1.12_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSQVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21315 - protein, 118 aa, Artificial Sequence
  Description of Artificial Sequence: Synthetic polypeptide
  VH of XENP020883
QVQLVQSGAEVKKPGASVKVSCKVSGFSLTGYGVNWVRQAPGQGLEWMGMIWIDGSTDYNSKFQGRVTMTKDNSKSQVYMELSSLRSEDTAVYYCARDRPDGRAMDYWGQGTMVTVSS

SEQ ID NO: 21316 - protein, 5 aa, Artificial Sequence
  Description of Artificial Sequence: Synthetic peptide
  XENP020883 vhCDR1
GYGVN

SEQ ID NO: 21317 - protein, 16 aa, Artificial Sequence
  Description of Artificial Sequence: Synthetic peptide
  XENP020883 vhCDR2
MIWIDGSTDYNSKFQG

SEQ ID NO: 21318 - protein, 10 aa, Artificial Sequence
  Description of Artificial Sequence: Synthetic peptide
  XENP020883 vhCDR3
DRPDGRAMDY

SEQ ID NO: 21319 - protein, 213 aa, Artificial Sequence; identical to SEQ ID NO: 21050
  Description of Artificial Sequence: Synthetic polypeptide
  XENP020883 9C6_H1.12_L1_anti-BTLA_IgG1_PVA_/S267K Light Chain

SEQ ID NO: 21320 - protein, 106 aa, Artificial Sequence; identical to SEQ ID NO: 21051
  Description of Artificial Sequence: Synthetic polypeptide
  VL of XENP020883

SEQ ID NO: 21321 - protein, 11 aa, Artificial Sequence
  Description of Artificial Sequence: Synthetic peptide
  XENP020883 vlCDR1
KASQSVSNDVA

SEQ ID NO: 21322 - protein, 7 aa, Artificial Sequence
  Description of Artificial Sequence: Synthetic peptide
  XENP020883 vlCDR2
YASNRYT

SEQ ID NO: 21323 - protein, 8 aa, Artificial Sequence
  Description of Artificial Sequence: Synthetic peptide
  XENP020883 vlCDR3
QQDYSSPT

SEQ ID NO: 21324 - protein, 447 aa, Artificial Sequence
  Description of Artificial Sequence: Synthetic polypeptide
  XENP020884 9C6_H1.13_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVFLKMNSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21325 - protein, 118 aa, Artificial Sequence
  Description of Artificial Sequence: Synthetic polypeptide
  VH of XENP020884
QVQLVQSGAEVKKPGASVKVSCKVSGFSLTGYGVNWVRQAPGQGLEWMGMIWIDGSTDYNSKFQGRVTMTKDNSKSTVFLKMNSLRSEDTAVYYCARDRPDGRAMDYWGQGTMVTVSS

SEQ ID NO: 21326 - protein, 5 aa, Artificial Sequence
  Description of Artificial Sequence: Synthetic peptide
  XENP020884 vhCDR1
GYGVN

SEQ ID NO: 21327 - protein, 16 aa, Artificial Sequence
  Description of Artificial Sequence: Synthetic peptide
  XENP020884 vhCDR2
MIWIDGSTDYNSKFQG

SEQ ID NO: 21328 - protein, 10 aa, Artificial Sequence
  Description of Artificial Sequence: Synthetic peptide
  XENP020884 vhCDR3
DRPDGRAMDY

SEQ ID NO: 21329 - protein, 213 aa, Artificial Sequence; identical to SEQ ID NO: 21050
  Description of Artificial Sequence: Synthetic polypeptide
  XENP020884 9C6_H1.13_L1_anti-BTLA_IgG1_PVA_/S267K Light Chain

SEQ ID NO: 21330 - protein, 106 aa, Artificial Sequence; identical to SEQ ID NO: 21051
  Description of Artificial Sequence: Synthetic polypeptide
  VL of XENP020884

SEQ ID NO: 21331 - protein, 11 aa, Artificial Sequence
  Description of Artificial Sequence: Synthetic peptide
  XENP020884 vlCDR1
KASQSVSNDVA

SEQ ID NO: 21332 - protein, 7 aa, Artificial Sequence
  Description of Artificial Sequence: Synthetic peptide
  XENP020884 vlCDR2
YASNRYT

SEQ ID NO: 21333 - protein, 8 aa, Artificial Sequence
  Description of Artificial Sequence: Synthetic peptide
  XENP020884 vlCDR3
QQDYSSPT

SEQ ID NO: 21334 - protein, 447 aa, Artificial Sequence
  Description of Artificial Sequence: Synthetic polypeptide
  XENP020885 9C6_H1.14_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLQTDDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21335 - protein, 118 aa, Artificial Sequence
  Description of Artificial Sequence: Synthetic polypeptide
  VH of XENP020885
QVQLVQSGAEVKKPGASVKVSCKVSGFSLTGYGVNWVRQAPGQGLEWMGMIWIDGSTDYNSKFQGRVTMTKDNSKSTVYMELSSLQTDDTAVYYCARDRPDGRAMDYWGQGTMVTVSS

SEQ ID NO: 21336 - protein, 5 aa, Artificial Sequence
  Description of Artificial Sequence: Synthetic peptide
  XENP020885 vhCDR1
GYGVN

SEQ ID NO: 21337 - protein, 16 aa, Artificial Sequence
  Description of Artificial Sequence: Synthetic peptide
  XENP020885 vhCDR2
MIWIDGSTDYNSKFQG

SEQ ID NO: 21338 - protein, 10 aa, Artificial Sequence
  Description of Artificial Sequence: Synthetic peptide
  XENP020885 vhCDR3
DRPDGRAMDY

SEQ ID NO: 21339 - protein, 213 aa, Artificial Sequence; identical to SEQ ID NO: 21050
  Description of Artificial Sequence: Synthetic polypeptide
  XENP020885 9C6_H1.14_L1_anti-BTLA_IgG1_PVA_/S267K Light Chain

SEQ ID NO: 21340 - protein, 106 aa, Artificial Sequence; identical to SEQ ID NO: 21051
  Description of Artificial Sequence: Synthetic polypeptide
  VL of XENP020885

SEQ ID NO: 21341 - protein, 11 aa, Artificial Sequence
  Description of Artificial Sequence: Synthetic peptide
  XENP020885 vlCDR1
KASQSVSNDVA

SEQ ID NO: 21342 - protein, 7 aa, Artificial Sequence
  Description of Artificial Sequence: Synthetic peptide
  XENP020885 vlCDR2
YASNRYT

SEQ ID NO: 21343 - protein, 8 aa, Artificial Sequence
  Description of Artificial Sequence: Synthetic peptide
  XENP020885 vlCDR3
QQDYSSPT

SEQ ID NO: 21344 - protein, 447 aa, Artificial Sequence
  Description of Artificial Sequence: Synthetic polypeptide
  XENP020886 9C6_H1.15_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTARYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21345 - protein, 118 aa, Artificial Sequence
  Description of Artificial Sequence: Synthetic polypeptide
  VH of XENP020886
QVQLVQSGAEVKKPGASVKVSCKVSGFSLTGYGVNWVRQAPGQGLEWMGMIWIDGSTDYNSKFQGRVTMTKDNSKSTVYMELSSLRSEDTARYYCARDRPDGRAMDYWGQGTMVTVSS

SEQ ID NO: 21346 - protein, 5 aa, Artificial Sequence
  Description of Artificial Sequence: Synthetic peptide
  XENP020886 vhCDR1
GYGVN

SEQ ID NO: 21347 - protein, 16 aa, Artificial Sequence
  Description of Artificial Sequence: Synthetic peptide
  XENP020886 vhCDR2
MIWIDGSTDYNSKFQG

SEQ ID NO: 21348 - protein, 10 aa, Artificial Sequence
  Description of Artificial Sequence: Synthetic peptide
  XENP020886 vhCDR3
DRPDGRAMDY

SEQ ID NO: 21349 - protein, 213 aa, Artificial Sequence; identical to SEQ ID NO: 21050
  Description of Artificial Sequence: Synthetic polypeptide
  XENP020886 9C6_H1.15_L1_anti-BTLA_IgG1_PVA_/S267K Light Chain

SEQ ID NO: 21350 - protein, 106 aa, Artificial Sequence; identical to SEQ ID NO: 21051
  Description of Artificial Sequence: Synthetic polypeptide
  VL of XENP020886

SEQ ID NO: 21351 - protein, 11 aa, Artificial Sequence
  Description of Artificial Sequence: Synthetic peptide
  XENP020886 vlCDR1
KASQSVSNDVA

SEQ ID NO: 21352 - protein, 7 aa, Artificial Sequence
  Description of Artificial Sequence: Synthetic peptide
  XENP020886 vlCDR2
YASNRYT

SEQ ID NO: 21353 - protein, 8 aa, Artificial Sequence
  Description of Artificial Sequence: Synthetic peptide
  XENP020886 vlCDR3
QQDYSSPT

SEQ ID NO: 21354 - protein, 447 aa, Artificial Sequence
  Description of Artificial Sequence: Synthetic polypeptide
  XENP020887 9C6_H1.16_L1_anti-BTLA_IgG1_PVA_/S267K Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21355 - protein, 118 aa, Artificial Sequence
  Description of Artificial Sequence: Synthetic polypeptide
  VH of XENP020887
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTSVTVSS

SEQ ID NO: 21356 - protein, 5 aa, Artificial Sequence
  Description of Artificial Sequence: Synthetic peptide
  XENP020887 vhCDR1
GYGVN

SEQ ID NO: 21357 - protein, 16 aa, Artificial Sequence
  Description of Artificial Sequence: Synthetic peptide
  XENP020887 vhCDR2
MIWIDGSTDYNSKFQG

SEQ ID NO: 21358 - protein, 10 aa, Artificial Sequence
  Description of Artificial Sequence: Synthetic peptide
  XENP020887 vhCDR3
DRPDGRAMDY

SEQ ID NO: 21359 - protein, 213 aa, Artificial Sequence; identical to SEQ ID NO: 21050
  Description of Artificial Sequence: Synthetic polypeptide
  XENP020887 9C6_H1.16_L1_anti-BTLA_IgG1_PVA_/S267K Light Chain

SEQ ID NO: 21360 - protein, 106 aa, Artificial Sequence; identical to SEQ ID NO: 21051
  Description of Artificial Sequence: Synthetic polypeptide
  VL of XENP020887

SEQ ID NO: 21361 - protein, 11 aa, Artificial Sequence
  Description of Artificial Sequence: Synthetic peptide
  XENP020887 vlCDR1
KASQSVSNDVA

SEQ ID NO: 21362 - protein, 7 aa, Artificial Sequence
  Description of Artificial Sequence: Synthetic peptide
  XENP020887 vlCDR2
YASNRYT

SEQ ID NO: 21363 - protein, 8 aa, Artificial Sequence
  Description of Artificial Sequence: Synthetic peptide
  XENP020887 vlCDR3
QQDYSSPT

SEQ ID NO: 21364 - protein, 447 aa, Artificial Sequence; identical to SEQ ID NO: 21065
  Description of Artificial Sequence: Synthetic polypeptide
  XENP020888 9C6_H1_L1.1_anti-BTLA_IgG1_PVA_/S267K Heavy Chain

SEQ ID NO: 21365 - protein, 118 aa, Artificial Sequence; identical to SEQ ID NO: 21066
  Description of Artificial Sequence: Synthetic polypeptide
  VH of XENP020888

SEQ ID NO: 21366 - protein, 5 aa, Artificial Sequence
  Description of Artificial Sequence: Synthetic peptide
  XENP020888 vhCDR1
GYGVN

SEQ ID NO: 21367 - protein, 16 aa, Artificial Sequence
  Description of Artificial Sequence: Synthetic peptide
  XENP020888 vhCDR2
MIWIDGSTDYNSKFQG

SEQ ID NO: 21368 - protein, 10 aa, Artificial Sequence
  Description of Artificial Sequence: Synthetic peptide
  XENP020888 vhCDR3
DRPDGRAMDY

SEQ ID NO: 21369 - protein, 213 aa, Artificial Sequence
  Description of Artificial Sequence: Synthetic polypeptide
  XENP020888 9C6_H1_L1.1_anti-BTLA_IgG1_PVA_/S267K Light Chain
SIVMTQTPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21370 - protein, 106 aa, Artificial Sequence
  Description of Artificial Sequence: Synthetic polypeptide
  VL of XENP020888
SIVMTQTPDSLAVSLGERATINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 21371 - protein, 11 aa, Artificial Sequence
  Description of Artificial Sequence: Synthetic peptide
  XENP020888 vlCDR1
KASQSVSNDVA

SEQ ID NO: 21372 - protein, 7 aa, Artificial Sequence
  Description of Artificial Sequence: Synthetic peptide
  XENP020888 vlCDR2
YASNRYT

SEQ ID NO: 21373 - protein, 8 aa, Artificial Sequence
  Description of Artificial Sequence: Synthetic peptide
  XENP020888 vlCDR3
QQDYSSPT

SEQ ID NO: 21374 - protein, 447 aa, Artificial Sequence; identical to SEQ ID NO: 21065
  Description of Artificial Sequence: Synthetic polypeptide
  XENP020889 9C6_H1_L1.2_anti-BTLA_IgG1_PVA_/S267K Heavy Chain

SEQ ID NO: 21375 - protein, 118 aa, Artificial Sequence; identical to SEQ ID NO: 21066
  Description of Artificial Sequence: Synthetic polypeptide
  VH of XENP020889

SEQ ID NO: 21376 - protein, 5 aa, Artificial Sequence
  Description of Artificial Sequence: Synthetic peptide
  XENP020889 vhCDR1
GYGVN

SEQ ID NO: 21377 - protein, 16 aa, Artificial Sequence
  Description of Artificial Sequence: Synthetic peptide
  XENP020889 vhCDR2
MIWIDGSTDYNSKFQG

SEQ ID NO: 21378 - protein, 10 aa, Artificial Sequence
  Description of Artificial Sequence: Synthetic peptide
  XENP020889 vhCDR3
DRPDGRAMDY

SEQ ID NO: 21379 - protein, 213 aa, Artificial Sequence
  Description of Artificial Sequence: Synthetic polypeptide
  XENP020889 9C6_H1_L1.2_anti-BTLA_IgG1_PVA_/S267K Light Chain
SIVMTQTPKFLLVSLGERATINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21380 - protein, 106 aa, Artificial Sequence
  Description of Artificial Sequence: Synthetic polypeptide
  VL of XENP020889
SIVMTQTPKFLLVSLGERATINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 21381 - protein, 11 aa, Artificial Sequence
  Description of Artificial Sequence: Synthetic peptide
  XENP020889 vlCDR1
KASQSVSNDVA

SEQ ID NO: 21382 - protein, 7 aa, Artificial Sequence
  Description of Artificial Sequence: Synthetic peptide
  XENP020889 vlCDR2
YASNRYT

SEQ ID NO: 21383 - protein, 8 aa, Artificial Sequence
  Description of Artificial Sequence: Synthetic peptide
  XENP020889 vlCDR3
QQDYSSPT

SEQ ID NO: 21384 - protein, 447 aa, Artificial Sequence; identical to SEQ ID NO: 21065
  Description of Artificial Sequence: Synthetic polypeptide
  XENP020890 9C6_H1_L1.3_anti-BTLA_IgG1_PVA_/S267K Heavy Chain

SEQ ID NO: 21385 - protein, 118 aa, Artificial Sequence; identical to SEQ ID NO: 21066
  Description of Artificial Sequence: Synthetic polypeptide
  VH of XENP020890

SEQ ID NO: 21386 - protein, 5 aa, Artificial Sequence
  Description of Artificial Sequence: Synthetic peptide
  XENP020890 vhCDR1
GYGVN

SEQ ID NO: 21387 - protein, 16 aa, Artificial Sequence
  Description of Artificial Sequence: Synthetic peptide
  XENP020890 vhCDR2
MIWIDGSTDYNSKFQG

SEQ ID NO: 21388 - protein, 10 aa, Artificial Sequence
  Description of Artificial Sequence: Synthetic peptide
  XENP020890 vhCDR3
DRPDGRAMDY

SEQ ID NO: 21389 - protein, 213 aa, Artificial Sequence
  Description of Artificial Sequence: Synthetic polypeptide
  XENP020890 9C6_H1_L1.3_anti-BTLA_IgG1_PVA_/S267K Light Chain
SIVMTQSPDSLAVSAGDRVTINCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21390 - protein, 106 aa, Artificial Sequence
  Description of Artificial Sequence: Synthetic polypeptide
  VL of XENP020890
SIVMTQSPDSLAVSAGDRVTINCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 21391 - protein, 11 aa, Artificial Sequence
  Description of Artificial Sequence: Synthetic peptide
  XENP020890 vlCDR1
KASQSVSNDVA

SEQ ID NO: 21392 - protein, 7 aa, Artificial Sequence
  Description of Artificial Sequence: Synthetic peptide
  XENP020890 vlCDR2
YASNRYT

SEQ ID NO: 21393 - protein, 8 aa, Artificial Sequence
  Description of Artificial Sequence: Synthetic peptide
  XENP020890 vlCDR3
QQDYSSPT

SEQ ID NO: 21394 - protein, 447 aa, Artificial Sequence; identical to SEQ ID NO: 21065
  Description of Artificial Sequence: Synthetic polypeptide
  XENP020891 9C6_H1_L1.4_anti-BTLA_IgG1_PVA_/S267K Heavy Chain

SEQ ID NO: 21395 - protein, 118 aa, Artificial Sequence; identical to SEQ ID NO: 21066
  Description of Artificial Sequence: Synthetic polypeptide
  VH of XENP020891

SEQ ID NO: 21396 - protein, 5 aa, Artificial Sequence
  Description of Artificial Sequence: Synthetic peptide
  XENP020891 vhCDR1
GYGVN

SEQ ID NO: 21397 - protein, 16 aa, Artificial Sequence
  Description of Artificial Sequence: Synthetic peptide
  XENP020891 vhCDR2
MIWIDGSTDYNSKFQG

SEQ ID NO: 21398 - protein, 10 aa, Artificial Sequence
  Description of Artificial Sequence: Synthetic peptide
  XENP020891 vhCDR3
DRPDGRAMDY

SEQ ID NO: 21399 - protein, 213 aa, Artificial Sequence
  Description of Artificial Sequence: Synthetic polypeptide
  XENP020891 9C6_H1_L1.4_anti-BTLA_IgG1_PVA_/S267K Light Chain
SIVMTQSPDSLAVSLGERATITCKASQSVSNDVAWYQQKPGQSPKLLIYYASNRYTGVPDRFTGSGYGTDFTLTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21400 - protein, 106 aa, Artificial Sequence
  Description of Artificial Sequence: Synthetic polypeptide
  VL of XENP020891
SIVMTQSPDSLAVSLGERATITCKASQSVSNDVAWYQQKPGQSPKLLIYYASNRYTGVPDRFTGSGYGTDFTLTISSLQAEDVAVYFCQQDYSSPTFGGGTKLEIK

SEQ ID NO: 21401 - protein, 11 aa, Artificial Sequence
  Description of Artificial Sequence: Synthetic peptide
  XENP020891 vlCDR1
KASQSVSNDVA

SEQ ID NO: 21402 - protein, 7 aa, Artificial Sequence
  Description of Artificial Sequence: Synthetic peptide
  XENP020891 vlCDR2
YASNRYT

SEQ ID NO: 21403 - protein, 8 aa, Artificial Sequence
  Description of Artificial Sequence: Synthetic peptide
  XENP020891 vlCDR3
QQDYSSPT

SEQ ID NO: 21404 - protein, 447 aa, Artificial Sequence; identical to SEQ ID NO: 21065
  Description of Artificial Sequence: Synthetic polypeptide
  XENP020892 9C6_H1_L1.5_anti-BTLA_IgG1_PVA_/S267K Heavy Chain

SEQ ID NO: 21405 - protein, 118 aa, Artificial Sequence; identical to SEQ ID NO: 21066
  Description of Artificial Sequence: Synthetic polypeptide
  VH of XENP020892

SEQ ID NO: 21406 - protein, 5 aa, Artificial Sequence
  Description of Artificial Sequence: Synthetic peptide
  XENP020892 vhCDR1
GYGVN

SEQ ID NO: 21407 - protein, 16 aa, Artificial Sequence
  Description of Artificial Sequence: Synthetic peptide
  XENP020892 vhCDR2
MIWIDGSTDYNSKFQG

SEQ ID NO: 21408 - protein, 10 aa, Artificial Sequence
  Description of Artificial Sequence: Synthetic peptide
  XENP020892 vhCDR3
DRPDGRAMDY

SEQ ID NO: 21409 - protein, 213 aa, Artificial Sequence
  Description of Artificial Sequence: Synthetic polypeptide
  XENP020892 9C6_H1_L1.5_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTFTISSLQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21410 - protein, 106 aa, Artificial Sequence
  Description of Artificial Sequence: Synthetic polypeptide
  VL of XENP020892
SIVMTQSPDSLAVSLGERATINCKASQSVSNDVAWYQQKPGQSPKLLIYYASNRYTGVPDRFTGSGYGTDFTFTISSLQAEDVAVYFCQQDYSSPTFGGGTKLEIK

SEQ ID NO: 21411 - protein, 11 aa, Artificial Sequence
  Description of Artificial Sequence: Synthetic peptide
  XENP020892 vlCDR1
KASQSVSNDVA

SEQ ID NO: 21412 - protein, 7 aa, Artificial Sequence
  Description of Artificial Sequence: Synthetic peptide
  XENP020892 vlCDR2
YASNRYT

SEQ ID NO: 21413 - protein, 8 aa, Artificial Sequence
  Description of Artificial Sequence: Synthetic peptide
  XENP020892 vlCDR3
QQDYSSPT

SEQ ID NO: 21414 - protein, 447 aa, Artificial Sequence; identical to SEQ ID NO: 21065
  Description of Artificial Sequence: Synthetic polypeptide
  XENP020893 9C6_H1_L1.6_anti-BTLA_IgG1_PVA_/S267K Heavy Chain

SEQ ID NO: 21415 - protein, 118 aa, Artificial Sequence; identical to SEQ ID NO: 21066
  Description of Artificial Sequence: Synthetic polypeptide
  VH of XENP020893

SEQ ID NO: 21416 - protein, 5 aa, Artificial Sequence
  Description of Artificial Sequence: Synthetic peptide
  XENP020893 vhCDR1
GYGVN

SEQ ID NO: 21417 - protein, 16 aa, Artificial Sequence
  Description of Artificial Sequence: Synthetic peptide
  XENP020893 vhCDR2
MIWIDGSTDYNSKFQG

SEQ ID NO: 21418 - protein, 10 aa, Artificial Sequence
  Description of Artificial Sequence: Synthetic peptide
  XENP020893 vhCDR3
DRPDGRAMDY

SEQ ID NO: 21419 - protein, 213 aa, Artificial Sequence
  Description of Artificial Sequence: Synthetic polypeptide
  XENP020893 9C6_H1_L1.6_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTLTISTVQAEDVAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21420 - protein, 106 aa, Artificial Sequence
  Description of Artificial Sequence: Synthetic polypeptide
  VL of XENP020893
SIVMTQSPDSLAVSLGERATINCKASQSVSNDVAWYQQKPGQSPKLLIYYASNRYTGVPDRFTGSGYGTDFTLTISTVQAEDVAVYFCQQDYSSPTFGGGTKLEIK

SEQ ID NO: 21421 - protein, 11 aa, Artificial Sequence
  Description of Artificial Sequence: Synthetic peptide
  XENP020893 vlCDR1
KASQSVSNDVA

SEQ ID NO: 21422 - protein, 7 aa, Artificial Sequence
  Description of Artificial Sequence: Synthetic peptide
  XENP020893 vlCDR2
YASNRYT

SEQ ID NO: 21423 - protein, 8 aa, Artificial Sequence
  Description of Artificial Sequence: Synthetic peptide
  XENP020893 vlCDR3
QQDYSSPT

SEQ ID NO: 21424 - protein, 447 aa, Artificial Sequence; identical to SEQ ID NO: 21065
  Description of Artificial Sequence: Synthetic polypeptide
  XENP020894 9C6_H1_L1.7_anti-BTLA_IgG1_PVA_/S267K Heavy Chain

SEQ ID NO: 21425 - protein, 118 aa, Artificial Sequence; identical to SEQ ID NO: 21066
  Description of Artificial Sequence: Synthetic polypeptide
  VH of XENP020894

SEQ ID NO: 21426 - protein, 5 aa, Artificial Sequence
  Description of Artificial Sequence: Synthetic peptide
  XENP020894 vhCDR1
GYGVN

SEQ ID NO: 21427 - protein, 16 aa, Artificial Sequence
  Description of Artificial Sequence: Synthetic peptide
  XENP020894 vhCDR2
MIWIDGSTDYNSKFQG

SEQ ID NO: 21428 - protein, 10 aa, Artificial Sequence
  Description of Artificial Sequence: Synthetic peptide
  XENP020894 vhCDR3
DRPDGRAMDY

SEQ ID NO: 21429 - protein, 213 aa, Artificial Sequence
  Description of Artificial Sequence: Synthetic polypeptide
  XENP020894 9C6_H1_L1.7_anti-BTLA_IgG1_PVA_/S267K Light Chain
SIVMTQSPDSLAVSLGERATINCKASQSVSNDVAWYQQKPGQSPKLLIYYASNRYTGVPDRFTGSGYGTDFTLTISSLQAEDLAVYFCQQDYSSPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21430 - protein, 106 aa, Artificial Sequence
  Description of Artificial Sequence: Synthetic polypeptide
  VL of XENP020894
SIVMTQSPDSLAVSLGERATINCKASQSVSNDVAWYQQKPGQSPKLLIYYASNRYTGVPDRFTGSGYGTDFTLTISSLQAEDLAVYFCQQDYSSPTFGGGTKLEIK

SEQ ID NO: 21431 - protein, 11 aa, Artificial Sequence
  Description of Artificial Sequence: Synthetic peptide
  XENP020894 vlCDR1
KASQSVSNDVA

SEQ ID NO: 21432 - protein, 7 aa, Artificial Sequence
  Description of Artificial Sequence: Synthetic peptide
  XENP020894 vlCDR2
YASNRYT

SEQ ID NO: 21433 - protein, 8 aa, Artificial Sequence
  Description of Artificial Sequence: Synthetic peptide
  XENP020894 vlCDR3
QQDYSSPT

SEQ ID NO: 21434 - protein, 449 aa, Artificial Sequence
  Description of Artificial Sequence: Synthetic polypeptide
  XENP021208 3F6_H1L0_anti-BTLA_IgG1_PVA_/S267K Heavy Chain
QVQLQESGPGLVKPSQTLSLTCTVSGDSITSGYWNWIRKPPGKKLEYIGYLSYSGSTYYNPSLKSRVTISRDTSKNQYSLKLSSVTAADTAVYYCARYFYGSYYEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21435 - protein, 120 aa, Artificial Sequence
  Description of Artificial Sequence: Synthetic polypeptide
  VH of XENP021208
QVQLQESGPGLVKPSQTLSLTCTVSGDSITSGYWNWIRKPPGKKLEYIGYLSYSGSTYYNPSLKSRVTISRDTSKNQYSLKLSSVTAADTAVYYCARYFYGSYYEAMDYWGQGTTVTVSS

SEQ ID NO: 21436 - protein, 5 aa, Artificial Sequence
  Description of Artificial Sequence: Synthetic peptide
  XENP021208 vhCDR1
SGYWN

SEQ ID NO: 21437 - protein, 16 aa, Artificial Sequence
  Description of Artificial Sequence: Synthetic peptide
  XENP021208 vhCDR2
YLSYSGSTYYNPSLKS

SEQ ID NO: 21438 - protein, 12 aa, Artificial Sequence
  Description of Artificial Sequence: Synthetic peptide
  XENP021208 vhCDR3
YFYGSYYEAMDY

SEQ ID NO: 21439 - protein, 214 aa, Artificial Sequence; identical to SEQ ID NO: 20920
  Description of Artificial Sequence: Synthetic polypeptide
  XENP021208 3F6_H1L0_anti-BTLA_IgG1_PVA_/S267K Light Chain

SEQ ID NO: 21440 - protein, 107 aa, Artificial Sequence; identical to SEQ ID NO: 20921
  Description of Artificial Sequence: Synthetic polypeptide
  VL of XENP021208

SEQ ID NO: 21441 - protein, 11 aa, Artificial Sequence
  Description of Artificial Sequence: Synthetic peptide
  XENP021208 vlCDR1
RASKSISKYLA

SEQ ID NO: 21442 - protein, 7 aa, Artificial Sequence
  Description of Artificial Sequence: Synthetic peptide
  XENP021208 vlCDR2
SGSTLQS

SEQ ID NO: 21443 - protein, 9 aa, Artificial Sequence
  Description of Artificial Sequence: Synthetic peptide
  XENP021208 vlCDR3
QQHNEYPWT

SEQ ID NO: 21444 - protein, 449 aa, Artificial Sequence; identical to SEQ ID NO: 21434
  Description of Artificial Sequence: Synthetic polypeptide
  XENP021209 3F6_H1L1_anti-BTLA_IgG1_PVA_/S267K Heavy Chain

SEQ ID NO: 21445 - protein, 120 aa, Artificial Sequence; identical to SEQ ID NO: 21435
  Description of Artificial Sequence: Synthetic polypeptide
  VH of XENP021209

SEQ ID NO: 21446 - protein, 5 aa, Artificial Sequence
  Description of Artificial Sequence: Synthetic peptide
  XENP021209 vhCDR1
SGYWN

SEQ ID NO: 21447 - protein, 16 aa, Artificial Sequence
  Description of Artificial Sequence: Synthetic peptide
  XENP021209 vhCDR2
YLSYSGSTYYNPSLKS

SEQ ID NO: 21448 - protein, 12 aa, Artificial Sequence
  Description of Artificial Sequence: Synthetic peptide
  XENP021209 vhCDR3
YFYGSYYEAMDY

SEQ ID NO: 21449 - protein, 214 aa, Artificial Sequence
  Description of Artificial Sequence: Synthetic polypeptide
  XENP021209 3F6_H1L1_anti-BTLA_IgG1_PVA_/S267K Light Chain
DVQITQSPSFLSASVGDRVTITCRASKSISKYLAWYQEKPGKTNKLLIYSGSTLQSGIPSRFSGSGSGTEFTLTISSLQPEDFATYYCQQHNEYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21450 - protein, 107 aa, Artificial Sequence
  Description of Artificial Sequence: Synthetic polypeptide
  VL of XENP021209
DVQITQSPSFLSASVGDRVTITCRASKSISKYLAWYQEKPGKTNKLLIYSGSTLQSGIPSRFSGSGSGTEFTLTISSLQPEDFATYYCQQHNEYPWTFGGGTKVEIK

SEQ ID NO: 21451 - protein, 11 aa, Artificial Sequence
  Description of Artificial Sequence: Synthetic peptide
  XENP021209 vlCDR1
RASKSISKYLA

SEQ ID NO: 21452 - protein, 7 aa, Artificial Sequence
  Description of Artificial Sequence: Synthetic peptide
  XENP021209 vlCDR2
SGSTLQS

SEQ ID NO: 21453 - protein, 9 aa, Artificial Sequence
  Description of Artificial Sequence: Synthetic peptide
  XENP021209 vlCDR3
QQHNEYPWT

SEQ ID NO: 21454 - protein, 448 aa, Artificial Sequence; identical to SEQ ID NO: 20925
  Description of Artificial Sequence: Synthetic polypeptide
  XENP021210 1A9_H0L1_anti-BTLA_IgG1_PVA_/S267K Heavy Chain

SEQ ID NO: 21455 - protein, 119 aa, Artificial Sequence; identical to SEQ ID NO: 20926
  Description of Artificial Sequence: Synthetic polypeptide
  VH of XENP021210

SEQ ID NO: 21456 - protein, 5 aa, Artificial Sequence
  Description of Artificial Sequence: Synthetic peptide
  XENP021210 vhCDR1
SFGMH

SEQ ID NO: 21457 - protein, 17 aa, Artificial Sequence
  Description of Artificial Sequence: Synthetic peptide
  XENP021210 vhCDR2
YISSGISTIYYADTVKG

SEQ ID NO: 21458 - protein, 10 aa, Artificial Sequence
  Description of Artificial Sequence: Synthetic peptide
  XENP021210 vhCDR3
DWLRGYAMDY

SEQ ID NO: 21459 - protein, 218 aa, Artificial Sequence
  Description of Artificial Sequence: Synthetic polypeptide
  XENP021210 1A9_H0L1_anti-BTLA_IgG1_PVA_/S267K Light Chain
DIVLTQSPSSLSASVGDRVTITCRASQSIDYDGDSYMNWYQQKPGKPPKLLIYAASNLDFGIPARFSGSGSGTDFTLTISSLQPEDFATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21460 - protein, 111 aa, Artificial Sequence
  Description of Artificial Sequence: Synthetic polypeptide
  VL of XENP021210
DIVLTQSPSSLSASVGDRVTITCRASQSIDYDGDSYMNWYQQKPGKPPKLLIYAASNLDFGIPARFSGSGSGTDFTLTISSLQPEDFATYYCQQSNEDPWTFGGGTKVEIK

SEQ ID NO: 21461 - protein, 15 aa, Artificial Sequence
  Description of Artificial Sequence: Synthetic peptide
  XENP021210 vlCDR1
RASQSIDYDGDSYMN

SEQ ID NO: 21462 - protein, 7 aa, Artificial Sequence
  Description of Artificial Sequence: Synthetic peptide
  XENP021210 vlCDR2
AASNLDF

SEQ ID NO: 21463 - protein, 9 aa, Artificial Sequence
  Description of Artificial Sequence: Synthetic peptide
  XENP021210 vlCDR3
QQSNEDPWT

SEQ ID NO: 21464 - protein, 448 aa, Artificial Sequence
  Description of Artificial Sequence: Synthetic polypeptide
  XENP021211 1A9_H1L0_anti-BTLA_IgG1_PVA_/S267K Heavy Chain
EVQLVESGGGLVQPGGSLRLSCAASGFTFSSFGMHWVRQAPGKGLEWVSYISSGISTIYYADSVKGRFTISRDNSKNTLYLQMNSLRAEDTAVYYCARDWLRGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21465 - protein, 119 aa, Artificial Sequence
  Description of Artificial Sequence: Synthetic polypeptide
  VH of XENP021211
EVQLVESGGGLVQPGGSLRLSCAASGFTFSSFGMHWVRQAPGKGLEWVSYISSGISTIYYADSVKGRFTISRDNSKNTLYLQMNSLRAEDTAVYYCARDWLRGYAMDYWGQGTTVTVSS

SEQ ID NO: 21466 - protein, 5 aa, Artificial Sequence
  Description of Artificial Sequence: Synthetic peptide
  XENP021211 vhCDR1
SFGMH

SEQ ID NO: 21467 - protein, 17 aa, Artificial Sequence
  Description of Artificial Sequence: Synthetic peptide
  XENP021211 vhCDR2
YISSGISTIYYADSVKG

SEQ ID NO: 21468 - protein, 10 aa, Artificial Sequence
  Description of Artificial Sequence: Synthetic peptide
  XENP021211 vhCDR3
DWLRGYAMDY

SEQ ID NO: 21469 - protein, 218 aa, Artificial Sequence; identical to SEQ ID NO: 20930
  Description of Artificial Sequence: Synthetic polypeptide
  XENP021211 1A9_H1L0_anti-BTLA_IgG1_PVA_/S267K Light Chain

SEQ ID NO: 21470 - protein, 111 aa, Artificial Sequence; identical to SEQ ID NO: 20931
  Description of Artificial Sequence: Synthetic polypeptide
  VL of XENP021211

SEQ ID NO: 21471 - protein, 15 aa, Artificial Sequence
  Description of Artificial Sequence: Synthetic peptide
  XENP021211 vlCDR1
KASQSIDYDGDSYMN

SEQ ID NO: 21472 - protein, 7 aa, Artificial Sequence
  Description of Artificial Sequence: Synthetic peptide
  XENP021211 vlCDR2
AASNLDF

SEQ ID NO: 21473 - protein, 9 aa, Artificial Sequence
  Description of Artificial Sequence: Synthetic peptide
  XENP021211 vlCDR3
QQSNEDPWT

SEQ ID NO: 21474 - protein, 448 aa, Artificial Sequence; identical to SEQ ID NO: 21464
  Description of Artificial Sequence: Synthetic polypeptide
  XENP021212 1A9_H1L1_anti-BTLA_IgG1_PVA_/S267K Heavy Chain

SEQ ID NO: 21475 - protein, 119 aa, Artificial Sequence; identical to SEQ ID NO: 21465
  Description of Artificial Sequence: Synthetic polypeptide
  VH of XENP021212

SEQ ID NO: 21476 - protein, 5 aa, Artificial Sequence
  Description of Artificial Sequence: Synthetic peptide
  XENP021212 vhCDR1
SFGMH

SEQ ID NO: 21477 - protein, 17 aa, Artificial Sequence
  Description of Artificial Sequence: Synthetic peptide
  XENP021212 vhCDR2
YISSGISTIYYADSVKG

SEQ ID NO: 21478 - protein, 10 aa, Artificial Sequence
  Description of Artificial Sequence: Synthetic peptide
  XENP021212 vhCDR3
DWLRGYAMDY

SEQ ID NO: 21479 - protein, 218 aa, Artificial Sequence; identical to SEQ ID NO: 21459
  Description of Artificial Sequence: Synthetic polypeptide
  XENP021212 1A9_H1L1_anti-BTLA_IgG1_PVA_/S267K Light Chain

SEQ ID NO: 21480 - protein, 111 aa, Artificial Sequence; identical to SEQ ID NO: 21460
  Description of Artificial Sequence: Synthetic polypeptide
  VL of XENP021212

SEQ ID NO: 21481 - protein, 15 aa, Artificial Sequence
  Description of Artificial Sequence: Synthetic peptide
  XENP021212 vlCDR1
RASQSIDYDGDSYMN

SEQ ID NO: 21482 - protein, 7 aa, Artificial Sequence
  Description of Artificial Sequence: Synthetic peptide
  XENP021212 vlCDR2
AASNLDF

SEQ ID NO: 21483 - protein, 9 aa, Artificial Sequence
  Description of Artificial Sequence: Synthetic peptide
  XENP021212 vlCDR3
QQSNEDPWT

SEQ ID NO: 21484 - protein, 448 aa, Artificial Sequence; identical to SEQ ID NO: 21464
  Description of Artificial Sequence: Synthetic polypeptide
  XENP021213 1A9_H1L2_anti-BTLA_IgG1_PVA_/S267K Heavy Chain

SEQ ID NO: 21485 - protein, 119 aa, Artificial Sequence; identical to SEQ ID NO: 21465
  Description of Artificial Sequence: Synthetic polypeptide
  VH of XENP021213

SEQ ID NO: 21486 - protein, 5 aa, Artificial Sequence
  Description of Artificial Sequence: Synthetic peptide
  XENP021213 vhCDR1
SFGMH

SEQ ID NO: 21487 - protein, 17 aa, Artificial Sequence
  Description of Artificial Sequence: Synthetic peptide
  XENP021213 vhCDR2
YISSGISTIYYADSVKG

SEQ ID NO: 21488 - protein, 10 aa, Artificial Sequence
  Description of Artificial Sequence: Synthetic peptide
  XENP021213 vhCDR3
DWLRGYAMDY

SEQ ID NO: 21489 - protein, 218 aa, Artificial Sequence
  Description of Artificial Sequence: Synthetic polypeptide
  XENP021213 1A9_H1L2_anti-BTLA_IgG1_PVA_/S267K Light Chain
DIVLTQSPATLSVSPGERATLSCRASQSIDYDGDSYMNWYQQKPGQPPRLLIYAASNLDFGIPARFSGSGSGTEFTLTISSLQSEDFAVYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21490 - protein, 111 aa, Artificial Sequence
  Description of Artificial Sequence: Synthetic polypeptide
  VL of XENP021213
DIVLTQSPATLSVSPGERATLSCRASQSIDYDGDSYMNWYQQKPGQPPRLLIYAASNLDFGIPARFSGSGSGTEFTLTISSLQSEDFAVYYCQQSNEDPWTFGGGTKVEIK

SEQ ID NO: 21491 - protein, 15 aa, Artificial Sequence
  Description of Artificial Sequence: Synthetic peptide
  XENP021213 vlCDR1
RASQSIDYDGDSYMN

SEQ ID NO: 21492 - protein, 7 aa, Artificial Sequence
  Description of Artificial Sequence: Synthetic peptide
  XENP021213 vlCDR2
AASNLDF

SEQ ID NO: 21493 - protein, 9 aa, Artificial Sequence
  Description of Artificial Sequence: Synthetic peptide
  XENP021213 vlCDR3
QQSNEDPWT

SEQ ID NO: 21494 - protein, 448 aa, Artificial Sequence
  Description of Artificial Sequence: Synthetic polypeptide
  XENP021214 1A9_H2L1_anti-BTLA_IgG1_PVA_/S267K Heavy Chain
QVQLVQSGAEVKKPGASVKVSCKASGFTFSSFGMHWVRQAPGQGLEWMGYISSGISTIYYADKFQGRVTMTRDNSKNTLYMELSSLRSEDTAVYYCARDWLRGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21495 - protein, 119 aa, Artificial Sequence
  Description of Artificial Sequence: Synthetic polypeptide
  VH of XENP021214
QVQLVQSGAEVKKPGASVKVSCKASGFTFSSFGMHWVRQAPGQGLEWMGYISSGISTIYYADKFQGRVTMTRDNSKNTLYMELSSLRSEDTAVYYCARDWLRGYAMDYWGQGTTVTVSS

SEQ ID NO: 21496 - protein, 5 aa, Artificial Sequence
  Description of Artificial Sequence: Synthetic peptide
  XENP021214 vhCDR1
SFGMH

SEQ ID NO: 21497 - protein, 17 aa, Artificial Sequence
  Description of Artificial Sequence: Synthetic peptide
  XENP021214 vhCDR2
YISSGISTIYYADKFQG

SEQ ID NO: 21498 - protein, 10 aa, Artificial Sequence
  Description of Artificial Sequence: Synthetic peptide
  XENP021214 vhCDR3
DWLRGYAMDY

SEQ ID NO: 21499 - protein, 218 aa, Artificial Sequence; identical to SEQ ID NO: 21459
  Description of Artificial Sequence: Synthetic polypeptide
  XENP021214 1A9_H2L1_anti-BTLA_IgG1_PVA_/S267K Light Chain

SEQ ID NO: 21500 - protein, 111 aa, Artificial Sequence; identical to SEQ ID NO: 21460
  Description of Artificial Sequence: Synthetic polypeptide
  VL of XENP021214

SEQ ID NO: 21501 - protein, 15 aa, Artificial Sequence
  Description of Artificial Sequence: Synthetic peptide
  XENP021214 vlCDR1
RASQSIDYDGDSYMN

SEQ ID NO: 21502 - protein, 7 aa, Artificial Sequence
  Description of Artificial Sequence: Synthetic peptide
  XENP021214 vlCDR2
AASNLDF

SEQ ID NO: 21503 - protein, 9 aa, Artificial Sequence
  Description of Artificial Sequence: Synthetic peptide
  XENP021214 vlCDR3
QQSNEDPWT

SEQ ID NO: 21504 - protein, 448 aa, Artificial Sequence
  Description of Artificial Sequence: Synthetic polypeptide
  XENP019351 10A7_H0L0_IgG1_PVA_/S267K Heavy Chain
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21505 - protein, 119 aa, Artificial Sequence
  Description of Artificial Sequence: Synthetic polypeptide
  VH of XENP019351
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSS

SEQ ID NO: 21506 - protein, 5 aa, Artificial Sequence
  Description of Artificial Sequence: Synthetic peptide
  XENP019351 vhCDR1
SFTMH

SEQ ID NO: 21507 - protein, 17 aa, Artificial Sequence
  Description of Artificial Sequence: Synthetic peptide
  XENP019351 vhCDR2
FIRSGSGIVFYADAVRG

SEQ ID NO: 21508 - protein, 10 aa, Artificial Sequence
  Description of Artificial Sequence: Synthetic peptide
  XENP019351 vhCDR3
RPLGHNTFDS

SEQ ID NO: 21509 - protein, 220 aa, Artificial Sequence
  Description of Artificial Sequence: Synthetic polypeptide
  XENP019351 10A7_H0L0_IgG1_PVA_/S267K Light Chain
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21510 - protein, 113 aa, Artificial Sequence
  Description of Artificial Sequence: Synthetic polypeptide
  VL of XENP019351
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIK

SEQ ID NO: 21511 - protein, 17 aa, Artificial Sequence
  Description of Artificial Sequence: Synthetic peptide
  XENP019351 vlCDR1
KSSQSLYYSGVKENLLA

SEQ ID NO: 21512 - protein, 7 aa, Artificial Sequence
  Description of Artificial Sequence: Synthetic peptide
  XENP019351 vlCDR2
YASIRFT

SEQ ID NO: 21513 - protein, 9 aa, Artificial Sequence
  Description of Artificial Sequence: Synthetic peptide
  XENP019351 vlCDR3
QQGINNPLT

SEQ ID NO: 21514 - protein, 448 aa, Artificial Sequence
  Description of Artificial Sequence: Synthetic polypeptide
  XENP019352 1F4_H0L0_IgG1_PVA_/S267K Heavy Chain
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21515 - protein, 119 aa, Artificial Sequence
  Description of Artificial Sequence: Synthetic polypeptide
  VH of XENP019352
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSS

SEQ ID NO: 21516 - protein, 5 aa, Artificial Sequence
  Description of Artificial Sequence: Synthetic peptide
  XENP019352 vhCDR1
GHLMN

SEQ ID NO: 21517 - protein, 17 aa, Artificial Sequence
  Description of Artificial Sequence: Synthetic peptide
  XENP019352 vhCDR2
LIIPYNGGTSYNQKFKG

SEQ ID NO: 21518 - protein, 10 aa, Artificial Sequence
  Description of Artificial Sequence: Synthetic peptide
  XENP019352 vhCDR3
GLRGFYAMDY

SEQ ID NO: 21519 - protein, 219 aa, Artificial Sequence
  Description of Artificial Sequence: Synthetic polypeptide
  XENP019352 1F4_H0L0_IgG1_PVA_/S267K Light Chain
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21520 - protein, 112 aa, Artificial Sequence
  Description of Artificial Sequence: Synthetic polypeptide
  VL of XENP019352
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVK

SEQ ID NO: 21521 - protein, 16 aa, Artificial Sequence
  Description of Artificial Sequence: Synthetic peptide
  XENP019352 vlCDR1
RSSQSLVNSYGNTFLS

SEQ ID NO: 21522 - protein, 7 aa, Artificial Sequence
  Description of Artificial Sequence: Synthetic peptide
  XENP019352 vlCDR2
GISNRFS

SEQ ID NO: 21523 - protein, 9 aa, Artificial Sequence
  Description of Artificial Sequence: Synthetic peptide
  XENP019352 vlCDR3
LQGTHQPPT

SEQ ID NO: 21524 - protein, 449 aa, Artificial Sequence
  Description of Artificial Sequence: Synthetic polypeptide
  XENP016430 25F7_H0L0-ipilimumab_H0L0 Fab-Fc Heavy Chain
QVQLQQWGAGLLKPSETLSLTCAVYGGSFSDYYWNWIRQPPGKGLEWIGEINHNGNTNSNPSLKSRVTLSLDTSKNQFSLKLRSVTAADTAVYYCAFGYSDYEYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 21525 - protein, 120 aa, Artificial Sequence; identical to SEQ ID NO: 17136
  Description of Artificial Sequence: Synthetic polypeptide
  VH of XENP016430

SEQ ID NO: 21526 - protein, 5 aa, Artificial Sequence
  Description of Artificial Sequence: Synthetic peptide
  XENP016430 vhCDR1
DYYWN

SEQ ID NO: 21527 - protein, 16 aa, Artificial Sequence
  Description of Artificial Sequence: Synthetic peptide
  XENP016430 vhCDR2
EINHNGNTNSNPSLKS

SEQ ID NO: 21528 - protein, 12 aa, Artificial Sequence
  Description of Artificial Sequence: Synthetic peptide
  XENP016430 vhCDR3
GYSDYEYNWFDP

SEQ ID NO: 21529 - protein, 477 aa, Artificial Sequence
  Description of Artificial Sequence: Synthetic polypeptide
  XENP016430 25F7_H0L0-ipilimumab_H0L0 scFv-Fc Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21530 - protein, 118 aa, Artificial Sequence; identical to SEQ ID NO: 22
  Description of Artificial Sequence: Synthetic polypeptide
  VH of XENP016430

SEQ ID NO: 21531 - protein, 108 aa, Artificial Sequence; identical to SEQ ID NO: 23
  Description of Artificial Sequence: Synthetic polypeptide
  VL of XENP016430

SEQ ID NO: 21532 - protein, 231 aa, Artificial Sequence
  Description of Artificial Sequence: Synthetic polypeptide
  Fc chain of XENP016430
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21533 - protein, 5 aa, Artificial Sequence
  Description of Artificial Sequence: Synthetic peptide
  XENP016430 vhCDR1
SYTMH

SEQ ID NO: 21534 - protein, 17 aa, Artificial Sequence
  Description of Artificial Sequence: Synthetic peptide
  XENP016430 vhCDR2
FISYDGNNKYYADSVKG

SEQ ID NO: 21535 - protein, 9 aa, Artificial Sequence
  Description of Artificial Sequence: Synthetic peptide
  XENP016430 vhCDR3
TGWLGPFDY

SEQ ID NO: 21536 - protein, 12 aa, Artificial Sequence
  Description of Artificial Sequence: Synthetic peptide
  XENP016430 vlCDR1
RASQSVGSSYLA

SEQ ID NO: 21537 - protein, 7 aa, Artificial Sequence
  Description of Artificial Sequence: Synthetic peptide
  XENP016430 vlCDR2
GAFSRAT

SEQ ID NO: 21538 - protein, 9 aa, Artificial Sequence
  Description of Artificial Sequence: Synthetic peptide
  XENP016430 vlCDR3
QQYGSSPWT

SEQ ID NO: 21539 - protein, 214 aa, Artificial Sequence; identical to SEQ ID NO: 17140
  Description of Artificial Sequence: Synthetic polypeptide
  XENP016430 25F7_H0L0-ipilimumab_H0L0 Light Chain

SEQ ID NO: 21540 - protein, 107 aa, Artificial Sequence; identical to SEQ ID NO: 17141
  Description of Artificial Sequence: Synthetic polypeptide
  VL of XENP016430

SEQ ID NO: 21541 - protein, 11 aa, Artificial Sequence
  Description of Artificial Sequence: Synthetic peptide
  XENP016430 vlCDR1
RASQSISSYLA

SEQ ID NO: 21542 - protein, 7 aa, Artificial Sequence
  Description of Artificial Sequence: Synthetic peptide
  XENP016430 vlCDR2
DASNRAT

SEQ ID NO: 21543 - protein, 9 aa, Artificial Sequence
  Description of Artificial Sequence: Synthetic peptide
  XENP016430 vlCDR3
QQRSNWPLT

SEQ ID NO: 21544 - protein, 447 aa, Artificial Sequence; identical to SEQ ID NO: 17235
  Description of Artificial Sequence: Synthetic polypeptide
  XENP020153 2A11_H1L2-ipilimumab_H3.4_L0.12 Fab-Fc Heavy Chain

SEQ ID NO: 21545 - protein, 118 aa, Artificial Sequence; identical to SEQ ID NO: 17236
  Description of Artificial Sequence: Synthetic polypeptide
  VH of XENP020153

SEQ ID NO: 21546 - protein, 5 aa, Artificial Sequence
  Description of Artificial Sequence: Synthetic peptide
  XENP020153 vhCDR1
DYYMH

SEQ ID NO: 21547 - protein, 17 aa, Artificial Sequence
  Description of Artificial Sequence: Synthetic peptide
  XENP020153 vhCDR2
WIDPENGDTEYAPKFQG

SEQ ID NO: 21548 - protein, 9 aa, Artificial Sequence
  Description of Artificial Sequence: Synthetic peptide
  XENP020153 vhCDR3
RGVRQALDY

SEQ ID NO: 21549 - protein, 477 aa, Artificial Sequence
  Description of Artificial Sequence: Synthetic polypeptide
  XENP020153 2A11_H1L2-ipilimumab_H3.4_L0.12 scFv-Fc Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21550 - protein, 118 aa, Artificial Sequence; identical to SEQ ID NO: 2461
  Description of Artificial Sequence: Synthetic polypeptide
  VH of XENP020153

SEQ ID NO: 21551 - protein, 108 aa, Artificial Sequence; identical to SEQ ID NO: 1517
  Description of Artificial Sequence: Synthetic polypeptide
  VL of XENP020153

SEQ ID NO: 21552 - protein, 231 aa, Artificial Sequence; identical to SEQ ID NO: 21532
  Description of Artificial Sequence: Synthetic polypeptide
  Fc chain of XENP020153

SEQ ID NO: 21553 - protein, 5 aa, Artificial Sequence
  Description of Artificial Sequence: Synthetic peptide
  XENP020153 vhCDR1
SYTMH

SEQ ID NO: 21554 - protein, 17 aa, Artificial Sequence
  Description of Artificial Sequence: Synthetic peptide
  XENP020153 vhCDR2
FISYDGNHKYYADSVKG

SEQ ID NO: 21555 - protein, 9 aa, Artificial Sequence
  Description of Artificial Sequence: Synthetic peptide
  XENP020153 vhCDR3
TGHLGPFDL

SEQ ID NO: 21556 - protein, 12 aa, Artificial Sequence
  Description of Artificial Sequence: Synthetic peptide
  XENP020153 vlCDR1
RASQSVGSSYLA

SEQ ID NO: 21557 - protein, 7 aa, Artificial Sequence
  Description of Artificial Sequence: Synthetic peptide
  XENP020153 vlCDR2
GAFSRAT

SEQ ID NO: 21558 - protein, 9 aa, Artificial Sequence
  Description of Artificial Sequence: Synthetic peptide
  XENP020153 vlCDR3
QQYGSSPWT

SEQ ID NO: 21559 - protein, 214 aa, Artificial Sequence; identical to SEQ ID NO: 17250
  Description of Artificial Sequence: Synthetic polypeptide
  XENP020153 2A11_H1L2-ipilimumab_H3.4_L0.12 Light Chain

SEQ ID NO: 21560 - protein, 107 aa, Artificial Sequence; identical to SEQ ID NO: 17251
  Description of Artificial Sequence: Synthetic polypeptide
  VL of XENP020153

SEQ ID NO: 21561 - protein, 11 aa, Artificial Sequence
  Description of Artificial Sequence: Synthetic peptide
  XENP020153 vlCDR1
QASQDIGNYLN

SEQ ID NO: 21562 - protein, 7 aa, Artificial Sequence
  Description of Artificial Sequence: Synthetic peptide
  XENP020153 vlCDR2
YTSRLHS

SEQ ID NO: 21563 - protein, 9 aa, Artificial Sequence
  Description of Artificial Sequence: Synthetic peptide
  XENP020153 vlCDR3
QQGNTLPYT

SEQ ID NO: 21564 - protein, 447 aa, Artificial Sequence
  Description of Artificial Sequence: Synthetic polypeptide
  XENP020721 2A11_H1L2-ipilimumab_H3.4_L0.12 Fab-Fc Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 21565 - protein, 118 aa, Artificial Sequence; identical to SEQ ID NO: 17236
  Description of Artificial Sequence: Synthetic polypeptide
  VH of XENP020721

SEQ ID NO: 21566 - protein, 5 aa, Artificial Sequence
  Description of Artificial Sequence: Synthetic peptide
  XENP020721 vhCDR1
DYYMH

SEQ ID NO: 21567 - protein, 17 aa, Artificial Sequence
  Description of Artificial Sequence: Synthetic peptide
  XENP020721 vhCDR2
WIDPENGDTEYAPKFQG

SEQ ID NO: 21568 - protein, 9 aa, Artificial Sequence
  Description of Artificial Sequence: Synthetic peptide
  XENP020721 vhCDR3
RGVRQALDY

SEQ ID NO: 21569 - protein, 477 aa, Artificial Sequence
  Description of Artificial Sequence: Synthetic polypeptide
  XENP020721 2A11_H1L2-ipilimumab_H3.4_L0.12 scFv-Fc Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 21570 - protein, 118 aa, Artificial Sequence; identical to SEQ ID NO: 2461
  Description of Artificial Sequence: Synthetic polypeptide
  VH of XENP020721

SEQ ID NO: 21571 - protein, 108 aa, Artificial Sequence; identical to SEQ ID NO: 1517
  Description of Artificial Sequence: Synthetic polypeptide
  VL of XENP020721

SEQ ID NO: 21572 - protein, 231 aa, Artificial Sequence
  Description of Artificial Sequence: Synthetic polypeptide
  Fc chain of XENP020721
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 21573 - protein, 5 aa, Artificial Sequence
  Description of Artificial Sequence: Synthetic peptide
  XENP020721 vhCDR1
SYTMH

SEQ ID NO: 21574 - protein, 17 aa, Artificial Sequence
  Description of Artificial Sequence: Synthetic peptide
  XENP020721 vhCDR2
FISYDGNHKYYADSVKG

SEQ ID NO: 21575 - protein, 9 aa, Artificial Sequence
  Description of Artificial Sequence: Synthetic peptide
  XENP020721 vhCDR3
TGHLGPFDL

SEQ ID NO: 21576 - protein, 12 aa, Artificial Sequence
  Description of Artificial Sequence: Synthetic peptide
  XENP020721 vlCDR1
RASQSVGSSYLA

SEQ ID NO: 21577 - protein, 7 aa, Artificial Sequence
  Description of Artificial Sequence: Synthetic peptide
  XENP020721 vlCDR2
GAFSRAT

SEQ ID NO: 21578 - protein, 9 aa, Artificial Sequence
  Description of Artificial Sequence: Synthetic peptide
  XENP020721 vlCDR3
QQYGSSPWT

SEQ ID NO: 21579 - protein, 214 aa, Artificial Sequence; identical to SEQ ID NO: 17250
  Description of Artificial Sequence: Synthetic polypeptide
  XENP020721 2A11_H1L2-ipilimumab_H3.4_L0.12 Light Chain

SEQ ID NO: 21580 - protein, 107 aa, Artificial Sequence; identical to SEQ ID NO: 17251
  Description of Artificial Sequence: Synthetic polypeptide
  VL of XENP020721

SEQ ID NO: 21581 - protein, 11 aa, Artificial Sequence
  Description of Artificial Sequence: Synthetic peptide
  XENP020721 vlCDR1
QASQDIGNYLN

SEQ ID NO: 21582 - protein, 7 aa, Artificial Sequence
  Description of Artificial Sequence: Synthetic peptide
  XENP020721 vlCDR2
YTSRLHS

SEQ ID NO: 21583 - protein, 9 aa, Artificial Sequence
  Description of Artificial Sequence: Synthetic peptide
  XENP020721 vlCDR3
QQGNTLPYT

SEQ ID NO: 21584 - protein, 447 aa, Artificial Sequence; identical to SEQ ID NO: 17235
  Description of Artificial Sequence: Synthetic polypeptide
  XENP020440 2A11_H1L2-ipilimumab_H3.21_L0.124 Fab-Fc Heavy Chain

SEQ ID NO: 21585 - protein, 118 aa, Artificial Sequence; identical to SEQ ID NO: 17236
  Description of Artificial Sequence: Synthetic polypeptide
  VH of XENP020440

SEQ ID NO: 21586 - protein, 5 aa, Artificial Sequence
  Description of Artificial Sequence: Synthetic peptide
  XENP020440 vhCDR1
DYYMH

SEQ ID NO: 21587 - protein, 17 aa, Artificial Sequence
  Description of Artificial Sequence: Synthetic peptide
  XENP020440 vhCDR2
WIDPENGDTEYAPKFQG

SEQ ID NO: 21588 - protein, 9 aa, Artificial Sequence
  Description of Artificial Sequence: Synthetic peptide
  XENP020440 vhCDR3
RGVRQALDY

SEQ ID NO: 21589 - protein, 477 aa, Artificial Sequence
  Description of Artificial Sequence: Synthetic polypeptide
  XENP020440 2A11_H1L2-ipilimumab_H3.21_L0.124 scFv-Fc Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21590 - protein, 118 aa, Artificial Sequence; identical to SEQ ID NO: 2614
  Description of Artificial Sequence: Synthetic polypeptide
  VH of XENP020440

SEQ ID NO: 21591 - protein, 108 aa, Artificial Sequence; identical to SEQ ID NO: 2723
  Description of Artificial Sequence: Synthetic polypeptide
  VL of XENP020440

SEQ ID NO: 21592 - protein, 231 aa, Artificial Sequence; identical to SEQ ID NO: 21532
  Description of Artificial Sequence: Synthetic polypeptide
  Fc chain of XENP020440

SEQ ID NO: 21593 - protein, 5 aa, Artificial Sequence
  Description of Artificial Sequence: Synthetic peptide
  XENP020440 vhCDR1
SYTMH

SEQ ID NO: 21594 - protein, 17 aa, Artificial Sequence
  Description of Artificial Sequence: Synthetic peptide
  XENP020440 vhCDR2
FISYDGNTKYYADSVKG

SEQ ID NO: 21595 - protein, 9 aa, Artificial Sequence
  Description of Artificial Sequence: Synthetic peptide
  XENP020440 vhCDR3
GGLLGPFDL

SEQ ID NO: 21596 - protein, 12 aa, Artificial Sequence
  Description of Artificial Sequence: Synthetic peptide
  XENP020440 vlCDR1
RASQSVGSSYLA

SEQ ID NO: 21597 - protein, 7 aa, Artificial Sequence
  Description of Artificial Sequence: Synthetic peptide
  XENP020440 vlCDR2
GASSRAT

SEQ ID NO: 21598 - protein, 9 aa, Artificial Sequence
  Description of Artificial Sequence: Synthetic peptide
  XENP020440 vlCDR3
QQYGSSPWT

SEQ ID NO: 21599 - protein, 214 aa, Artificial Sequence; identical to SEQ ID NO: 17250
  Description of Artificial Sequence: Synthetic polypeptide
  XENP020440 2A11_H1L2-ipilimumab_H3.21_L0.124 Light Chain

SEQ ID NO: 21600 - protein, 107 aa, Artificial Sequence; identical to SEQ ID NO: 17251
  Description of Artificial Sequence: Synthetic polypeptide
  VL of XENP020440

SEQ ID NO: 21601 - protein, 11 aa, Artificial Sequence
  Description of Artificial Sequence: Synthetic peptide
  XENP020440 vlCDR1
QASQDIGNYLN

SEQ ID NO: 21602 - protein, 7 aa, Artificial Sequence
  Description of Artificial Sequence: Synthetic peptide
  XENP020440 vlCDR2
YTSRLHS

SEQ ID NO: 21603 - protein, 9 aa, Artificial Sequence
  Description of Artificial Sequence: Synthetic peptide
  XENP020440 vlCDR3
QQGNTLPYT

SEQ ID NO: 21604 - protein, 447 aa, Artificial Sequence; identical to SEQ ID NO: 17235
  Description of Artificial Sequence: Synthetic polypeptide
  XENP020441 2A11_H1L2-ipilimumab_H3.21_L0.129 Fab-Fc Heavy Chain

SEQ ID NO: 21605 - protein, 118 aa, Artificial Sequence; identical to SEQ ID NO: 17236
  Description of Artificial Sequence: Synthetic polypeptide
  VH of XENP020441

SEQ ID NO: 21606 - protein, 5 aa, Artificial Sequence
  Description of Artificial Sequence: Synthetic peptide
  XENP020441 vhCDR1
DYYMH

SEQ ID NO: 21607 - protein, 17 aa, Artificial Sequence
  Description of Artificial Sequence: Synthetic peptide
  XENP020441 vhCDR2
WIDPENGDTEYAPKFQG

SEQ ID NO: 21608 - protein, 9 aa, Artificial Sequence
  Description of Artificial Sequence: Synthetic peptide
  XENP020441 vhCDR3
RGVRQALDY

SEQ ID NO: 21609 - protein, 477 aa, Artificial Sequence
  Description of Artificial Sequence: Synthetic polypeptide
  XENP020441 2A11_H1L2-ipilimumab_H3.21_L0.129 scFv-Fc Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21610 - protein, 118 aa, Artificial Sequence; identical to SEQ ID NO: 2614
  Description of Artificial Sequence: Synthetic polypeptide
  VH of XENP020441

SEQ ID NO: 21611 - protein, 108 aa, Artificial Sequence; identical to SEQ ID NO: 2768
  Description of Artificial Sequence: Synthetic polypeptide
  VL of XENP020441

SEQ ID NO: 21612 - protein, 231 aa, Artificial Sequence; identical to SEQ ID NO: 21532
  Description of Artificial Sequence: Synthetic polypeptide
  Fc chain of XENP020441

SEQ ID NO: 21613 - protein, 5 aa, Artificial Sequence
  Description of Artificial Sequence: Synthetic peptide
  XENP020441 vhCDR1
SYTMH

SEQ ID NO: 21614 - protein, 17 aa, Artificial Sequence
  Description of Artificial Sequence: Synthetic peptide
  XENP020441 vhCDR2
FISYDGNTKYYADSVKG

SEQ ID NO: 21615 - protein, 9 aa, Artificial Sequence
  Description of Artificial Sequence: Synthetic peptide
  XENP020441 vhCDR3
GGLLGPFDL

SEQ ID NO: 21616 - protein, 12 aa, Artificial Sequence
  Description of Artificial Sequence: Synthetic peptide
  XENP020441 vlCDR1
RASQSVGSSYLA

SEQ ID NO: 21617 - protein, 7 aa, Artificial Sequence
  Description of Artificial Sequence: Synthetic peptide
  XENP020441 vlCDR2
GASSRAT

SEQ ID NO: 21618 - protein, 9 aa, Artificial Sequence
  Description of Artificial Sequence: Synthetic peptide
  XENP020441 vlCDR3
QQYGSSPWT

SEQ ID NO: 21619 - protein, 214 aa, Artificial Sequence; identical to SEQ ID NO: 17250
  Description of Artificial Sequence: Synthetic polypeptide
  XENP020441 2A11_H1L2-ipilimumab_H3.21_L0.129 Light Chain

SEQ ID NO: 21620 - protein, 107 aa, Artificial Sequence; identical to SEQ ID NO: 17251
  Description of Artificial Sequence: Synthetic polypeptide
  VL of XENP020441

SEQ ID NO: 21621 - protein, 11 aa, Artificial Sequence
  Description of Artificial Sequence: Synthetic peptide
  XENP020441 vlCDR1
QASQDIGNYLN

SEQ ID NO: 21622 - protein, 7 aa, Artificial Sequence
  Description of Artificial Sequence: Synthetic peptide
  XENP020441 vlCDR2
YTSRLHS

SEQ ID NO: 21623 - protein, 9 aa, Artificial Sequence
  Description of Artificial Sequence: Synthetic peptide
  XENP020441 vlCDR3
QQGNTLPYT

SEQ ID NO: 21624 - protein, 447 aa, Artificial Sequence; identical to SEQ ID NO: 17235
  Description of Artificial Sequence: Synthetic polypeptide
  XENP020442 2A11_H1L2-ipilimumab_H3.21_L0.132 Fab-Fc Heavy Chain

SEQ ID NO: 21625 - protein, 118 aa, Artificial Sequence; identical to SEQ ID NO: 17236
  Description of Artificial Sequence: Synthetic polypeptide
  VH of XENP020442

SEQ ID NO: 21626 - protein, 5 aa, Artificial Sequence
  Description of Artificial Sequence: Synthetic peptide
  XENP020442 vhCDR1
DYYMH

SEQ ID NO: 21627 - protein, 17 aa, Artificial Sequence
  Description of Artificial Sequence: Synthetic peptide
  XENP020442 vhCDR2
WIDPENGDTEYAPKFQG

SEQ ID NO: 21628 - protein, 9 aa, Artificial Sequence
  Description of Artificial Sequence: Synthetic peptide
  XENP020442 vhCDR3
RGVRQALDY

SEQ ID NO: 21629 - protein, 477 aa, Artificial Sequence
  Description of Artificial Sequence: Synthetic polypeptide
  XENP020442 2A11_H1L2-ipilimumab_H3.21_L0.132 scFv-Fc Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21630 - protein, 118 aa, Artificial Sequence; identical to SEQ ID NO: 2614
  Description of Artificial Sequence: Synthetic polypeptide
  VH of XENP020442

SEQ ID NO: 21631 - protein, 108 aa, Artificial Sequence; identical to SEQ ID NO: 2795
  Description of Artificial Sequence: Synthetic polypeptide
  VL of XENP020442

SEQ ID NO: 21632 - protein, 231 aa, Artificial Sequence; identical to SEQ ID NO: 21532
  Description of Artificial Sequence: Synthetic polypeptide
  Fc chain of XENP020442

SEQ ID NO: 21633 - protein, 5 aa, Artificial Sequence
  Description of Artificial Sequence: Synthetic peptide
  XENP020442 vhCDR1
SYTMH

SEQ ID NO: 21634 - protein, 17 aa, Artificial Sequence
  Description of Artificial Sequence: Synthetic peptide
  XENP020442 vhCDR2
FISYDGNTKYYADSVKG

SEQ ID NO: 21635 - protein, 9 aa, Artificial Sequence
  Description of Artificial Sequence: Synthetic peptide
  XENP020442 vhCDR3
GGLLGPFDL

SEQ ID NO: 21636 - protein, 12 aa, Artificial Sequence
  Description of Artificial Sequence: Synthetic peptide
  XENP020442 vlCDR1
RASQSVSSSYLA

SEQ ID NO: 21637 - protein, 7 aa, Artificial Sequence
  Description of Artificial Sequence: Synthetic peptide
  XENP020442 vlCDR2
GASSRAT

SEQ ID NO: 21638 - protein, 9 aa, Artificial Sequence
  Description of Artificial Sequence: Synthetic peptide
  XENP020442 vlCDR3
QQYGSSPWT

SEQ ID NO: 21639 - protein, 214 aa, Artificial Sequence; identical to SEQ ID NO: 17250
  Description of Artificial Sequence: Synthetic polypeptide
  XENP020442 2A11_H1L2-ipilimumab_H3.21_L0.132 Light Chain

SEQ ID NO: 21640 - protein, 107 aa, Artificial Sequence; identical to SEQ ID NO: 17251
  Description of Artificial Sequence: Synthetic polypeptide
  VL of XENP020442

SEQ ID NO: 21641 - protein, 11 aa, Artificial Sequence
  Description of Artificial Sequence: Synthetic peptide
  XENP020442 vlCDR1
QASQDIGNYLN

SEQ ID NO: 21642 - protein, 7 aa, Artificial Sequence
  Description of Artificial Sequence: Synthetic peptide
  XENP020442 vlCDR2
YTSRLHS

SEQ ID NO: 21643 - protein, 9 aa, Artificial Sequence
  Description of Artificial Sequence: Synthetic peptide
  XENP020442 vlCDR3
QQGNTLPYT

SEQ ID NO: 21644 - protein, 447 aa, Artificial Sequence; identical to SEQ ID NO: 17235
  Description of Artificial Sequence: Synthetic polypeptide
  XENP020443 2A11_H1L2-ipilimumab_H3.23_L0.124 Fab-Fc Heavy Chain

SEQ ID NO: 21645 - protein, 118 aa, Artificial Sequence; identical to SEQ ID NO: 17236
  Description of Artificial Sequence: Synthetic polypeptide
  VH of XENP020443

SEQ ID NO: 21646 - protein, 5 aa, Artificial Sequence
  Description of Artificial Sequence: Synthetic peptide
  XENP020443 vhCDR1
DYYMH

SEQ ID NO: 21647 - protein, 17 aa, Artificial Sequence
  Description of Artificial Sequence: Synthetic peptide
  XENP020443 vhCDR2
WIDPENGDTEYAPKFQG

SEQ ID NO: 21648 - protein, 9 aa, Artificial Sequence
  Description of Artificial Sequence: Synthetic peptide
  XENP020443 vhCDR3
RGVRQALDY

SEQ ID NO: 21649 - protein, 477 aa, Artificial Sequence
  Description of Artificial Sequence: Synthetic polypeptide
  XENP020443 2A11_H1L2-ipilimumab_H3.23_L0.124 scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21650 - protein, 118 aa, Artificial Sequence; identical to SEQ ID NO: 2632
  Description of Artificial Sequence: Synthetic polypeptide
  VH of XENP020443

SEQ ID NO: 21651 - protein, 108 aa, Artificial Sequence; identical to SEQ ID NO: 2723
  Description of Artificial Sequence: Synthetic polypeptide
  VL of XENP020443

SEQ ID NO: 21652 - protein, 231 aa, Artificial Sequence; identical to SEQ ID NO: 21532
  Description of Artificial Sequence: Synthetic polypeptide
  Fc chain of XENP020443

SEQ ID NO: 21653 - protein, 5 aa, Artificial Sequence
  Description of Artificial Sequence: Synthetic peptide
  XENP020443 vhCDR1
SYTMH

SEQ ID NO: 21654 - protein, 17 aa, Artificial Sequence
  Description of Artificial Sequence: Synthetic peptide
  XENP020443 vhCDR2
FISYDGNYKYYADSVKG

SEQ ID NO: 21655 - protein, 9 aa, Artificial Sequence
  Description of Artificial Sequence: Synthetic peptide
  XENP020443 vhCDR3
GGHLGPFDL

SEQ ID NO: 21656 - protein, 12 aa, Artificial Sequence
  Description of Artificial Sequence: Synthetic peptide
  XENP020443 vlCDR1
RASQSVGSSYLA

SEQ ID NO: 21657 - protein, 7 aa, Artificial Sequence
  Description of Artificial Sequence: Synthetic peptide
  XENP020443 vlCDR2
GASSRAT

SEQ ID NO: 21658 - protein, 9 aa, Artificial Sequence
  Description of Artificial Sequence: Synthetic peptide
  XENP020443 vlCDR3
QQYGSSPWT

SEQ ID NO: 21659 - protein, 214 aa, Artificial Sequence; identical to SEQ ID NO: 17250
  Description of Artificial Sequence: Synthetic polypeptide
  XENP020443 2A11_H1L2-ipilimumab_H3.23_L0.124 Light Chain

SEQ ID NO: 21660 - protein, 107 aa, Artificial Sequence; identical to SEQ ID NO: 17251
  Description of Artificial Sequence: Synthetic polypeptide
  VL of XENP020443

SEQ ID NO: 21661 - protein, 11 aa, Artificial Sequence
  Description of Artificial Sequence: Synthetic peptide
  XENP020443 vlCDR1
QASQDIGNYLN

SEQ ID NO: 21662 - protein, 7 aa, Artificial Sequence
  Description of Artificial Sequence: Synthetic peptide
  XENP020443 vlCDR2
YTSRLHS

SEQ ID NO: 21663 - protein, 9 aa, Artificial Sequence
  Description of Artificial Sequence: Synthetic peptide
  XENP020443 vlCDR3
QQGNTLPYT

SEQ ID NO: 21664 - protein, 447 aa, Artificial Sequence; identical to SEQ ID NO: 17235
  Description of Artificial Sequence: Synthetic polypeptide
  XENP020444 2A11_H1L2-ipilimumab_H3.23_L0.129 Fab-Fc Heavy Chain

SEQ ID NO: 21665 - protein, 118 aa, Artificial Sequence; identical to SEQ ID NO: 17236
  Description of Artificial Sequence: Synthetic polypeptide
  VH of XENP020444

SEQ ID NO: 21666 - protein, 5 aa, Artificial Sequence
  Description of Artificial Sequence: Synthetic peptide
  XENP020444 vhCDR1
DYYMH

SEQ ID NO: 21667 - protein, 17 aa, Artificial Sequence
  Description of Artificial Sequence: Synthetic peptide
  XENP020444 vhCDR2
WIDPENGDTEYAPKFQG

SEQ ID NO: 21668 - protein, 9 aa, Artificial Sequence
  Description of Artificial Sequence: Synthetic peptide
  XENP020444 vhCDR3
RGVRQALDY

SEQ ID NO: 21669 - protein, 477 aa, Artificial Sequence
  Description of Artificial Sequence: Synthetic polypeptide
  XENP020444 2A11_H1L2-ipilimumab_H3.23_L0.129 scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21670 - protein, 118 aa, Artificial Sequence; identical to SEQ ID NO: 2632
  Description of Artificial Sequence: Synthetic polypeptide
  VH of XENP020444

SEQ ID NO: 21671 - protein, 108 aa, Artificial Sequence; identical to SEQ ID NO: 2768
  Description of Artificial Sequence: Synthetic polypeptide
  VL of XENP020444

SEQ ID NO: 21672 - protein, 231 aa, Artificial Sequence; identical to SEQ ID NO: 21532
  Description of Artificial Sequence: Synthetic polypeptide
  Fc chain of XENP020444

SEQ ID NO: 21673 - protein, 5 aa, Artificial Sequence
  Description of Artificial Sequence: Synthetic peptide
  XENP020444 vhCDR1
SYTMH

SEQ ID NO: 21674 - protein, 17 aa, Artificial Sequence
  Description of Artificial Sequence: Synthetic peptide
  XENP020444 vhCDR2
FISYDGNYKYYADSVKG

SEQ ID NO: 21675 - protein, 9 aa, Artificial Sequence
  Description of Artificial Sequence: Synthetic peptide
  XENP020444 vhCDR3
GGHLGPFDL

SEQ ID NO: 21676 - protein, 12 aa, Artificial Sequence
  Description of Artificial Sequence: Synthetic peptide
  XENP020444 vlCDR1
RASQSVGSSYLA

SEQ ID NO: 21677 - protein, 7 aa, Artificial Sequence
  Description of Artificial Sequence: Synthetic peptide
  XENP020444 vlCDR2
GASSRAT

SEQ ID NO: 21678 - protein, 9 aa, Artificial Sequence
  Description of Artificial Sequence: Synthetic peptide
  XENP020444 vlCDR3
QQYGSSPWT

SEQ ID NO: 21679 - protein, 214 aa, Artificial Sequence; identical to SEQ ID NO: 17250
  Description of Artificial Sequence: Synthetic polypeptide
  XENP020444 2A11_H1L2-ipilimumab_H3.23_L0.129 Light Chain

SEQ ID NO: 21680 - protein, 107 aa, Artificial Sequence; identical to SEQ ID NO: 17251
  Description of Artificial Sequence: Synthetic polypeptide
  VL of XENP020444

SEQ ID NO: 21681 - protein, 11 aa, Artificial Sequence
  Description of Artificial Sequence: Synthetic peptide
  XENP020444 vlCDR1
QASQDIGNYLN

SEQ ID NO: 21682 - protein, 7 aa, Artificial Sequence
  Description of Artificial Sequence: Synthetic peptide
  XENP020444 vlCDR2
YTSRLHS

SEQ ID NO: 21683 - protein, 9 aa, Artificial Sequence
  Description of Artificial Sequence: Synthetic peptide
  XENP020444 vlCDR3
QQGNTLPYT

SEQ ID NO: 21684 - protein, 447 aa, Artificial Sequence; identical to SEQ ID NO: 17235
  Description of Artificial Sequence: Synthetic polypeptide
  XENP020445 2A11_H1L2-ipilimumab_H3.23_L0.132 Fab-Fc Heavy Chain

SEQ ID NO: 21685 - protein, 118 aa, Artificial Sequence; identical to SEQ ID NO: 17236
  Description of Artificial Sequence: Synthetic polypeptide
  VH of XENP020445

SEQ ID NO: 21686 - protein, 5 aa, Artificial Sequence
  Description of Artificial Sequence: Synthetic peptide
  XENP020445 vhCDR1
DYYMH

SEQ ID NO: 21687 - protein, 17 aa, Artificial Sequence
  Description of Artificial Sequence: Synthetic peptide
  XENP020445 vhCDR2
WIDPENGDTEYAPKFQG

SEQ ID NO: 21688 - protein, 9 aa, Artificial Sequence
  Description of Artificial Sequence: Synthetic peptide
  XENP020445 vhCDR3
RGVRQALDY

SEQ ID NO: 21689 - protein, 477 aa, Artificial Sequence
  Description of Artificial Sequence: Synthetic polypeptide
  XENP020445 2A11_H1L2-ipilimumab_H3.23_L0.132 scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21690 - protein, 118 aa, Artificial Sequence; identical to SEQ ID NO: 2632
  Description of Artificial Sequence: Synthetic polypeptide
  VH of XENP020445

SEQ ID NO: 21691 - protein, 108 aa, Artificial Sequence; identical to SEQ ID NO: 2795
  Description of Artificial Sequence: Synthetic polypeptide
  VL of XENP020445

SEQ ID NO: 21692 - protein, 231 aa, Artificial Sequence; identical to SEQ ID NO: 21532
  Description of Artificial Sequence: Synthetic polypeptide
  Fc chain of XENP020445

SEQ ID NO: 21693 - protein, 5 aa, Artificial Sequence
  Description of Artificial Sequence: Synthetic peptide
  XENP020445 vhCDR1
SYTMH

SEQ ID NO: 21694 - protein, 17 aa, Artificial Sequence
  Description of Artificial Sequence: Synthetic peptide
  XENP020445 vhCDR2
FISYDGNYKYYADSVKG

SEQ ID NO: 21695 - protein, 9 aa, Artificial Sequence
  Description of Artificial Sequence: Synthetic peptide
  XENP020445 vhCDR3
GGHLGPFDL

SEQ ID NO: 21696 - protein, 12 aa, Artificial Sequence
  Description of Artificial Sequence: Synthetic peptide
  XENP020445 vlCDR1
RASQSVSSSYLA

SEQ ID NO: 21697 - protein, 7 aa, Artificial Sequence
  Description of Artificial Sequence: Synthetic peptide
  XENP020445 vlCDR2
GASSRAT

SEQ ID NO: 21698 - protein, 9 aa, Artificial Sequence
  Description of Artificial Sequence: Synthetic peptide
  XENP020445 vlCDR3
QQYGSSPWT

SEQ ID NO: 21699 - protein, 214 aa, Artificial Sequence; identical to SEQ ID NO: 17250
  Description of Artificial Sequence: Synthetic polypeptide
  XENP020445 2A11_H1L2-ipilimumab_H3.23_L0.132 Light Chain

SEQ ID NO: 21700 - protein, 107 aa, Artificial Sequence; identical to SEQ ID NO: 17251
  Description of Artificial Sequence: Synthetic polypeptide
  VL of XENP020445

SEQ ID NO: 21701 - protein, 11 aa, Artificial Sequence
  Description of Artificial Sequence: Synthetic peptide
  XENP020445 vlCDR1
QASQDIGNYLN

SEQ ID NO: 21702 - protein, 7 aa, Artificial Sequence
  Description of Artificial Sequence: Synthetic peptide
  XENP020445 vlCDR2
YTSRLHS

SEQ ID NO: 21703 - protein, 9 aa, Artificial Sequence
  Description of Artificial Sequence: Synthetic peptide
  XENP020445 vlCDR3
QQGNTLPYT

SEQ ID NO: 21704 - protein, 447 aa, Artificial Sequence; identical to SEQ ID NO: 17235
  Description of Artificial Sequence: Synthetic polypeptide
  XENP020446 2A11_H1L2-ipilimumab_H3.25_L0.124 Fab-Fc Heavy Chain

SEQ ID NO: 21705 - protein, 118 aa, Artificial Sequence; identical to SEQ ID NO: 17236
  Description of Artificial Sequence: Synthetic polypeptide
  VH of XENP020446

SEQ ID NO: 21706 - protein, 5 aa, Artificial Sequence
  Description of Artificial Sequence: Synthetic peptide
  XENP020446 vhCDR1
DYYMH

SEQ ID NO: 21707 - protein, 17 aa, Artificial Sequence
  Description of Artificial Sequence: Synthetic peptide
  XENP020446 vhCDR2
WIDPENGDTEYAPKFQG

SEQ ID NO: 21708 - protein, 9 aa, Artificial Sequence
  Description of Artificial Sequence: Synthetic peptide
  XENP020446 vhCDR3
RGVRQALDY

SEQ ID NO: 21709 - protein, 477 aa, Artificial Sequence
  Description of Artificial Sequence: Synthetic polypeptide
  XENP020446 2A11_H1L2-ipilimumab_H3.25_L0.124 scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21710 - protein, 118 aa, Artificial Sequence; identical to SEQ ID NO: 2650
  Description of Artificial Sequence: Synthetic polypeptide
  VH of XENP020446

SEQ ID NO: 21711 - protein, 108 aa, Artificial Sequence; identical to SEQ ID NO: 2723
  Description of Artificial Sequence: Synthetic polypeptide
  VL of XENP020446

SEQ ID NO: 21712 - protein, 231 aa, Artificial Sequence; identical to SEQ ID NO: 21532
  Description of Artificial Sequence: Synthetic polypeptide
  Fc chain of XENP020446

SEQ ID NO: 21713 - protein, 5 aa, Artificial Sequence
  Description of Artificial Sequence: Synthetic peptide
  XENP020446 vhCDR1
SYTMH

SEQ ID NO: 21714 - protein, 17 aa, Artificial Sequence
  Description of Artificial Sequence: Synthetic peptide
  XENP020446 vhCDR2
FISYDGNYKYYADSVKG

SEQ ID NO: 21715 - protein, 9 aa, Artificial Sequence
  Description of Artificial Sequence: Synthetic peptide
  XENP020446 vhCDR3
GGLLGPFDL

SEQ ID NO: 21716 - protein, 12 aa, Artificial Sequence
  Description of Artificial Sequence: Synthetic peptide
  XENP020446 vlCDR1
RASQSVGSSYLA

SEQ ID NO: 21717 - protein, 7 aa, Artificial Sequence
  Description of Artificial Sequence: Synthetic peptide
  XENP020446 vlCDR2
GASSRAT

SEQ ID NO: 21718 - protein, 9 aa, Artificial Sequence
  Description of Artificial Sequence: Synthetic peptide
  XENP020446 vlCDR3
QQYGSSPWT

SEQ ID NO: 21719 - protein, 214 aa, Artificial Sequence; identical to SEQ ID NO: 17250
  Description of Artificial Sequence: Synthetic polypeptide
  XENP020446 2A11_H1L2-ipilimumab_H3.25_L0.124 Light Chain

SEQ ID NO: 21720 - protein, 107 aa, Artificial Sequence; identical to SEQ ID NO: 17251
  Description of Artificial Sequence: Synthetic polypeptide
  VL of XENP020446

SEQ ID NO: 21721 - protein, 11 aa, Artificial Sequence
  Description of Artificial Sequence: Synthetic peptide
  XENP020446 vlCDR1
QASQDIGNYLN

SEQ ID NO: 21722 - protein, 7 aa, Artificial Sequence
  Description of Artificial Sequence: Synthetic peptide
  XENP020446 vlCDR2
YTSRLHS

SEQ ID NO: 21723 - protein, 9 aa, Artificial Sequence
  Description of Artificial Sequence: Synthetic peptide
  XENP020446 vlCDR3
QQGNTLPYT

SEQ ID NO: 21724 - protein, 447 aa, Artificial Sequence; identical to SEQ ID NO: 17235
  Description of Artificial Sequence: Synthetic polypeptide
  XENP020447 2A11_H1L2-ipilimumab_H3.25_L0.129 Fab-Fc Heavy Chain

SEQ ID NO: 21725 - protein, 118 aa, Artificial Sequence; identical to SEQ ID NO: 17236
  Description of Artificial Sequence: Synthetic polypeptide
  VH of XENP020447

SEQ ID NO: 21726 - protein, 5 aa, Artificial Sequence
  Description of Artificial Sequence: Synthetic peptide
  XENP020447 vhCDR1
DYYMH

SEQ ID NO: 21727 - protein, 17 aa, Artificial Sequence
  Description of Artificial Sequence: Synthetic peptide
  XENP020447 vhCDR2
WIDPENGDTEYAPKFQG

SEQ ID NO: 21728 - protein, 9 aa, Artificial Sequence
  Description of Artificial Sequence: Synthetic peptide
  XENP020447 vhCDR3
RGVRQALDY

SEQ ID NO: 21729 - protein, 477 aa, Artificial Sequence
  Description of Artificial Sequence: Synthetic polypeptide
  XENP020447 2A11_H1L2-ipilimumab_H3.25_L0.129 scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21730 - protein, 118 aa, Artificial Sequence; identical to SEQ ID NO: 2650
  Description of Artificial Sequence: Synthetic polypeptide
  VH of XENP020447

SEQ ID NO: 21731 - protein, 108 aa, Artificial Sequence; identical to SEQ ID NO: 2768
  Description of Artificial Sequence: Synthetic polypeptide
  VL of XENP020447

SEQ ID NO: 21732 - protein, 231 aa, Artificial Sequence; identical to SEQ ID NO: 21532
  Description of Artificial Sequence: Synthetic polypeptide
  Fc chain of XENP020447

SEQ ID NO: 21733 - protein, 5 aa, Artificial Sequence
  Description of Artificial Sequence: Synthetic peptide
  XENP020447 vhCDR1
SYTMH

SEQ ID NO: 21734 - protein, 17 aa, Artificial Sequence
  Description of Artificial Sequence: Synthetic peptide
  XENP020447 vhCDR2
FISYDGNYKYYADSVKG

SEQ ID NO: 21735 - protein, 9 aa, Artificial Sequence
  Description of Artificial Sequence: Synthetic peptide
  XENP020447 vhCDR3
GGLLGPFDL

SEQ ID NO: 21736 - protein, 12 aa, Artificial Sequence
  Description of Artificial Sequence: Synthetic peptide
  XENP020447 vlCDR1
RASQSVGSSYLA

SEQ ID NO: 21737 - protein, 7 aa, Artificial Sequence
  Description of Artificial Sequence: Synthetic peptide
  XENP020447 vlCDR2
GASSRAT

SEQ ID NO: 21738 - protein, 9 aa, Artificial Sequence
  Description of Artificial Sequence: Synthetic peptide
  XENP020447 vlCDR3
QQYGSSPWT

SEQ ID NO: 21739 - protein, 214 aa, Artificial Sequence; identical to SEQ ID NO: 17250
  Description of Artificial Sequence: Synthetic polypeptide
  XENP020447 2A11_H1L2-ipilimumab_H3.25_L0.129 Light Chain

SEQ ID NO: 21740 - protein, 107 aa, Artificial Sequence; identical to SEQ ID NO: 17251
  Description of Artificial Sequence: Synthetic polypeptide
  VL of XENP020447

SEQ ID NO: 21741 - protein, 11 aa, Artificial Sequence
  Description of Artificial Sequence: Synthetic peptide
  XENP020447 vlCDR1
QASQDIGNYLN

SEQ ID NO: 21742 - protein, 7 aa, Artificial Sequence
  Description of Artificial Sequence: Synthetic peptide
  XENP020447 vlCDR2
YTSRLHS

SEQ ID NO: 21743 - protein, 9 aa, Artificial Sequence
  Description of Artificial Sequence: Synthetic peptide
  XENP020447 vlCDR3
QQGNTLPYT

SEQ ID NO: 21744 - protein, 447 aa, Artificial Sequence; identical to SEQ ID NO: 17235
  Description of Artificial Sequence: Synthetic polypeptide
  XENP020448 2A11_H1L2-ipilimumab_H3.25_L0.132 Fab-Fc Heavy Chain

SEQ ID NO: 21745 - protein, 118 aa, Artificial Sequence; identical to SEQ ID NO: 17236
  Description of Artificial Sequence: Synthetic polypeptide
  VH of XENP020448

SEQ ID NO: 21746 - protein, 5 aa, Artificial Sequence
  Description of Artificial Sequence: Synthetic peptide
  XENP020448 vhCDR1
DYYMH

SEQ ID NO: 21747 - protein, 17 aa, Artificial Sequence
  Description of Artificial Sequence: Synthetic peptide
  XENP020448 vhCDR2
WIDPENGDTEYAPKFQG

SEQ ID NO: 21748 - protein, 9 aa, Artificial Sequence
  Description of Artificial Sequence: Synthetic peptide
  XENP020448 vhCDR3
RGVRQALDY

SEQ ID NO: 21749 - protein, 477 aa, Artificial Sequence
  Description of Artificial Sequence: Synthetic polypeptide
  XENP020448 2A11_H1L2-ipilimumab_H3.25_L0.132 scFv-Fc Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21750 - protein, 118 aa, Artificial Sequence; identical to SEQ ID NO: 2650
  Description of Artificial Sequence: Synthetic polypeptide
  VH of XENP020448

SEQ ID NO: 21751 - protein, 108 aa, Artificial Sequence; identical to SEQ ID NO: 2795
  Description of Artificial Sequence: Synthetic polypeptide
  VL of XENP020448

SEQ ID NO: 21752 - protein, 231 aa, Artificial Sequence; identical to SEQ ID NO: 21532
  Description of Artificial Sequence: Synthetic polypeptide
  Fc chain of XENP020448

SEQ ID NO: 21753 - protein, 5 aa, Artificial Sequence
  Description of Artificial Sequence: Synthetic peptide
  XENP020448 vhCDR1
SYTMH

SEQ ID NO: 21754 - protein, 17 aa, Artificial Sequence
  Description of Artificial Sequence: Synthetic peptide
  XENP020448 vhCDR2
FISYDGNYKYYADSVKG

SEQ ID NO: 21755 - protein, 9 aa, Artificial Sequence
  Description of Artificial Sequence: Synthetic peptide
  XENP020448 vhCDR3
GGLLGPFDL

SEQ ID NO: 21756 - protein, 12 aa, Artificial Sequence
  Description of Artificial Sequence: Synthetic peptide
  XENP020448 vlCDR1
RASQSVSSSYLA

SEQ ID NO: 21757 - protein, 7 aa, Artificial Sequence
  Description of Artificial Sequence: Synthetic peptide
  XENP020448 vlCDR2
GASSRAT

SEQ ID NO: 21758 - protein, 9 aa, Artificial Sequence
  Description of Artificial Sequence: Synthetic peptide
  XENP020448 vlCDR3
QQYGSSPWT

SEQ ID NO: 21759 - protein, 214 aa, Artificial Sequence; identical to SEQ ID NO: 17250
  Description of Artificial Sequence: Synthetic polypeptide
  XENP020448 2A11_H1L2-ipilimumab_H3.25_L0.132 Light Chain

SEQ ID NO: 21760 - protein, 107 aa, Artificial Sequence; identical to SEQ ID NO: 17251
  Description of Artificial Sequence: Synthetic polypeptide
  VL of XENP020448

SEQ ID NO: 21761 - protein, 11 aa, Artificial Sequence
  Description of Artificial Sequence: Synthetic peptide
  XENP020448 vlCDR1
QASQDIGNYLN

SEQ ID NO: 21762 - protein, 7 aa, Artificial Sequence
  Description of Artificial Sequence: Synthetic peptide
  XENP020448 vlCDR2
YTSRLHS

SEQ ID NO: 21763 - protein, 9 aa, Artificial Sequence
  Description of Artificial Sequence: Synthetic peptide
  XENP020448 vlCDR3
QQGNTLPYT

SEQ ID NO: 21764 - protein, 447 aa, Artificial Sequence; identical to SEQ ID NO: 17235
  Description of Artificial Sequence: Synthetic polypeptide
  XENP020041 2A11_H1L2_Fab-ipilimumab_H3L0 Fab-Fc Heavy Chain

SEQ ID NO: 21765 - protein, 118 aa, Artificial Sequence; identical to SEQ ID NO: 17236
  Description of Artificial Sequence: Synthetic polypeptide
  VH of XENP020041

SEQ ID NO: 21766 - protein, 5 aa, Artificial Sequence
  Description of Artificial Sequence: Synthetic peptide
  XENP020041 vhCDR1
DYYMH

SEQ ID NO: 21767 - protein, 17 aa, Artificial Sequence
  Description of Artificial Sequence: Synthetic peptide
  XENP020041 vhCDR2
WIDPENGDTEYAPKFQG

SEQ ID NO: 21768 - protein, 9 aa, Artificial Sequence
  Description of Artificial Sequence: Synthetic peptide
  XENP020041 vhCDR3
RGVRQALDY

SEQ ID NO: 21769 - protein, 477 aa, Artificial Sequence
  Description of Artificial Sequence: Synthetic polypeptide
  XENP020041 2A11_H1L2_Fab-ipilimumab_H3L0 scFv-Fc Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21770 - protein, 118 aa, Artificial Sequence; identical to SEQ ID NO: 139
  Description of Artificial Sequence: Synthetic polypeptide
  VH of XENP020041

SEQ ID NO: 21771 - protein, 108 aa, Artificial Sequence; identical to SEQ ID NO: 23
  Description of Artificial Sequence: Synthetic polypeptide
  VL of XENP020041

SEQ ID NO: 21772 - protein, 231 aa, Artificial Sequence; identical to SEQ ID NO: 21532
  Description of Artificial Sequence: Synthetic polypeptide
  Fc chain of XENP020041

SEQ ID NO: 21773 - protein, 5 aa, Artificial Sequence
  Description of Artificial Sequence: Synthetic peptide
  XENP020041 vhCDR1
SYTMH

SEQ ID NO: 21774 - protein, 17 aa, Artificial Sequence
  Description of Artificial Sequence: Synthetic peptide
  XENP020041 vhCDR2
FISYDGNNKYYADSVKG

SEQ ID NO: 21775 - protein, 9 aa, Artificial Sequence
  Description of Artificial Sequence: Synthetic peptide
  XENP020041 vhCDR3
TGWLGPFDY

SEQ ID NO: 21776 - protein, 12 aa, Artificial Sequence
  Description of Artificial Sequence: Synthetic peptide
  XENP020041 vlCDR1
RASQSVGSSYLA

SEQ ID NO: 21777 - protein, 7 aa, Artificial Sequence
  Description of Artificial Sequence: Synthetic peptide
  XENP020041 vlCDR2
GAFSRAT

SEQ ID NO: 21778 - protein, 9 aa, Artificial Sequence
  Description of Artificial Sequence: Synthetic peptide
  XENP020041 vlCDR3
QQYGSSPWT

SEQ ID NO: 21779 - protein, 214 aa, Artificial Sequence; identical to SEQ ID NO: 17250
  Description of Artificial Sequence: Synthetic polypeptide
  XENP020041 2A11_H1L2_Fab-ipilimumab_H3L0 Light Chain

SEQ ID NO: 21780 - protein, 107 aa, Artificial Sequence; identical to SEQ ID NO: 17251
  Description of Artificial Sequence: Synthetic polypeptide
  VL of XENP020041

SEQ ID NO: 21781 - protein, 11 aa, Artificial Sequence
  Description of Artificial Sequence: Synthetic peptide
  XENP020041 vlCDR1
QASQDIGNYLN

SEQ ID NO: 21782 - protein, 7 aa, Artificial Sequence
  Description of Artificial Sequence: Synthetic peptide
  XENP020041 vlCDR2
YTSRLHS

SEQ ID NO: 21783 - protein, 9 aa, Artificial Sequence
  Description of Artificial Sequence: Synthetic peptide
  XENP020041 vlCDR3
QQGNTLPYT

SEQ ID NO: 21784 - protein, 447 aa, Artificial Sequence; identical to SEQ ID NO: 17235
  Description of Artificial Sequence: Synthetic polypeptide
  XENP020152 2A11_H1L2_Fab-ipilimumab_H3.3_L0.12 Fab-Fc Heavy Chain

SEQ ID NO: 21785 - protein, 118 aa, Artificial Sequence; identical to SEQ ID NO: 17236
  Description of Artificial Sequence: Synthetic polypeptide
  VH of XENP020152

SEQ ID NO: 21786 - protein, 5 aa, Artificial Sequence
  Description of Artificial Sequence: Synthetic peptide
  XENP020152 vhCDR1
DYYMH

SEQ ID NO: 21787 - protein, 17 aa, Artificial Sequence
  Description of Artificial Sequence: Synthetic peptide
  XENP020152 vhCDR2
WIDPENGDTEYAPKFQG

SEQ ID NO: 21788 - protein, 9 aa, Artificial Sequence
  Description of Artificial Sequence: Synthetic peptide
  XENP020152 vhCDR3
RGVRQALDY

SEQ ID NO: 21789 - protein, 477 aa, Artificial Sequence
  Description of Artificial Sequence: Synthetic polypeptide
  XENP020152 2A11_H1L2_Fab-ipilimumab_H3.3_L0.12 scFv-Fc Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21790 - protein, 118 aa, Artificial Sequence; identical to SEQ ID NO: 2452
  Description of Artificial Sequence: Synthetic polypeptide
  VH of XENP020152

SEQ ID NO: 21791 - protein, 108 aa, Artificial Sequence; identical to SEQ ID NO: 1517
  Description of Artificial Sequence: Synthetic polypeptide
  VL of XENP020152

SEQ ID NO: 21792 - protein, 231 aa, Artificial Sequence; identical to SEQ ID NO: 21532
  Description of Artificial Sequence: Synthetic polypeptide
  Fc chain of XENP020152

SEQ ID NO: 21793 - protein, 5 aa, Artificial Sequence
  Description of Artificial Sequence: Synthetic peptide
  XENP020152 vhCDR1
SYTMH

SEQ ID NO: 21794 - protein, 17 aa, Artificial Sequence
  Description of Artificial Sequence: Synthetic peptide
  XENP020152 vhCDR2
FISYDGNQKYYADSVKG

SEQ ID NO: 21795 - protein, 9 aa, Artificial Sequence
  Description of Artificial Sequence: Synthetic peptide
  XENP020152 vhCDR3
TGLLGPFDL

SEQ ID NO: 21796 - protein, 12 aa, Artificial Sequence
  Description of Artificial Sequence: Synthetic peptide
  XENP020152 vlCDR1
RASQSVGSSYLA

SEQ ID NO: 21797 - protein, 7 aa, Artificial Sequence
  Description of Artificial Sequence: Synthetic peptide
  XENP020152 vlCDR2
GAFSRAT

SEQ ID NO: 21798 - protein, 9 aa, Artificial Sequence
  Description of Artificial Sequence: Synthetic peptide
  XENP020152 vlCDR3
QQYGSSPWT

SEQ ID NO: 21799 - protein, 214 aa, Artificial Sequence; identical to SEQ ID NO: 17250
  Description of Artificial Sequence: Synthetic polypeptide
  XENP020152 2A11_H1L2_Fab-ipilimumab_H3.3_L0.12 Light Chain

SEQ ID NO: 21800 - protein, 107 aa, Artificial Sequence; identical to SEQ ID NO: 17251
  Description of Artificial Sequence: Synthetic polypeptide
  VL of XENP020152

SEQ ID NO: 21801 - protein, 11 aa, Artificial Sequence
  Description of Artificial Sequence: Synthetic peptide
  XENP020152 vlCDR1
QASQDIGNYLN

SEQ ID NO: 21802 - protein, 7 aa, Artificial Sequence
  Description of Artificial Sequence: Synthetic peptide
  XENP020152 vlCDR2
YTSRLHS

SEQ ID NO: 21803 - protein, 9 aa, Artificial Sequence
  Description of Artificial Sequence: Synthetic peptide
  XENP020152 vlCDR3
QQGNTLPYT

SEQ ID NO: 21804 - protein, 447 aa, Artificial Sequence; identical to SEQ ID NO: 17235
  Description of Artificial Sequence: Synthetic polypeptide
  XENP020153 2A11_H1L2_Fab-ipilimumab_H3.4_L0.12 Fab-Fc Heavy Chain

SEQ ID NO: 21805 - protein, 118 aa, Artificial Sequence; identical to SEQ ID NO: 17236
  Description of Artificial Sequence: Synthetic polypeptide
  VH of XENP020153

SEQ ID NO: 21806 - protein, 5 aa, Artificial Sequence
  Description of Artificial Sequence: Synthetic peptide
  XENP020153 vhCDR1
DYYMH

SEQ ID NO: 21807 - protein, 17 aa, Artificial Sequence
  Description of Artificial Sequence: Synthetic peptide
  XENP020153 vhCDR2
WIDPENGDTEYAPKFQG

SEQ ID NO: 21808 - protein, 9 aa, Artificial Sequence
  Description of Artificial Sequence: Synthetic peptide
  XENP020153 vhCDR3
RGVRQALDY

SEQ ID NO: 21809 - protein, 477 aa, Artificial Sequence; identical to SEQ ID NO: 21549
  Description of Artificial Sequence: Synthetic polypeptide
  XENP020153 2A11_H1L2_Fab-ipilimumab_H3.4_L0.12 scFv-Fc Heavy Chain

SEQ ID NO: 21810 - protein, 118 aa, Artificial Sequence; identical to SEQ ID NO: 2461
  Description of Artificial Sequence: Synthetic polypeptide
  VH of XENP020153

SEQ ID NO: 21811 - protein, 108 aa, Artificial Sequence; identical to SEQ ID NO: 1517
  Description of Artificial Sequence: Synthetic polypeptide
  VL of XENP020153

SEQ ID NO: 21812 - protein, 231 aa, Artificial Sequence; identical to SEQ ID NO: 21532
  Description of Artificial Sequence: Synthetic polypeptide
  Fc chain of XENP020153

SEQ ID NO: 21813 - protein, 5 aa, Artificial Sequence
  Description of Artificial Sequence: Synthetic peptide
  XENP020153 vhCDR1
SYTMH

SEQ ID NO: 21814 - protein, 17 aa, Artificial Sequence
  Description of Artificial Sequence: Synthetic peptide
  XENP020153 vhCDR2
FISYDGNHKYYADSVKG

SEQ ID NO: 21815 - protein, 9 aa, Artificial Sequence
  Description of Artificial Sequence: Synthetic peptide
  XENP020153 vhCDR3
TGHLGPFDL

SEQ ID NO: 21816 - protein, 12 aa, Artificial Sequence
  Description of Artificial Sequence: Synthetic peptide
  XENP020153 vlCDR1
RASQSVGSSYLA

SEQ ID NO: 21817 - protein, 7 aa, Artificial Sequence
  Description of Artificial Sequence: Synthetic peptide
  XENP020153 vlCDR2
GAFSRAT

SEQ ID NO: 21818 - protein, 9 aa, Artificial Sequence
  Description of Artificial Sequence: Synthetic peptide
  XENP020153 vlCDR3
QQYGSSPWT

SEQ ID NO: 21819 - protein, 214 aa, Artificial Sequence; identical to SEQ ID NO: 17250
  Description of Artificial Sequence: Synthetic polypeptide
  XENP020153 2A11_H1L2_Fab-ipilimumab_H3.4_L0.12 Light Chain

SEQ ID NO: 21820 - protein, 107 aa, Artificial Sequence; identical to SEQ ID NO: 17251
  Description of Artificial Sequence: Synthetic polypeptide
  VL of XENP020153

SEQ ID NO: 21821 - protein, 11 aa, Artificial Sequence
  Description of Artificial Sequence: Synthetic peptide
  XENP020153 vlCDR1
QASQDIGNYLN

SEQ ID NO: 21822 - protein, 7 aa, Artificial Sequence
  Description of Artificial Sequence: Synthetic peptide
  XENP020153 vlCDR2
YTSRLHS

SEQ ID NO: 21823 - protein, 9 aa, Artificial Sequence
  Description of Artificial Sequence: Synthetic peptide
  XENP020153 vlCDR3
QQGNTLPYT

SEQ ID NO: 21824 - protein, 447 aa, Artificial Sequence; identical to SEQ ID NO: 17235
  Description of Artificial Sequence: Synthetic polypeptide
  XENP020440 2A11_H1L2_Fab-ipilimumab_H3.21_L0.124 Fab-Fc Heavy Chain

SEQ ID NO: 21825 - protein, 118 aa, Artificial Sequence; identical to SEQ ID NO: 17236
  Description of Artificial Sequence: Synthetic polypeptide
  VH of XENP020440

SEQ ID NO: 21826 - protein, 5 aa, Artificial Sequence
  Description of Artificial Sequence: Synthetic peptide
  XENP020440 vhCDR1
DYYMH

SEQ ID NO: 21827 - protein, 17 aa, Artificial Sequence
  Description of Artificial Sequence: Synthetic peptide
  XENP020440 vhCDR2
WIDPENGDTEYAPKFQG

SEQ ID NO: 21828 - protein, 9 aa, Artificial Sequence
  Description of Artificial Sequence: Synthetic peptide
  XENP020440 vhCDR3
RGVRQALDY

SEQ ID NO: 21829 - protein, 477 aa, Artificial Sequence; identical to SEQ ID NO: 21589
  Description of Artificial Sequence: Synthetic polypeptide
  XENP020440 2A11_H1L2_Fab-ipilimumab_H3.21_L0.124 scFv-Fc Heavy Chain

SEQ ID NO: 21830 - protein, 118 aa, Artificial Sequence; identical to SEQ ID NO: 2614
  Description of Artificial Sequence: Synthetic polypeptide
  VH of XENP020440

SEQ ID NO: 21831 - protein, 108 aa, Artificial Sequence; identical to SEQ ID NO: 2723
  Description of Artificial Sequence: Synthetic polypeptide
  VL of XENP020440

SEQ ID NO: 21832 - protein, 231 aa, Artificial Sequence; identical to SEQ ID NO: 21532
  Description of Artificial Sequence: Synthetic polypeptide
  Fc chain of XENP020440

SEQ ID NO: 21833 - protein, 5 aa, Artificial Sequence
  Description of Artificial Sequence: Synthetic peptide
  XENP020440 vhCDR1
SYTMH

SEQ ID NO: 21834 - protein, 17 aa, Artificial Sequence
  Description of Artificial Sequence: Synthetic peptide
  XENP020440 vhCDR2
FISYDGNTKYYADSVKG

SEQ ID NO: 21835 - protein, 9 aa, Artificial Sequence
  Description of Artificial Sequence: Synthetic peptide
  XENP020440 vhCDR3
GGLLGPFDL

SEQ ID NO: 21836 - protein, 12 aa, Artificial Sequence
  Description of Artificial Sequence: Synthetic peptide
  XENP020440 vlCDR1
RASQSVGSSYLA

SEQ ID NO: 21837 - protein, 7 aa, Artificial Sequence
  Description of Artificial Sequence: Synthetic peptide
  XENP020440 vlCDR2
GASSRAT

SEQ ID NO: 21838 - protein, 9 aa, Artificial Sequence
  Description of Artificial Sequence: Synthetic peptide
  XENP020440 vlCDR3
QQYGSSPWT

SEQ ID NO: 21839 - protein, 214 aa, Artificial Sequence; identical to SEQ ID NO: 17250
  Description of Artificial Sequence: Synthetic polypeptide
  XENP020440 2A11_H1L2_Fab-ipilimumab_H3.21_L0.124 Light Chain

SEQ ID NO: 21840 - protein, 107 aa, Artificial Sequence; identical to SEQ ID NO: 17251
  Description of Artificial Sequence: Synthetic polypeptide
  VL of XENP020440

SEQ ID NO: 21841 - protein, 11 aa, Artificial Sequence
  Description of Artificial Sequence: Synthetic peptide
  XENP020440 vlCDR1
QASQDIGNYLN

SEQ ID NO: 21842 - protein, 7 aa, Artificial Sequence
  Description of Artificial Sequence: Synthetic peptide
  XENP020440 vlCDR2
YTSRLHS

SEQ ID NO: 21843 - protein, 9 aa, Artificial Sequence
  Description of Artificial Sequence: Synthetic peptide
  XENP020440 vlCDR3
QQGNTLPYT

SEQ ID NO: 21844 - protein, 447 aa, Artificial Sequence; identical to SEQ ID NO: 17235
  Description of Artificial Sequence: Synthetic polypeptide
  XENP020441 2A11_H1L2_Fab-ipilimumab_H3.21_L0.129 Fab-Fc Heavy Chain

SEQ ID NO: 21845 - protein, 118 aa, Artificial Sequence; identical to SEQ ID NO: 17236
  Description of Artificial Sequence: Synthetic polypeptide
  VH of XENP020441

SEQ ID NO: 21846 - protein, 5 aa, Artificial Sequence
  Description of Artificial Sequence: Synthetic peptide
  XENP020441 vhCDR1
DYYMH

SEQ ID NO: 21847 - protein, 17 aa, Artificial Sequence
  Description of Artificial Sequence: Synthetic peptide
  XENP020441 vhCDR2
WIDPENGDTEYAPKFQG

SEQ ID NO: 21848 - protein, 9 aa, Artificial Sequence
  Description of Artificial Sequence: Synthetic peptide
  XENP020441 vhCDR3
RGVRQALDY

SEQ ID NO: 21849 - protein, 477 aa, Artificial Sequence; identical to SEQ ID NO: 21609
  Description of Artificial Sequence: Synthetic polypeptide
  XENP020441 2A11_H1L2_Fab-ipilimumab_H3.21_L0.129 scFv-Fc Heavy Chain

SEQ ID NO: 21850 - protein, 118 aa, Artificial Sequence; identical to SEQ ID NO: 2614
  Description of Artificial Sequence: Synthetic polypeptide
  VH of XENP020441

SEQ ID NO: 21851 - protein, 108 aa, Artificial Sequence; identical to SEQ ID NO: 2768
  Description of Artificial Sequence: Synthetic polypeptide
  VL of XENP020441

SEQ ID NO: 21852 - protein, 231 aa, Artificial Sequence; identical to SEQ ID NO: 21532
  Description of Artificial Sequence: Synthetic polypeptide
  Fc chain of XENP020441

SEQ ID NO: 21853 - protein, 5 aa, Artificial Sequence
  Description of Artificial Sequence: Synthetic peptide
  XENP020441 vhCDR1
SYTMH

SEQ ID NO: 21854 - protein, 17 aa, Artificial Sequence
  Description of Artificial Sequence: Synthetic peptide
  XENP020441 vhCDR2
FISYDGNTKYYADSVKG

SEQ ID NO: 21855 - protein, 9 aa, Artificial Sequence
  Description of Artificial Sequence: Synthetic peptide
  XENP020441 vhCDR3
GGLLGPFDL

SEQ ID NO: 21856 - protein, 12 aa, Artificial Sequence
  Description of Artificial Sequence: Synthetic peptide
  XENP020441 vlCDR1
RASQSVGSSYLA

SEQ ID NO: 21857 - protein, 7 aa, Artificial Sequence
  Description of Artificial Sequence: Synthetic peptide
  XENP020441 vlCDR2
GASSRAT

SEQ ID NO: 21858 - protein, 9 aa, Artificial Sequence
  Description of Artificial Sequence: Synthetic peptide
  XENP020441 vlCDR3
QQYGSSPWT

SEQ ID NO: 21859 - protein, 214 aa, Artificial Sequence; identical to SEQ ID NO: 17250
  Description of Artificial Sequence: Synthetic polypeptide
  XENP020441 2A11_H1L2_Fab-ipilimumab_H3.21_L0.129 Light Chain

SEQ ID NO: 21860 - protein, 107 aa, Artificial Sequence; identical to SEQ ID NO: 17251
  Description of Artificial Sequence: Synthetic polypeptide
  VL of XENP020441

SEQ ID NO: 21861 - protein, 11 aa, Artificial Sequence
  Description of Artificial Sequence: Synthetic peptide
  XENP020441 vlCDR1
QASQDIGNYLN

SEQ ID NO: 21862 - protein, 7 aa, Artificial Sequence
  Description of Artificial Sequence: Synthetic peptide
  XENP020441 vlCDR2
YTSRLHS

SEQ ID NO: 21863 - protein, 9 aa, Artificial Sequence
  Description of Artificial Sequence: Synthetic peptide
  XENP020441 vlCDR3
QQGNTLPYT

SEQ ID NO: 21864 - protein, 447 aa, Artificial Sequence; identical to SEQ ID NO: 17235
  Description of Artificial Sequence: Synthetic polypeptide
  XENP020442 2A11_H1L2_Fab-ipilimumab_H3.21_L0.132 Fab-Fc Heavy Chain

SEQ ID NO: 21865 - protein, 118 aa, Artificial Sequence; identical to SEQ ID NO: 17236
  Description of Artificial Sequence: Synthetic polypeptide
  VH of XENP020442

SEQ ID NO: 21866 - protein, 5 aa, Artificial Sequence
  Description of Artificial Sequence: Synthetic peptide
  XENP020442 vhCDR1
DYYMH

SEQ ID NO: 21867 - protein, 17 aa, Artificial Sequence
  Description of Artificial Sequence: Synthetic peptide
  XENP020442 vhCDR2
WIDPENGDTEYAPKFQG

SEQ ID NO: 21868 - protein, 9 aa, Artificial Sequence
  Description of Artificial Sequence: Synthetic peptide
  XENP020442 vhCDR3
RGVRQALDY

SEQ ID NO: 21869 - protein, 477 aa, Artificial Sequence; identical to SEQ ID NO: 21629
  Description of Artificial Sequence: Synthetic polypeptide
  XENP020442 2A11_H1L2_Fab-ipilimumab_H3.21_L0.132 scFv-Fc Heavy Chain

SEQ ID NO: 21870 - protein, 118 aa, Artificial Sequence; identical to SEQ ID NO: 2614
  Description of Artificial Sequence: Synthetic polypeptide
  VH of XENP020442

SEQ ID NO: 21871 - protein, 108 aa, Artificial Sequence; identical to SEQ ID NO: 2795
  Description of Artificial Sequence: Synthetic polypeptide
  VL of XENP020442

SEQ ID NO: 21872 - protein, 231 aa, Artificial Sequence; identical to SEQ ID NO: 21532
  Description of Artificial Sequence: Synthetic polypeptide
  Fc chain of XENP020442

SEQ ID NO: 21873 - protein, 5 aa, Artificial Sequence
  Description of Artificial Sequence: Synthetic peptide
  XENP020442 vhCDR1
SYTMH

SEQ ID NO: 21874 - protein, 17 aa, Artificial Sequence
  Description of Artificial Sequence: Synthetic peptide
  XENP020442 vhCDR2
FISYDGNTKYYADSVKG

SEQ ID NO: 21875 - protein, 9 aa, Artificial Sequence
  Description of Artificial Sequence: Synthetic peptide
  XENP020442 vhCDR3
GGLLGPFDL

SEQ ID NO: 21876 - protein, 12 aa, Artificial Sequence
  Description of Artificial Sequence: Synthetic peptide
  XENP020442 vlCDR1
RASQSVSSSYLA

SEQ ID NO: 21877 - protein, 7 aa, Artificial Sequence
  Description of Artificial Sequence: Synthetic peptide
  XENP020442 vlCDR2
GASSRAT

SEQ ID NO: 21878 - protein, 9 aa, Artificial Sequence
  Description of Artificial Sequence: Synthetic peptide
  XENP020442 vlCDR3
QQYGSSPWT

SEQ ID NO: 21879 - protein, 214 aa, Artificial Sequence; identical to SEQ ID NO: 17250
  Description of Artificial Sequence: Synthetic polypeptide
  XENP020442 2A11_H1L2_Fab-ipilimumab_H3.21_L0.132 Light Chain

SEQ ID NO: 21880 - protein, 107 aa, Artificial Sequence; identical to SEQ ID NO: 17251
  Description of Artificial Sequence: Synthetic polypeptide
  VL of XENP020442

SEQ ID NO: 21881 - protein, 11 aa, Artificial Sequence
  Description of Artificial Sequence: Synthetic peptide
  XENP020442 vlCDR1
QASQDIGNYLN

SEQ ID NO: 21882 - protein, 7 aa, Artificial Sequence
  Description of Artificial Sequence: Synthetic peptide
  XENP020442 vlCDR2
YTSRLHS

SEQ ID NO: 21883 - protein, 9 aa, Artificial Sequence
  Description of Artificial Sequence: Synthetic peptide
  XENP020442 vlCDR3
QQGNTLPYT

SEQ ID NO: 21884 - protein, 447 aa, Artificial Sequence; identical to SEQ ID NO: 17235
  Description of Artificial Sequence: Synthetic polypeptide
  XENP020443 2A11_H1L2_Fab-ipilimumab_H3.23_L0.124 Fab-Fc Heavy Chain

SEQ ID NO: 21885 - protein, 118 aa, Artificial Sequence; identical to SEQ ID NO: 17236
  Description of Artificial Sequence: Synthetic polypeptide
  VH of XENP020443

SEQ ID NO: 21886 - protein, 5 aa, Artificial Sequence
  Description of Artificial Sequence: Synthetic peptide
  XENP020443 vhCDR1
DYYMH

SEQ ID NO: 21887 - protein, 17 aa, Artificial Sequence
  Description of Artificial Sequence: Synthetic peptide
  XENP020443 vhCDR2
WIDPENGDTEYAPKFQG

SEQ ID NO: 21888 - protein, 9 aa, Artificial Sequence
  Description of Artificial Sequence: Synthetic peptide
  XENP020443 vhCDR3
RGVRQALDY

SEQ ID NO: 21889 - protein, 477 aa, Artificial Sequence; identical to SEQ ID NO: 21649
  Description of Artificial Sequence: Synthetic polypeptide
  XENP020443 2A11_H1L2_Fab-ipilimumab_H3.23_L0.124 scFv-Fc Heavy Chain

SEQ ID NO: 21890 - protein, 118 aa, Artificial Sequence; identical to SEQ ID NO: 2632
  Description of Artificial Sequence: Synthetic polypeptide
  VH of XENP020443

SEQ ID NO: 21891 - protein, 108 aa, Artificial Sequence; identical to SEQ ID NO: 2723
  Description of Artificial Sequence: Synthetic polypeptide
  VL of XENP020443

SEQ ID NO: 21892 - protein, 231 aa, Artificial Sequence; identical to SEQ ID NO: 21532
  Description of Artificial Sequence: Synthetic polypeptide
  Fc chain of XENP020443

SEQ ID NO: 21893 - protein, 5 aa, Artificial Sequence
  Description of Artificial Sequence: Synthetic peptide
  XENP020443 vhCDR1
SYTMH

SEQ ID NO: 21894 - protein, 17 aa, Artificial Sequence
  Description of Artificial Sequence: Synthetic peptide
  XENP020443 vhCDR2
FISYDGNYKYYADSVKG

SEQ ID NO: 21895 - protein, 9 aa, Artificial Sequence
  Description of Artificial Sequence: Synthetic peptide
  XENP020443 vhCDR3
GGHLGPFDL

SEQ ID NO: 21896 - protein, 12 aa, Artificial Sequence
  Description of Artificial Sequence: Synthetic peptide
  XENP020443 vlCDR1
RASQSVGSSYLA

SEQ ID NO: 21897 - protein, 7 aa, Artificial Sequence
  Description of Artificial Sequence: Synthetic peptide
  XENP020443 vlCDR2
GASSRAT

SEQ ID NO: 21898 - protein, 9 aa, Artificial Sequence
  Description of Artificial Sequence: Synthetic peptide
  XENP020443 vlCDR3
QQYGSSPWT

SEQ ID NO: 21899 - protein, 214 aa, Artificial Sequence; identical to SEQ ID NO: 17250
  Description of Artificial Sequence: Synthetic polypeptide
  XENP020443 2A11_H1L2_Fab-ipilimumab_H3.23_L0.124 Light Chain

SEQ ID NO: 21900 - protein, 107 aa, Artificial Sequence; identical to SEQ ID NO: 17251
  Description of Artificial Sequence: Synthetic polypeptide
  VL of XENP020443

SEQ ID NO: 21901 - protein, 11 aa, Artificial Sequence
  Description of Artificial Sequence: Synthetic peptide
  XENP020443 vlCDR1
QASQDIGNYLN

SEQ ID NO: 21902 - protein, 7 aa, Artificial Sequence
  Description of Artificial Sequence: Synthetic peptide
  XENP020443 vlCDR2
YTSRLHS

SEQ ID NO: 21903 - protein, 9 aa, Artificial Sequence
  Description of Artificial Sequence: Synthetic peptide
  XENP020443 vlCDR3
QQGNTLPYT

SEQ ID NO: 21904 - protein, 447 aa, Artificial Sequence; identical to SEQ ID NO: 17235
  Description of Artificial Sequence: Synthetic polypeptide
  XENP020444 2A11_H1L2_Fab-ipilimumab_H3.23_L0.129 Fab-Fc Heavy Chain

SEQ ID NO: 21905 - protein, 118 aa, Artificial Sequence; identical to SEQ ID NO: 17236
  Description of Artificial Sequence: Synthetic polypeptide
  VH of XENP020444

SEQ ID NO: 21906 - protein, 5 aa, Artificial Sequence
  Description of Artificial Sequence: Synthetic peptide
  XENP020444 vhCDR1
DYYMH

SEQ ID NO: 21907 - protein, 17 aa, Artificial Sequence
  Description of Artificial Sequence: Synthetic peptide
  XENP020444 vhCDR2
WIDPENGDTEYAPKFQG

SEQ ID NO: 21908 - protein, 9 aa, Artificial Sequence
  Description of Artificial Sequence: Synthetic peptide
  XENP020444 vhCDR3
RGVRQALDY

SEQ ID NO: 21909 - protein, 477 aa, Artificial Sequence; identical to SEQ ID NO: 21669
  Description of Artificial Sequence: Synthetic polypeptide
  XENP020444 2A11_H1L2_Fab-ipilimumab_H3.23_L0.129 scFv-Fc Heavy Chain

SEQ ID NO: 21910 - protein, 118 aa, Artificial Sequence; identical to SEQ ID NO: 2632
  Description of Artificial Sequence: Synthetic polypeptide
  VH of XENP020444

SEQ ID NO: 21911 - protein, 108 aa, Artificial Sequence; identical to SEQ ID NO: 2768
  Description of Artificial Sequence: Synthetic polypeptide
  VL of XENP020444

SEQ ID NO: 21912 - protein, 231 aa, Artificial Sequence; identical to SEQ ID NO: 21532
  Description of Artificial Sequence: Synthetic polypeptide
  Fc chain of XENP020444

SEQ ID NO: 21913 - protein, 5 aa, Artificial Sequence
  Description of Artificial Sequence: Synthetic peptide
  XENP020444 vhCDR1
SYTMH

SEQ ID NO: 21914 - protein, 17 aa, Artificial Sequence
  Description of Artificial Sequence: Synthetic peptide
  XENP020444 vhCDR2
FISYDGNYKYYADSVKG

SEQ ID NO: 21915 - protein, 9 aa, Artificial Sequence
  Description of Artificial Sequence: Synthetic peptide
  XENP020444 vhCDR3
GGHLGPFDL

SEQ ID NO: 21916 - protein, 12 aa, Artificial Sequence
  Description of Artificial Sequence: Synthetic peptide
  XENP020444 vlCDR1
RASQSVGSSYLA

SEQ ID NO: 21917 - protein, 7 aa, Artificial Sequence
  Description of Artificial Sequence: Synthetic peptide
  XENP020444 vlCDR2
GASSRAT

SEQ ID NO: 21918 - protein, 9 aa, Artificial Sequence
  Description of Artificial Sequence: Synthetic peptide
  XENP020444 vlCDR3
QQYGSSPWT

SEQ ID NO: 21919 - protein, 214 aa, Artificial Sequence; identical to SEQ ID NO: 17250
  Description of Artificial Sequence: Synthetic polypeptide
  XENP020444 2A11_H1L2_Fab-ipilimumab_H3.23_L0.129 Light Chain

SEQ ID NO: 21920 - protein, 107 aa, Artificial Sequence; identical to SEQ ID NO: 17251
  Description of Artificial Sequence: Synthetic polypeptide
  VL of XENP020444

SEQ ID NO: 21921 - protein, 11 aa, Artificial Sequence
  Description of Artificial Sequence: Synthetic peptide
  XENP020444 vlCDR1
QASQDIGNYLN

SEQ ID NO: 21922 - protein, 7 aa, Artificial Sequence
  Description of Artificial Sequence: Synthetic peptide
  XENP020444 vlCDR2
YTSRLHS

SEQ ID NO: 21923 - protein, 9 aa, Artificial Sequence
  Description of Artificial Sequence: Synthetic peptide
  XENP020444 vlCDR3
QQGNTLPYT

SEQ ID NO: 21924 - protein, 447 aa, Artificial Sequence; identical to SEQ ID NO: 17235
  Description of Artificial Sequence: Synthetic polypeptide
  XENP020445 2A11_H1L2_Fab-ipilimumab_H3.23_L0.132 Fab-Fc Heavy Chain

SEQ ID NO: 21925 - protein, 118 aa, Artificial Sequence; identical to SEQ ID NO: 17236
  Description of Artificial Sequence: Synthetic polypeptide
  VH of XENP020445

SEQ ID NO: 21926 - protein, 5 aa, Artificial Sequence
  Description of Artificial Sequence: Synthetic peptide
  XENP020445 vhCDR1
DYYMH

SEQ ID NO: 21927 - protein, 17 aa, Artificial Sequence
  Description of Artificial Sequence: Synthetic peptide
  XENP020445 vhCDR2
WIDPENGDTEYAPKFQG

SEQ ID NO: 21928 - protein, 9 aa, Artificial Sequence
  Description of Artificial Sequence: Synthetic peptide
  XENP020445 vhCDR3
RGVRQALDY

SEQ ID NO: 21929 - protein, 477 aa, Artificial Sequence; identical to SEQ ID NO: 21689
  Description of Artificial Sequence: Synthetic polypeptide
  XENP020445 2A11_H1L2_Fab-ipilimumab_H3.23_L0.132 scFv-Fc Heavy Chain

SEQ ID NO: 21930 - protein, 118 aa, Artificial Sequence; identical to SEQ ID NO: 2632
  Description of Artificial Sequence: Synthetic polypeptide
  VH of XENP020445

SEQ ID NO: 21931 - protein, 108 aa, Artificial Sequence; identical to SEQ ID NO: 2795
  Description of Artificial Sequence: Synthetic polypeptide
  VL of XENP020445

SEQ ID NO: 21932 - protein, 231 aa, Artificial Sequence; identical to SEQ ID NO: 21532
  Description of Artificial Sequence: Synthetic polypeptide
  Fc chain of XENP020445

SEQ ID NO: 21933 - protein, 5 aa, Artificial Sequence
  Description of Artificial Sequence: Synthetic peptide
  XENP020445 vhCDR1
SYTMH

SEQ ID NO: 21934 - protein, 17 aa, Artificial Sequence
  Description of Artificial Sequence: Synthetic peptide
  XENP020445 vhCDR2
FISYDGNYKYYADSVKG

SEQ ID NO: 21935 - protein, 9 aa, Artificial Sequence
  Description of Artificial Sequence: Synthetic peptide
  XENP020445 vhCDR3
GGHLGPFDL

SEQ ID NO: 21936 - protein, 12 aa, Artificial Sequence
  Description of Artificial Sequence: Synthetic peptide
  XENP020445 vlCDR1
RASQSVSSSYLA

SEQ ID NO: 21937 - protein, 7 aa, Artificial Sequence
  Description of Artificial Sequence: Synthetic peptide
  XENP020445 vlCDR2
GASSRAT

SEQ ID NO: 21938 - protein, 9 aa, Artificial Sequence
  Description of Artificial Sequence: Synthetic peptide
  XENP020445 vlCDR3
QQYGSSPWT

SEQ ID NO: 21939 - protein, 214 aa, Artificial Sequence; identical to SEQ ID NO: 17250
  Description of Artificial Sequence: Synthetic polypeptide
  XENP020445 2A11_H1L2_Fab-ipilimumab_H3.23_L0.132 Light Chain

SEQ ID NO: 21940 - protein, 107 aa, Artificial Sequence; identical to SEQ ID NO: 17251
  Description of Artificial Sequence: Synthetic polypeptide
  VL of XENP020445

SEQ ID NO: 21941 - protein, 11 aa, Artificial Sequence
  Description of Artificial Sequence: Synthetic peptide
  XENP020445 vlCDR1
QASQDIGNYLN

SEQ ID NO: 21942 - protein, 7 aa, Artificial Sequence
  Description of Artificial Sequence: Synthetic peptide
  XENP020445 vlCDR2
YTSRLHS

SEQ ID NO: 21943 - protein, 9 aa, Artificial Sequence
  Description of Artificial Sequence: Synthetic peptide
  XENP020445 vlCDR3
QQGNTLPYT

SEQ ID NO: 21944 - protein, 447 aa, Artificial Sequence; identical to SEQ ID NO: 17235
  Description of Artificial Sequence: Synthetic polypeptide
  XENP020446 2A11_H1L2_Fab-ipilimumab_H3.25_L0.124 Fab-Fc Heavy Chain

SEQ ID NO: 21945 - protein, 118 aa, Artificial Sequence; identical to SEQ ID NO: 17236
  Description of Artificial Sequence: Synthetic polypeptide
  VH of XENP020446

SEQ ID NO: 21946 - protein, 5 aa, Artificial Sequence
  Description of Artificial Sequence: Synthetic peptide
  XENP020446 vhCDR1
DYYMH

SEQ ID NO: 21947 - protein, 17 aa, Artificial Sequence
  Description of Artificial Sequence: Synthetic peptide
  XENP020446 vhCDR2
WIDPENGDTEYAPKFQG

SEQ ID NO: 21948 - protein, 9 aa, Artificial Sequence
  Description of Artificial Sequence: Synthetic peptide
  XENP020446 vhCDR3
RGVRQALDY

SEQ ID NO: 21949 - protein, 477 aa, Artificial Sequence; identical to SEQ ID NO: 21709
  Description of Artificial Sequence: Synthetic polypeptide
  XENP020446 2A11_H1L2_Fab-ipilimumab_H3.25_L0.124 scFv-Fc Heavy Chain

SEQ ID NO: 21950 - protein, 118 aa, Artificial Sequence; identical to SEQ ID NO: 2650
  Description of Artificial Sequence: Synthetic polypeptide
  VH of XENP020446

SEQ ID NO: 21951 - protein, 108 aa, Artificial Sequence; identical to SEQ ID NO: 2723
  Description of Artificial Sequence: Synthetic polypeptide
  VL of XENP020446

SEQ ID NO: 21952 - protein, 231 aa, Artificial Sequence; identical to SEQ ID NO: 21532
  Description of Artificial Sequence: Synthetic polypeptide
  Fc chain of XENP020446

SEQ ID NO: 21953 - protein, 5 aa, Artificial Sequence
  Description of Artificial Sequence: Synthetic peptide
  XENP020446 vhCDR1
SYTMH

SEQ ID NO: 21954 - protein, 17 aa, Artificial Sequence
  Description of Artificial Sequence: Synthetic peptide
  XENP020446 vhCDR2
FISYDGNYKYYADSVKG

SEQ ID NO: 21955 - protein, 9 aa, Artificial Sequence
  Description of Artificial Sequence: Synthetic peptide
  XENP020446 vhCDR3
GGLLGPFDL

SEQ ID NO: 21956 - protein, 12 aa, Artificial Sequence
  Description of Artificial Sequence: Synthetic peptide
  XENP020446 vlCDR1
RASQSVGSSYLA

SEQ ID NO: 21957 - protein, 7 aa, Artificial Sequence
  Description of Artificial Sequence: Synthetic peptide
  XENP020446 vlCDR2
GASSRAT

SEQ ID NO: 21958 - protein, 9 aa, Artificial Sequence
  Description of Artificial Sequence: Synthetic peptide
  XENP020446 vlCDR3
QQYGSSPWT

SEQ ID NO: 21959 - protein, 214 aa, Artificial Sequence; identical to SEQ ID NO: 17250
  Description of Artificial Sequence: Synthetic polypeptide
  XENP020446 2A11_H1L2_Fab-ipilimumab_H3.25_L0.124 Light Chain

SEQ ID NO: 21960 - protein, 107 aa, Artificial Sequence; identical to SEQ ID NO: 17251
  Description of Artificial Sequence: Synthetic polypeptide
  VL of XENP020446

SEQ ID NO: 21961 - protein, 11 aa, Artificial Sequence
  Description of Artificial Sequence: Synthetic peptide
  XENP020446 vlCDR1
QASQDIGNYLN

SEQ ID NO: 21962 - protein, 7 aa, Artificial Sequence
  Description of Artificial Sequence: Synthetic peptide
  XENP020446 vlCDR2
YTSRLHS

SEQ ID NO: 21963 - protein, 9 aa, Artificial Sequence
  Description of Artificial Sequence: Synthetic peptide
  XENP020446 vlCDR3
QQGNTLPYT

SEQ ID NO: 21964 - protein, 447 aa, Artificial Sequence; identical to SEQ ID NO: 17235
  Description of Artificial Sequence: Synthetic polypeptide
  XENP020447 2A11_H1L2_Fab-ipilimumab_H3.25_L0.129 Fab-Fc Heavy Chain

SEQ ID NO: 21965 - protein, 118 aa, Artificial Sequence; identical to SEQ ID NO: 17236
  Description of Artificial Sequence: Synthetic polypeptide
  VH of XENP020447

SEQ ID NO: 21966 - protein, 5 aa, Artificial Sequence
  Description of Artificial Sequence: Synthetic peptide
  XENP020447 vhCDR1
DYYMH

SEQ ID NO: 21967 - protein, 17 aa, Artificial Sequence
  Description of Artificial Sequence: Synthetic peptide
  XENP020447 vhCDR2
WIDPENGDTEYAPKFQG

SEQ ID NO: 21968 - protein, 9 aa, Artificial Sequence
  Description of Artificial Sequence: Synthetic peptide
  XENP020447 vhCDR3
RGVRQALDY

SEQ ID NO: 21969 - protein, 477 aa, Artificial Sequence; identical to SEQ ID NO: 21729
  Description of Artificial Sequence: Synthetic polypeptide
  XENP020447 2A11_H1L2_Fab-ipilimumab_H3.25_L0.129 scFv-Fc Heavy Chain

SEQ ID NO: 21970 - protein, 118 aa, Artificial Sequence; identical to SEQ ID NO: 2650
  Description of Artificial Sequence: Synthetic polypeptide
  VH of XENP020447

SEQ ID NO: 21971 - protein, 108 aa, Artificial Sequence; identical to SEQ ID NO: 2768
  Description of Artificial Sequence: Synthetic polypeptide
  VL of XENP020447

SEQ ID NO: 21972 - protein, 231 aa, Artificial Sequence; identical to SEQ ID NO: 21532
  Description of Artificial Sequence: Synthetic polypeptide
  Fc chain of XENP020447

SEQ ID NO: 21973 - protein, 5 aa, Artificial Sequence
  Description of Artificial Sequence: Synthetic peptide
  XENP020447 vhCDR1
SYTMH

SEQ ID NO: 21974 - protein, 17 aa, Artificial Sequence
  Description of Artificial Sequence: Synthetic peptide
  XENP020447 vhCDR2
FISYDGNYKYYADSVKG

SEQ ID NO: 21975 - protein, 9 aa, Artificial Sequence
  Description of Artificial Sequence: Synthetic peptide
  XENP020447 vhCDR3
GGLLGPFDL

SEQ ID NO: 21976 - protein, 12 aa, Artificial Sequence
  Description of Artificial Sequence: Synthetic peptide
  XENP020447 vlCDR1
RASQSVGSSYLA

SEQ ID NO: 21977 - protein, 7 aa, Artificial Sequence
  Description of Artificial Sequence: Synthetic peptide
  XENP020447 vlCDR2
GASSRAT

SEQ ID NO: 21978 - protein, 9 aa, Artificial Sequence
  Description of Artificial Sequence: Synthetic peptide
  XENP020447 vlCDR3
QQYGSSPWT

SEQ ID NO: 21979 - protein, 214 aa, Artificial Sequence; identical to SEQ ID NO: 17250
  Description of Artificial Sequence: Synthetic polypeptide
  XENP020447 2A11_H1L2_Fab-ipilimumab_H3.25_L0.129 Light Chain

SEQ ID NO: 21980 - protein, 107 aa, Artificial Sequence; identical to SEQ ID NO: 17251
  Description of Artificial Sequence: Synthetic polypeptide
  VL of XENP020447

SEQ ID NO: 21981 - protein, 11 aa, Artificial Sequence
  Description of Artificial Sequence: Synthetic peptide
  XENP020447 vlCDR1
QASQDIGNYLN

SEQ ID NO: 21982 - protein, 7 aa, Artificial Sequence
  Description of Artificial Sequence: Synthetic peptide
  XENP020447 vlCDR2
YTSRLHS

SEQ ID NO: 21983 - protein, 9 aa, Artificial Sequence
  Description of Artificial Sequence: Synthetic peptide
  XENP020447 vlCDR3
QQGNTLPYT

SEQ ID NO: 21984 - protein, 447 aa, Artificial Sequence; identical to SEQ ID NO: 17235
  Description of Artificial Sequence: Synthetic polypeptide
  XENP020448 2A11_H1L2_Fab-ipilimumab_H3.25_L0.132 Fab-Fc Heavy Chain

SEQ ID NO: 21985 - protein, 118 aa, Artificial Sequence; identical to SEQ ID NO: 17236
  Description of Artificial Sequence: Synthetic polypeptide
  VH of XENP020448

SEQ ID NO: 21986 - protein, 5 aa, Artificial Sequence
  Description of Artificial Sequence: Synthetic peptide
  XENP020448 vhCDR1
DYYMH

SEQ ID NO: 21987 - protein, 17 aa, Artificial Sequence
  Description of Artificial Sequence: Synthetic peptide
  XENP020448 vhCDR2
WIDPENGDTEYAPKFQG

SEQ ID NO: 21988 - protein, 9 aa, Artificial Sequence
  Description of Artificial Sequence: Synthetic peptide
  XENP020448 vhCDR3
RGVRQALDY

SEQ ID NO: 21989 - protein, 477 aa, Artificial Sequence; identical to SEQ ID NO: 21749
  Description of Artificial Sequence: Synthetic polypeptide
  XENP020448 2A11_H1L2_Fab-ipilimumab_H3.25_L0.132 scFv-Fc Heavy Chain

SEQ ID NO: 21990 - protein, 118 aa, Artificial Sequence; identical to SEQ ID NO: 2650
  Description of Artificial Sequence: Synthetic polypeptide
  VH of XENP020448

SEQ ID NO: 21991 - protein, 108 aa, Artificial Sequence; identical to SEQ ID NO: 2795
  Description of Artificial Sequence: Synthetic polypeptide
  VL of XENP020448

SEQ ID NO: 21992 - protein, 231 aa, Artificial Sequence; identical to SEQ ID NO: 21532
  Description of Artificial Sequence: Synthetic polypeptide
  Fc chain of XENP020448

SEQ ID NO: 21993 - protein, 5 aa, Artificial Sequence
  Description of Artificial Sequence: Synthetic peptide
  XENP020448 vhCDR1
SYTMH

SEQ ID NO: 21994 - protein, 17 aa, Artificial Sequence
  Description of Artificial Sequence: Synthetic peptide
  XENP020448 vhCDR2
FISYDGNYKYYADSVKG

SEQ ID NO: 21995 - protein, 9 aa, Artificial Sequence
  Description of Artificial Sequence: Synthetic peptide
  XENP020448 vhCDR3
GGLLGPFDL

SEQ ID NO: 21996 - protein, 12 aa, Artificial Sequence
  Description of Artificial Sequence: Synthetic peptide
  XENP020448 vlCDR1
RASQSVSSSYLA

SEQ ID NO: 21997 - protein, 7 aa, Artificial Sequence
  Description of Artificial Sequence: Synthetic peptide
  XENP020448 vlCDR2
GASSRAT

SEQ ID NO: 21998 - protein, 9 aa, Artificial Sequence
  Description of Artificial Sequence: Synthetic peptide
  XENP020448 vlCDR3
QQYGSSPWT

SEQ ID NO: 21999 - protein, 214 aa, Artificial Sequence; identical to SEQ ID NO: 17250
  Description of Artificial Sequence: Synthetic polypeptide
  XENP020448 2A11_H1L2_Fab-ipilimumab_H3.25_L0.132 Light Chain

SEQ ID NO: 22000 - protein, 107 aa, Artificial Sequence; identical to SEQ ID NO: 17251
  Description of Artificial Sequence: Synthetic polypeptide
  VL of XENP020448

SEQ ID NO: 22001 - protein, 11 aa, Artificial Sequence
  Description of Artificial Sequence: Synthetic peptide
  XENP020448 vlCDR1
QASQDIGNYLN

SEQ ID NO: 22002 - protein, 7 aa, Artificial Sequence
  Description of Artificial Sequence: Synthetic peptide
  XENP020448 vlCDR2
YTSRLHS

SEQ ID NO: 22003 - protein, 9 aa, Artificial Sequence
  Description of Artificial Sequence: Synthetic peptide
  XENP020448 vlCDR3
QQGNTLPYT

SEQ ID NO: 22004 - protein, 447 aa, Artificial Sequence; identical to SEQ ID NO: 21564
  Description of Artificial Sequence: Synthetic polypeptide
  XENP020721 2A11_H1L2_Fab-ipilimumab_H3.4_L0.12 Fab-Fc Heavy Chain

SEQ ID NO: 22005 - protein, 118 aa, Artificial Sequence; identical to SEQ ID NO: 17236
  Description of Artificial Sequence: Synthetic polypeptide
  VH of XENP020721

SEQ ID NO: 22006 - protein, 5 aa, Artificial Sequence
  Description of Artificial Sequence: Synthetic peptide
  XENP020721 vhCDR1
DYYMH

SEQ ID NO: 22007 - protein, 17 aa, Artificial Sequence
  Description of Artificial Sequence: Synthetic peptide
  XENP020721 vhCDR2
WIDPENGDTEYAPKFQG

SEQ ID NO: 22008 - protein, 9 aa, Artificial Sequence
  Description of Artificial Sequence: Synthetic peptide
  XENP020721 vhCDR3
RGVRQALDY

SEQ ID NO: 22009 - protein, 477 aa, Artificial Sequence; identical to SEQ ID NO: 21569
  Description of Artificial Sequence: Synthetic polypeptide
  XENP020721 2A11_H1L2_Fab-ipilimumab_H3.4_L0.12 scFv-Fc Heavy Chain

SEQ ID NO: 22010 - protein, 118 aa, Artificial Sequence; identical to SEQ ID NO: 2461
  Description of Artificial Sequence: Synthetic polypeptide
  VH of XENP020721

SEQ ID NO: 22011 - protein, 108 aa, Artificial Sequence; identical to SEQ ID NO: 1517
  Description of Artificial Sequence: Synthetic polypeptide
  VL of XENP020721

SEQ ID NO: 22012 - protein, 231 aa, Artificial Sequence; identical to SEQ ID NO: 21572
  Description of Artificial Sequence: Synthetic polypeptide
  Fc chain of XENP020721

SEQ ID NO: 22013 - protein, 5 aa, Artificial Sequence
  Description of Artificial Sequence: Synthetic peptide
  XENP020721 vhCDR1
SYTMH

SEQ ID NO: 22014 - protein, 17 aa, Artificial Sequence
  Description of Artificial Sequence: Synthetic peptide
  XENP020721 vhCDR2
FISYDGNHKYYADSVKG

SEQ ID NO: 22015 - protein, 9 aa, Artificial Sequence
  Description of Artificial Sequence: Synthetic peptide
  XENP020721 vhCDR3
TGHLGPFDL

SEQ ID NO: 22016 - protein, 12 aa, Artificial Sequence
  Description of Artificial Sequence: Synthetic peptide
  XENP020721 vlCDR1
RASQSVGSSYLA

SEQ ID NO: 22017 - protein, 7 aa, Artificial Sequence
  Description of Artificial Sequence: Synthetic peptide
  XENP020721 vlCDR2
GAFSRAT

SEQ ID NO: 22018 - protein, 9 aa, Artificial Sequence
  Description of Artificial Sequence: Synthetic peptide
  XENP020721 vlCDR3
QQYGSSPWT

SEQ ID NO: 22019 - protein, 214 aa, Artificial Sequence; identical to SEQ ID NO: 17250
  Description of Artificial Sequence: Synthetic polypeptide
  XENP020721 2A11_H1L2_Fab-ipilimumab_H3.4_L0.12 Light Chain

SEQ ID NO: 22020 - protein, 107 aa, Artificial Sequence; identical to SEQ ID NO: 17251
  Description of Artificial Sequence: Synthetic polypeptide
  VL of XENP020721

SEQ ID NO: 22021 - protein, 11 aa, Artificial Sequence
  Description of Artificial Sequence: Synthetic peptide
  XENP020721 vlCDR1
QASQDIGNYLN

SEQ ID NO: 22022 - protein, 7 aa, Artificial Sequence
  Description of Artificial Sequence: Synthetic peptide
  XENP020721 vlCDR2
YTSRLHS

SEQ ID NO: 22023 - protein, 9 aa, Artificial Sequence
  Description of Artificial Sequence: Synthetic peptide
  XENP020721 vlCDR3
QQGNTLPYT

SEQ ID NO: 22024 - protein, 447 aa, Artificial Sequence; identical to SEQ ID NO: 17235
  Description of Artificial Sequence: Synthetic polypeptide
  XENP021859 2A11_H1_L2.47_Fab-ipilimumab_H3.23_L0.129 Fab-Fc Heavy Chain

SEQ ID NO: 22025 - protein, 118 aa, Artificial Sequence; identical to SEQ ID NO: 17236
  Description of Artificial Sequence: Synthetic polypeptide
  VH of XENP021859

SEQ ID NO: 22026 - protein, 5 aa, Artificial Sequence
  Description of Artificial Sequence: Synthetic peptide
  XENP021859 vhCDR1
DYYMH

SEQ ID NO: 22027 - protein, 17 aa, Artificial Sequence
  Description of Artificial Sequence: Synthetic peptide
  XENP021859 vhCDR2
WIDPENGDTEYAPKFQG

SEQ ID NO: 22028 - protein, 9 aa, Artificial Sequence
  Description of Artificial Sequence: Synthetic peptide
  XENP021859 vhCDR3
RGVRQALDY

SEQ ID NO: 22029 - protein, 477 aa, Artificial Sequence; identical to SEQ ID NO: 21669
  Description of Artificial Sequence: Synthetic polypeptide
  XENP021859 2A11_H1_L2.47_Fab-ipilimumab_H3.23_L0.129 scFv-Fc Heavy Chain

SEQ ID NO: 22030 - protein, 118 aa, Artificial Sequence; identical to SEQ ID NO: 2632
  Description of Artificial Sequence: Synthetic polypeptide
  VH of XENP021859

SEQ ID NO: 22031 - protein, 108 aa, Artificial Sequence; identical to SEQ ID NO: 2768
  Description of Artificial Sequence: Synthetic polypeptide
  VL of XENP021859

SEQ ID NO: 22032 - protein, 231 aa, Artificial Sequence; identical to SEQ ID NO: 21532
  Description of Artificial Sequence: Synthetic polypeptide
  Fc chain of XENP021859

SEQ ID NO: 22033 - protein, 5 aa, Artificial Sequence
  Description of Artificial Sequence: Synthetic peptide
  XENP021859 vhCDR1
SYTMH

SEQ ID NO: 22034 - protein, 17 aa, Artificial Sequence
  Description of Artificial Sequence: Synthetic peptide
  XENP021859 vhCDR2
FISYDGNYKYYADSVKG

SEQ ID NO: 22035 - protein, 9 aa, Artificial Sequence
  Description of Artificial Sequence: Synthetic peptide
  XENP021859 vhCDR3
GGHLGPFDL

SEQ ID NO: 22036 - protein, 12 aa, Artificial Sequence
  Description of Artificial Sequence: Synthetic peptide
  XENP021859 vlCDR1
RASQSVGSSYLA

SEQ ID NO: 22037 - protein, 7 aa, Artificial Sequence
  Description of Artificial Sequence: Synthetic peptide
  XENP021859 vlCDR2
GASSRAT

SEQ ID NO: 22038 - protein, 9 aa, Artificial Sequence
  Description of Artificial Sequence: Synthetic peptide
  XENP021859 vlCDR3
QQYGSSPWT

SEQ ID NO: 22039 - protein, 214 aa, Artificial Sequence
  Description of Artificial Sequence: Synthetic polypeptide
  XENP021859 2A11_H1_L2.47_Fab-ipilimumab_H3.23_L0.129 Light Chain
DIQMTQSPAFLSVTPGEKVTITCQASQDIGNYLNWFQQKPDQTVKLLIYYTSHLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22040 - protein, 107 aa, Artificial Sequence
  Description of Artificial Sequence: Synthetic polypeptide
  VL of XENP021859
DIQMTQSPAFLSVTPGEKVTITCQASQDIGNYLNWFQQKPDQTVKLLIYYTSHLHSGVPSRFSGSGSGTDYTFTISSLEAEDAATYFCQQGNTLPYTFGGGTKVEIK

SEQ ID NO: 22041 - protein, 11 aa, Artificial Sequence
  Description of Artificial Sequence: Synthetic peptide
  XENP021859 vlCDR1
QASQDIGNYLN

SEQ ID NO: 22042 - protein, 7 aa, Artificial Sequence
  Description of Artificial Sequence: Synthetic peptide
  XENP021859 vlCDR2
YTSHLHS

SEQ ID NO: 22043 - protein, 9 aa, Artificial Sequence
  Description of Artificial Sequence: Synthetic peptide
  XENP021859 vlCDR3
QQGNTLPYT

SEQ ID NO: 22044 - protein, 447 aa, Artificial Sequence; identical to SEQ ID NO: 17235
  Description of Artificial Sequence: Synthetic polypeptide
  XENP021860 2A11_H1_L2.50_Fab-ipilimumab_H3.23_L0.129 Fab-Fc Heavy Chain

SEQ ID NO: 22045 - protein, 118 aa, Artificial Sequence; identical to SEQ ID NO: 17236
  Description of Artificial Sequence: Synthetic polypeptide
  VH of XENP021860

SEQ ID NO: 22046 - protein, 5 aa, Artificial Sequence
  Description of Artificial Sequence: Synthetic peptide
  XENP021860 vhCDR1
DYYMH

SEQ ID NO: 22047 - protein, 17 aa, Artificial Sequence
  Description of Artificial Sequence: Synthetic peptide
  XENP021860 vhCDR2
WIDPENGDTEYAPKFQG

SEQ ID NO: 22048 - protein, 9 aa, Artificial Sequence
  Description of Artificial Sequence: Synthetic peptide
  XENP021860 vhCDR3
RGVRQALDY

SEQ ID NO: 22049 - protein, 477 aa, Artificial Sequence; identical to SEQ ID NO: 21669
  Description of Artificial Sequence: Synthetic polypeptide
  XENP021860 2A11_H1_L2.50_Fab-ipilimumab_H3.23_L0.129 scFv-Fc Heavy Chain

SEQ ID NO: 22050 - protein, 118 aa, Artificial Sequence; identical to SEQ ID NO: 2632
  Description of Artificial Sequence: Synthetic polypeptide
  VH of XENP021860

SEQ ID NO: 22051 - protein, 108 aa, Artificial Sequence; identical to SEQ ID NO: 2768
  Description of Artificial Sequence: Synthetic polypeptide
  VL of XENP021860

SEQ ID NO: 22052 - protein, 231 aa, Artificial Sequence; identical to SEQ ID NO: 21532
  Description of Artificial Sequence: Synthetic polypeptide
  Fc chain of XENP021860

SEQ ID NO: 22053 - protein, 5 aa, Artificial Sequence
  Description of Artificial Sequence: Synthetic peptide
  XENP021860 vhCDR1
SYTMH

SEQ ID NO: 22054 - protein, 17 aa, Artificial Sequence
  Description of Artificial Sequence: Synthetic peptide
  XENP021860 vhCDR2
FISYDGNYKYYADSVKG

SEQ ID NO: 22055 - protein, 9 aa, Artificial Sequence
  Description of Artificial Sequence: Synthetic peptide
  XENP021860 vhCDR3
GGHLGPFDL

SEQ ID NO: 22056 - protein, 12 aa, Artificial Sequence
  Description of Artificial Sequence: Synthetic peptide
  XENP021860 vlCDR1
RASQSVGSSYLA

SEQ ID NO: 22057 - protein, 7 aa, Artificial Sequence
  Description of Artificial Sequence: Synthetic peptide
  XENP021860 vlCDR2
GASSRAT

SEQ ID NO: 22058 - protein, 9 aa, Artificial Sequence
  Description of Artificial Sequence: Synthetic peptide
  XENP021860 vlCDR3
QQYGSSPWT

SEQ ID NO: 22059 - protein, 214 aa, Artificial Sequence
  Description of Artificial Sequence: Synthetic polypeptide
  XENP021860 2A11_H1_L2.50_Fab-ipilimumab_H3.23_L0.129 Light Chain
DIQMTQSPAFLSVTPGEKVTITCQASQDIGNYLNWFQQKPDQTVKLLIYYTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22060 - protein, 107 aa, Artificial Sequence
  Description of Artificial Sequence: Synthetic polypeptide
  VL of XENP021860
DIQMTQSPAFLSVTPGEKVTITCQASQDIGNYLNWFQQKPDQTVKLLIYYTSYLHSGVPSRFSGSGSGTDYTFTISSLEAEDAATYFCQQGNTLPYTFGGGTKVEIK

SEQ ID NO: 22061 - protein, 11 aa, Artificial Sequence
  Description of Artificial Sequence: Synthetic peptide
  XENP021860 vlCDR1
QASQDIGNYLN

SEQ ID NO: 22062 - protein, 7 aa, Artificial Sequence
  Description of Artificial Sequence: Synthetic peptide
  XENP021860 vlCDR2
YTSYLHS

SEQ ID NO: 22063 - protein, 9 aa, Artificial Sequence
  Description of Artificial Sequence: Synthetic peptide
  XENP021860 vlCDR3
QQGNTLPYT

SEQ ID NO: 22064 - protein, 447 aa, Artificial Sequence
  Description of Artificial Sequence: Synthetic polypeptide
  XENP022505 2A11_H1.125_L2.113_Fab-ipilimumab_H3.23_L0.129 Fab -Fc Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22065 - protein, 118 aa, Artificial Sequence
  Description of Artificial Sequence: Synthetic polypeptide
  VH of XENP022505
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVYQALDYWGQGTLVTVSS

SEQ ID NO: 22066 - protein, 5 aa, Artificial Sequence
  Description of Artificial Sequence: Synthetic peptide
  XENP022505 vhCDR1
HYFMH

SEQ ID NO: 22067 - protein, 17 aa, Artificial Sequence
  Description of Artificial Sequence: Synthetic peptide
  XENP022505 vhCDR2
WIDPYLGDTEYAPKFQG

SEQ ID NO: 22068 - protein, 9 aa, Artificial Sequence
  Description of Artificial Sequence: Synthetic peptide
  XENP022505 vhCDR3
RGVYQALDY

SEQ ID NO: 22069 - protein, 477 aa, Artificial Sequence; identical to SEQ ID NO: 21669
  Description of Artificial Sequence: Synthetic polypeptide
  XENP022505 2A11_H1.125_L2.113_Fab-ipilimumab_H3.23_L0.129 scFv-Fc Heavy Chain

SEQ ID NO: 22070 - protein, 118 aa, Artificial Sequence; identical to SEQ ID NO: 2632
  Description of Artificial Sequence: Synthetic polypeptide
  VH of XENP022505

SEQ ID NO: 22071 - protein, 108 aa, Artificial Sequence; identical to SEQ ID NO: 2768
  Description of Artificial Sequence: Synthetic polypeptide
  VL of XENP022505

SEQ ID NO: 22072 - protein, 231 aa, Artificial Sequence; identical to SEQ ID NO: 21532
  Description of Artificial Sequence: Synthetic polypeptide
  Fc chain of XENP022505

SEQ ID NO: 22073 - protein, 5 aa, Artificial Sequence
  Description of Artificial Sequence: Synthetic peptide
  XENP022505 vhCDR1
SYTMH

SEQ ID NO: 22074 - protein, 17 aa, Artificial Sequence
  Description of Artificial Sequence: Synthetic peptide
  XENP022505 vhCDR2
FISYDGNYKYYADSVKG

SEQ ID NO: 22075 - protein, 9 aa, Artificial Sequence
  Description of Artificial Sequence: Synthetic peptide
  XENP022505 vhCDR3
GGHLGPFDL

SEQ ID NO: 22076 - protein, 12 aa, Artificial Sequence
  Description of Artificial Sequence: Synthetic peptide
  XENP022505 vlCDR1
RASQSVGSSYLA

SEQ ID NO: 22077 - protein, 7 aa, Artificial Sequence
  Description of Artificial Sequence: Synthetic peptide
  XENP022505 vlCDR2
GASSRAT

SEQ ID NO: 22078 - protein, 9 aa, Artificial Sequence
  Description of Artificial Sequence: Synthetic peptide
  XENP022505 vlCDR3
QQYGSSPWT

SEQ ID NO: 22079 - protein, 214 aa, Artificial Sequence
  Description of Artificial Sequence: Synthetic polypeptide
  XENP022505 2A11_H1.125_L2.113_Fab-ipilimumab_H3.23_L0.129 Light Chain
DIQMTQSPAFLSVTPGEKVTITCQASQDIGNYLNWFQQKPDQTVKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22080 - protein, 107 aa, Artificial Sequence
  Description of Artificial Sequence: Synthetic polypeptide
  VL of XENP022505
DIQMTQSPAFLSVTPGEKVTITCQASQDIGNYLNWFQQKPDQTVKLLIYFTSYLHSGVPSRFSGSGSGTDYTFTISSLEAEDAATYFCQQGNTLPYTFGGGTKVEIK

SEQ ID NO: 22081 - protein, 11 aa, Artificial Sequence
  Description of Artificial Sequence: Synthetic peptide
  XENP022505 vlCDR1
QASQDIGNYLN

SEQ ID NO: 22082 - protein, 7 aa, Artificial Sequence
  Description of Artificial Sequence: Synthetic peptide
  XENP022505 vlCDR2
FTSYLHS

SEQ ID NO: 22083 - protein, 9 aa, Artificial Sequence
  Description of Artificial Sequence: Synthetic peptide
  XENP022505 vlCDR3
QQGNTLPYT

SEQ ID NO: 22084 - protein, 447 aa, Artificial Sequence
  Description of Artificial Sequence: Synthetic polypeptide
  XENP022506 2A11_H1.144_L2.113_Fab-ipilimumab_H3.23_L0.129 Fab-Fc Heavy Chain
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22085 - protein, 118 aa, Artificial Sequence
  Description of Artificial Sequence: Synthetic polypeptide
  VH of XENP022506
EVQLVQSGAEVKKPGATVKISCKASGFNIKDYFMHWVQQAPGKGLEWMGWIDPELGDTEYAPKFQGRVTITADTSTNTAYMELSSLRSEDTAVYYCYARGVYQALDYWGQGTLVTVSS

SEQ ID NO: 22086 - protein, 5 aa, Artificial Sequence
  Description of Artificial Sequence: Synthetic peptide
  XENP022506 vhCDR1
DYFMH

SEQ ID NO: 22087 - protein, 17 aa, Artificial Sequence
  Description of Artificial Sequence: Synthetic peptide
  XENP022506 vhCDR2
WIDPELGDTEYAPKFQG

SEQ ID NO: 22088 - protein, 9 aa, Artificial Sequence
  Description of Artificial Sequence: Synthetic peptide
  XENP022506 vhCDR3
RGVYQALDY

SEQ ID NO: 22089 - protein, 477 aa, Artificial Sequence; identical to SEQ ID NO: 21669
  Description of Artificial Sequence: Synthetic polypeptide
  XENP022506 2A11_H1.144_L2.113_Fab-ipilimumab_H3.23_L0.129 scFv-Fc Heavy Chain

SEQ ID NO: 22090 - protein, 118 aa, Artificial Sequence; identical to SEQ ID NO: 2632
  Description of Artificial Sequence: Synthetic polypeptide
  VH of XENP022506

SEQ ID NO: 22091 - protein, 108 aa, Artificial Sequence; identical to SEQ ID NO: 2768
  Description of Artificial Sequence: Synthetic polypeptide
  VL of XENP022506

SEQ ID NO: 22092 - protein, 231 aa, Artificial Sequence; identical to SEQ ID NO: 21532
  Description of Artificial Sequence: Synthetic polypeptide
  Fc chain of XENP022506

SEQ ID NO: 22093 - protein, 5 aa, Artificial Sequence
  Description of Artificial Sequence: Synthetic peptide
  XENP022506 vhCDR1
SYTMH

SEQ ID NO: 22094 - protein, 17 aa, Artificial Sequence
  Description of Artificial Sequence: Synthetic peptide
  XENP022506 vhCDR2
FISYDGNYKYYADSVKG

SEQ ID NO: 22095 - protein, 9 aa, Artificial Sequence
  Description of Artificial Sequence: Synthetic peptide
  XENP022506 vhCDR3
GGHLGPFDL

SEQ ID NO: 22096 - protein, 12 aa, Artificial Sequence
  Description of Artificial Sequence: Synthetic peptide
  XENP022506 vlCDR1
RASQSVGSSYLA

SEQ ID NO: 22097 - protein, 7 aa, Artificial Sequence
  Description of Artificial Sequence: Synthetic peptide
  XENP022506 vlCDR2
GASSRAT

SEQ ID NO: 22098 - protein, 9 aa, Artificial Sequence
  Description of Artificial Sequence: Synthetic peptide
  XENP022506 vlCDR3
QQYGSSPWT

SEQ ID NO: 22099 - protein, 214 aa, Artificial Sequence; identical to SEQ ID NO: 22079
  Description of Artificial Sequence: Synthetic polypeptide
  XENP022506 2A11_H1.144_L2.113_Fab-ipilimumab_H3.23_L0.129 Light Chain

SEQ ID NO: 22100 - protein, 107 aa, Artificial Sequence; identical to SEQ ID NO: 22080
  Description of Artificial Sequence: Synthetic polypeptide
  VL of XENP022506

SEQ ID NO: 22101 - protein, 11 aa, Artificial Sequence
  Description of Artificial Sequence: Synthetic peptide
  XENP022506 vlCDR1
QASQDIGNYLN

SEQ ID NO: 22102 - protein, 7 aa, Artificial Sequence
  Description of Artificial Sequence: Synthetic peptide
  XENP022506 vlCDR2
FTSYLHS

SEQ ID NO: 22103 - protein, 9 aa, Artificial Sequence
  Description of Artificial Sequence: Synthetic peptide
  XENP022506 vlCDR3
QQGNTLPYT

SEQ ID NO: 22104 - protein, 447 aa, Artificial Sequence
  Description of Artificial Sequence: Synthetic polypeptide
  XENP022507 2A11_H1.117_L2.116_Fab-ipilimumab_H3.23_L0.129 Fab-Fc Heavy Chain
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22105 - protein, 118 aa, Artificial Sequence
  Description of Artificial Sequence: Synthetic polypeptide
  VH of XENP022507
EVQLVQSGAEVKKPGATVKISCKASGFNIKHYFMHWVQQAPGKGLEWMGWIDPYLGDTEYAPKFQGRVTITADTSTNTAYMELSSLRSEDTAVYYCYARGVRQALDYWGQGTLVTVSS

SEQ ID NO: 22106 - protein, 5 aa, Artificial Sequence
  Description of Artificial Sequence: Synthetic peptide
  XENP022507 vhCDR1
HYFMH

SEQ ID NO: 22107 - protein, 17 aa, Artificial Sequence
  Description of Artificial Sequence: Synthetic peptide
  XENP022507 vhCDR2
WIDPYLGDTEYAPKFQG

SEQ ID NO: 22108 - protein, 9 aa, Artificial Sequence
  Description of Artificial Sequence: Synthetic peptide
  XENP022507 vhCDR3
RGVRQALDY

SEQ ID NO: 22109 - protein, 477 aa, Artificial Sequence; identical to SEQ ID NO: 21669
  Description of Artificial Sequence: Synthetic polypeptide
  XENP022507 2A11_H1.117_L2.116_Fab-ipilimumab_H3.23_L0.129 scFv-Fc Heavy Chain

SEQ ID NO: 22110 - protein, 118 aa, Artificial Sequence; identical to SEQ ID NO: 2632
  Description of Artificial Sequence: Synthetic polypeptide
  VH of XENP022507

SEQ ID NO: 22111 - protein, 108 aa, Artificial Sequence; identical to SEQ ID NO: 2768
  Description of Artificial Sequence: Synthetic polypeptide
  VL of XENP022507

SEQ ID NO: 22112 - protein, 231 aa, Artificial Sequence; identical to SEQ ID NO: 21532
  Description of Artificial Sequence: Synthetic polypeptide
  Fc chain of XENP022507

SEQ ID NO: 22113 - protein, 5 aa, Artificial Sequence
  Description of Artificial Sequence: Synthetic peptide
  XENP022507 vhCDR1
SYTMH

SEQ ID NO: 22114 - protein, 17 aa, Artificial Sequence
  Description of Artificial Sequence: Synthetic peptide
  XENP022507 vhCDR2
FISYDGNYKYYADSVKG

SEQ ID NO: 22115 - protein, 9 aa, Artificial Sequence
  Description of Artificial Sequence: Synthetic peptide
  XENP022507 vhCDR3
GGHLGPFDL

SEQ ID NO: 22116 - protein, 12 aa, Artificial Sequence
  Description of Artificial Sequence: Synthetic peptide
  XENP022507 vlCDR1
RASQSVGSSYLA

SEQ ID NO: 22117 - protein, 7 aa, Artificial Sequence
  Description of Artificial Sequence: Synthetic peptide
  XENP022507 vlCDR2
GASSRAT

SEQ ID NO: 22118 - protein, 9 aa, Artificial Sequence
  Description of Artificial Sequence: Synthetic peptide
  XENP022507 vlCDR3
QQYGSSPWT

SEQ ID NO: 22119 - protein, 214 aa, Artificial Sequence
  Description of Artificial Sequence: Synthetic polypeptide
  XENP022507 2A11_H1.117_L2.116_Fab-ipilimumab_H3.23_L0.129 Light Chain
DIQMTQSPAFLSVTPGEKVTITCQASQDIGNYLNWFQQKPDQTVKLLIYFTSHLHSGVPSRFSGSGSGTDYTFTISSLEAEDAATYFCQQGHQLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22120 - protein, 107 aa, Artificial Sequence
  Description of Artificial Sequence: Synthetic polypeptide
  VL of XENP022507
DIQMTQSPAFLSVTPGEKVTITCQASQDIGNYLNWFQQKPDQTVKLLIYFTSHLHSGVPSRFSGSGSGTDYTFTISSLEAEDAATYFCQQGHQLPYTFGGGTKVEIK

SEQ ID NO: 22121 - protein, 11 aa, Artificial Sequence
  Description of Artificial Sequence: Synthetic peptide
  XENP022507 vlCDR1
QASQDIGNYLN

SEQ ID NO: 22122 - protein, 7 aa, Artificial Sequence
  Description of Artificial Sequence: Synthetic peptide
  XENP022507 vlCDR2
FTSHLHS

SEQ ID NO: 22123 - protein, 9 aa, Artificial Sequence
  Description of Artificial Sequence: Synthetic peptide
  XENP022507 vlCDR3
QQGHQLPYT

SEQ ID NO: 22124 - protein, 447 aa, Artificial Sequence; identical to SEQ ID NO: 22084
  Description of Artificial Sequence: Synthetic polypeptide
  XENP022508 2A11_H1.144_L2_Fab-ipilimumab_H3.23_L0.129 Fab- Fc Heavy Chain

SEQ ID NO: 22125 - protein, 118 aa, Artificial Sequence; identical to SEQ ID NO: 22085
  Description of Artificial Sequence: Synthetic polypeptide
  VH of XENP022508

SEQ ID NO: 22126 - protein, 5 aa, Artificial Sequence
  Description of Artificial Sequence: Synthetic peptide
  XENP022508 vhCDR1
DYFMH

SEQ ID NO: 22127 - protein, 17 aa, Artificial Sequence
  Description of Artificial Sequence: Synthetic peptide
  XENP022508 vhCDR2
WIDPELGDTEYAPKFQG

SEQ ID NO: 22128 - protein, 9 aa, Artificial Sequence
  Description of Artificial Sequence: Synthetic peptide
  XENP022508 vhCDR3
RGVYQALDY

SEQ ID NO: 22129 - protein, 477 aa, Artificial Sequence; identical to SEQ ID NO: 21669
  Description of Artificial Sequence: Synthetic polypeptide
  XENP022508 2A11_H1.144_L2_Fab-ipilimumab_H3.23_L0.129 scFv -Fc Heavy Chain

SEQ ID NO: 22130 - protein, 118 aa, Artificial Sequence; identical to SEQ ID NO: 2632
  Description of Artificial Sequence: Synthetic polypeptide
  VH of XENP022508

SEQ ID NO: 22131 - protein, 108 aa, Artificial Sequence; identical to SEQ ID NO: 2768
  Description of Artificial Sequence: Synthetic polypeptide
  VL of XENP022508

SEQ ID NO: 22132 - protein, 231 aa, Artificial Sequence; identical to SEQ ID NO: 21532
  Description of Artificial Sequence: Synthetic polypeptide
  Fc chain of XENP022508

SEQ ID NO: 22133 - protein, 5 aa, Artificial Sequence
  Description of Artificial Sequence: Synthetic peptide
  XENP022508 vhCDR1
SYTMH

SEQ ID NO: 22134 - protein, 17 aa, Artificial Sequence
  Description of Artificial Sequence: Synthetic peptide
  XENP022508 vhCDR2
FISYDGNYKYYADSVKG

SEQ ID NO: 22135 - protein, 9 aa, Artificial Sequence
  Description of Artificial Sequence: Synthetic peptide
  XENP022508 vhCDR3
GGHLGPFDL

SEQ ID NO: 22136 - protein, 12 aa, Artificial Sequence
  Description of Artificial Sequence: Synthetic peptide
  XENP022508 vlCDR1
RASQSVGSSYLA

SEQ ID NO: 22137 - protein, 7 aa, Artificial Sequence
  Description of Artificial Sequence: Synthetic peptide
  XENP022508 vlCDR2
GASSRAT

SEQ ID NO: 22138 - protein, 9 aa, Artificial Sequence
  Description of Artificial Sequence: Synthetic peptide
  XENP022508 vlCDR3
QQYGSSPWT

SEQ ID NO: 22139 - protein, 214 aa, Artificial Sequence; identical to SEQ ID NO: 17250
  Description of Artificial Sequence: Synthetic polypeptide
  XENP022508 2A11_H1.144_L2_Fab-ipilimumab_H3.23_L0.129 Light Chain

SEQ ID NO: 22140 - protein, 107 aa, Artificial Sequence; identical to SEQ ID NO: 17251
  Description of Artificial Sequence: Synthetic polypeptide
  VL of XENP022508

SEQ ID NO: 22141 - protein, 11 aa, Artificial Sequence
  Description of Artificial Sequence: Synthetic peptide
  XENP022508 vlCDR1
QASQDIGNYLN

SEQ ID NO: 22142 - protein, 7 aa, Artificial Sequence
  Description of Artificial Sequence: Synthetic peptide
  XENP022508 vlCDR2
YTSRLHS

SEQ ID NO: 22143 - protein, 9 aa, Artificial Sequence
  Description of Artificial Sequence: Synthetic peptide
  XENP022508 vlCDR3
QQGNTLPYT

SEQ ID NO: 22144 - protein, 447 aa, Artificial Sequence; identical to SEQ ID NO: 17235
  Description of Artificial Sequence: Synthetic polypeptide
  XENP022509 2A11_H1_L2.113_Fab-ipilimumab_H3.23_L0.129 Fab- Fc Heavy Chain

SEQ ID NO: 22145 - protein, 118 aa, Artificial Sequence; identical to SEQ ID NO: 17236
  Description of Artificial Sequence: Synthetic polypeptide
  VH of XENP022509

SEQ ID NO: 22146 - protein, 5 aa, Artificial Sequence
  Description of Artificial Sequence: Synthetic peptide
  XENP022509 vhCDR1
DYYMH

SEQ ID NO: 22147 - protein, 17 aa, Artificial Sequence
  Description of Artificial Sequence: Synthetic peptide
  XENP022509 vhCDR2
WIDPENGDTEYAPKFQG

SEQ ID NO: 22148 - protein, 9 aa, Artificial Sequence
  Description of Artificial Sequence: Synthetic peptide
  XENP022509 vhCDR3
RGVRQALDY

SEQ ID NO: 22149 - protein, 477 aa, Artificial Sequence; identical to SEQ ID NO: 21669
  Description of Artificial Sequence: Synthetic polypeptide
  XENP022509 2A11_H1_L2.113_Fab-ipilimumab_H3.23_L0.129 scFv- Fc Heavy Chain

SEQ ID NO: 22150 - protein, 118 aa, Artificial Sequence; identical to SEQ ID NO: 2632
  Description of Artificial Sequence: Synthetic polypeptide
  VH of XENP022509

SEQ ID NO: 22151 - protein, 108 aa, Artificial Sequence; identical to SEQ ID NO: 2768
  Description of Artificial Sequence: Synthetic polypeptide
  VL of XENP022509

SEQ ID NO: 22152 - protein, 231 aa, Artificial Sequence; identical to SEQ ID NO: 21532
  Description of Artificial Sequence: Synthetic polypeptide
  Fc chain of XENP022509

SEQ ID NO: 22153 - protein, 5 aa, Artificial Sequence
  Description of Artificial Sequence: Synthetic peptide
  XENP022509 vhCDR1
SYTMH

SEQ ID NO: 22154 - protein, 17 aa, Artificial Sequence
  Description of Artificial Sequence: Synthetic peptide
  XENP022509 vhCDR2
FISYDGNYKYYADSVKG

SEQ ID NO: 22155 - protein, 9 aa, Artificial Sequence
  Description of Artificial Sequence: Synthetic peptide
  XENP022509 vhCDR3
GGHLGPFDL

SEQ ID NO: 22156 - protein, 12 aa, Artificial Sequence
  Description of Artificial Sequence: Synthetic peptide
  XENP022509 vlCDR1
RASQSVGSSYLA

SEQ ID NO: 22157 - protein, 7 aa, Artificial Sequence
  Description of Artificial Sequence: Synthetic peptide
  XENP022509 vlCDR2
GASSRAT

SEQ ID NO: 22158 - protein, 9 aa, Artificial Sequence
  Description of Artificial Sequence: Synthetic peptide
  XENP022509 vlCDR3
QQYGSSPWT

SEQ ID NO: 22159 - protein, 214 aa, Artificial Sequence; identical to SEQ ID NO: 22079
  Description of Artificial Sequence: Synthetic polypeptide
  XENP022509 2A11_H1_L2.113_Fab-ipilimumab_H3.23_L0.129 Light Chain

SEQ ID NO: 22160 - protein, 107 aa, Artificial Sequence; identical to SEQ ID NO: 22080
  Description of Artificial Sequence: Synthetic polypeptide
  VL of XENP022509

SEQ ID NO: 22161 - protein, 11 aa, Artificial Sequence
  Description of Artificial Sequence: Synthetic peptide
  XENP022509 vlCDR1
QASQDIGNYLN

SEQ ID NO: 22162 - protein, 7 aa, Artificial Sequence
  Description of Artificial Sequence: Synthetic peptide
  XENP022509 vlCDR2
FTSYLHS

SEQ ID NO: 22163 - protein, 9 aa, Artificial Sequence
  Description of Artificial Sequence: Synthetic peptide
  XENP022509 vlCDR3
QQGNTLPYT

SEQ ID NO: 22164 - protein, 447 aa, Artificial Sequence; identical to SEQ ID NO: 17235
  Description of Artificial Sequence: Synthetic polypeptide
  XENP022510 2A11_H1_L2.25_Fab-ipilimumab_H3.23_L0.129 Fab-Fc Heavy Chain

SEQ ID NO: 22165 - protein, 118 aa, Artificial Sequence; identical to SEQ ID NO: 17236
  Description of Artificial Sequence: Synthetic polypeptide
  VH of XENP022510

SEQ ID NO: 22166 - protein, 5 aa, Artificial Sequence
  Description of Artificial Sequence: Synthetic peptide
  XENP022510 vhCDR1
DYYMH

SEQ ID NO: 22167 - protein, 17 aa, Artificial Sequence
  Description of Artificial Sequence: Synthetic peptide
  XENP022510 vhCDR2
WIDPENGDTEYAPKFQG

SEQ ID NO: 22168 - protein, 9 aa, Artificial Sequence
  Description of Artificial Sequence: Synthetic peptide
  XENP022510 vhCDR3
RGVRQALDY

SEQ ID NO: 22169 - protein, 477 aa, Artificial Sequence; identical to SEQ ID NO: 21669
  Description of Artificial Sequence: Synthetic polypeptide
  XENP022510 2A11_H1_L2.25_Fab-ipilimumab_H3.23_L0.129 scFv-Fc Heavy Chain

SEQ ID NO: 22170 - protein, 118 aa, Artificial Sequence; identical to SEQ ID NO: 2632
  Description of Artificial Sequence: Synthetic polypeptide
  VH of XENP022510

SEQ ID NO: 22171 - protein, 108 aa, Artificial Sequence; identical to SEQ ID NO: 2768
  Description of Artificial Sequence: Synthetic polypeptide
  VL of XENP022510

SEQ ID NO: 22172 - protein, 231 aa, Artificial Sequence; identical to SEQ ID NO: 21532
  Description of Artificial Sequence: Synthetic polypeptide
  Fc chain of XENP022510

SEQ ID NO: 22173 - protein, 5 aa, Artificial Sequence
  Description of Artificial Sequence: Synthetic peptide
  XENP022510 vhCDR1
SYTMH

SEQ ID NO: 22174 - protein, 17 aa, Artificial Sequence
  Description of Artificial Sequence: Synthetic peptide
  XENP022510 vhCDR2
FISYDGNYKYYADSVKG

SEQ ID NO: 22175 - protein, 9 aa, Artificial Sequence
  Description of Artificial Sequence: Synthetic peptide
  XENP022510 vhCDR3
GGHLGPFDL

SEQ ID NO: 22176 - protein, 12 aa, Artificial Sequence
  Description of Artificial Sequence: Synthetic peptide
  XENP022510 vlCDR1
RASQSVGSSYLA

SEQ ID NO: 22177 - protein, 7 aa, Artificial Sequence
  Description of Artificial Sequence: Synthetic peptide
  XENP022510 vlCDR2
GASSRAT

SEQ ID NO: 22178 - protein, 9 aa, Artificial Sequence
  Description of Artificial Sequence: Synthetic peptide
  XENP022510 vlCDR3
QQYGSSPWT

SEQ ID NO: 22179 - protein, 214 aa, Artificial Sequence
  Description of Artificial Sequence: Synthetic polypeptide
  XENP022510 2A11_H1_L2.25_Fab-ipilimumab_H3.23_L0.129 Light Chain
DIQMTQSPAFLSVTPGEKVTITCQASQDIGNHLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22180 - protein, 107 aa, Artificial Sequence
  Description of Artificial Sequence: Synthetic polypeptide
  VL of XENP022510
DIQMTQSPAFLSVTPGEKVTITCQASQDIGNHLNWFQQKPDQTVKLLIYYTSRLHSGVPSRFSGSGSGTDYTFTISSLEAEDAATYFCQQGNTLPYTFGGGTKVEIK

SEQ ID NO: 22181 - protein, 11 aa, Artificial Sequence
  Description of Artificial Sequence: Synthetic peptide
  XENP022510 vlCDR1
QASQDIGNHLN

SEQ ID NO: 22182 - protein, 7 aa, Artificial Sequence
  Description of Artificial Sequence: Synthetic peptide
  XENP022510 vlCDR2
YTSRLHS

SEQ ID NO: 22183 - protein, 9 aa, Artificial Sequence
  Description of Artificial Sequence: Synthetic peptide
  XENP022510 vlCDR3
QQGNTLPYT

SEQ ID NO: 22184 - protein, 447 aa, Artificial Sequence; identical to SEQ ID NO: 22084
  Description of Artificial Sequence: Synthetic polypeptide
  XENP022518 2A11_H1.144_L2.133_Fab-ipilimumab_H3.23_L0.129 Fab-Fc Heavy Chain

SEQ ID NO: 22185 - protein, 118 aa, Artificial Sequence; identical to SEQ ID NO: 22085
  Description of Artificial Sequence: Synthetic polypeptide
  VH of XENP022518

SEQ ID NO: 22186 - protein, 5 aa, Artificial Sequence
  Description of Artificial Sequence: Synthetic peptide
  XENP022518 vhCDR1
DYFMH

SEQ ID NO: 22187 - protein, 17 aa, Artificial Sequence
  Description of Artificial Sequence: Synthetic peptide
  XENP022518 vhCDR2
WIDPELGDTEYAPKFQG

SEQ ID NO: 22188 - protein, 9 aa, Artificial Sequence
  Description of Artificial Sequence: Synthetic peptide
  XENP022518 vhCDR3
RGVYQALDY

SEQ ID NO: 22189 - protein, 477 aa, Artificial Sequence; identical to SEQ ID NO: 21669
  Description of Artificial Sequence: Synthetic polypeptide
  XENP022518 2A11_H1.144_L2.133_Fab-ipilimumab_H3.23_L0.129 scFv-Fc Heavy Chain

SEQ ID NO: 22190 - protein, 118 aa, Artificial Sequence; identical to SEQ ID NO: 2632
  Description of Artificial Sequence: Synthetic polypeptide
  VH of XENP022518

SEQ ID NO: 22191 - protein, 108 aa, Artificial Sequence; identical to SEQ ID NO: 2768
  Description of Artificial Sequence: Synthetic polypeptide
  VL of XENP022518

SEQ ID NO: 22192 - protein, 231 aa, Artificial Sequence; identical to SEQ ID NO: 21532
  Description of Artificial Sequence: Synthetic polypeptide
  Fc chain of XENP022518

SEQ ID NO: 22193 - protein, 5 aa, Artificial Sequence
  Description of Artificial Sequence: Synthetic peptide
  XENP022518 vhCDR1
SYTMH

SEQ ID NO: 22194 - protein, 17 aa, Artificial Sequence
  Description of Artificial Sequence: Synthetic peptide
  XENP022518 vhCDR2
FISYDGNYKYYADSVKG

SEQ ID NO: 22195 - protein, 9 aa, Artificial Sequence
  Description of Artificial Sequence: Synthetic peptide
  XENP022518 vhCDR3
GGHLGPFDL

SEQ ID NO: 22196 - protein, 12 aa, Artificial Sequence
  Description of Artificial Sequence: Synthetic peptide
  XENP022518 vlCDR1
RASQSVGSSYLA

SEQ ID NO: 22197 - protein, 7 aa, Artificial Sequence
  Description of Artificial Sequence: Synthetic peptide
  XENP022518 vlCDR2
GASSRAT

SEQ ID NO: 22198 - protein, 9 aa, Artificial Sequence
  Description of Artificial Sequence: Synthetic peptide
  XENP022518 vlCDR3
QQYGSSPWT

SEQ ID NO: 22199 - protein, 214 aa, Artificial Sequence
  Description of Artificial Sequence: Synthetic polypeptide
  XENP022518 2A11_H1.144_L2.133_Fab-ipilimumab_H3.23_L0.129 Light Chain
DIQMTQSPAFLSVTPGEKVTITCQASQDIGNYLNWFQQKPDQTPKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22200 - protein, 107 aa, Artificial Sequence
  Description of Artificial Sequence: Synthetic polypeptide
  VL of XENP022518
DIQMTQSPAFLSVTPGEKVTITCQASQDIGNYLNWFQQKPDQTPKLLIYFTSYLHSGVPSRFSGSGSGTDYTFTISSLEAEDAATYFCQEGNTLPYTFGGGTKVEIK

SEQ ID NO: 22201 - protein, 11 aa, Artificial Sequence
  Description of Artificial Sequence: Synthetic peptide
  XENP022518 vlCDR1
QASQDIGNYLN

SEQ ID NO: 22202 - protein, 7 aa, Artificial Sequence
  Description of Artificial Sequence: Synthetic peptide
  XENP022518 vlCDR2
FTSYLHS

SEQ ID NO: 22203 - protein, 9 aa, Artificial Sequence
  Description of Artificial Sequence: Synthetic peptide
  XENP022518 vlCDR3
QEGNTLPYT

SEQ ID NO: 22204 - protein, 447 aa, Artificial Sequence; identical to SEQ ID NO: 22064
  Description of Artificial Sequence: Synthetic polypeptide
  XENP022625 2A11_H1.125_L2.132_Fab-ipilimumab_H3.23_L0.129 Fab-Fc Heavy Chain

SEQ ID NO: 22205 - protein, 118 aa, Artificial Sequence; identical to SEQ ID NO: 22065
  Description of Artificial Sequence: Synthetic polypeptide
  VH of XENP022625

SEQ ID NO: 22206 - protein, 5 aa, Artificial Sequence
  Description of Artificial Sequence: Synthetic peptide
  XENP022625 vhCDR1
HYFMH

SEQ ID NO: 22207 - protein, 17 aa, Artificial Sequence
  Description of Artificial Sequence: Synthetic peptide
  XENP022625 vhCDR2
WIDPYLGDTEYAPKFQG

SEQ ID NO: 22208 - protein, 9 aa, Artificial Sequence
  Description of Artificial Sequence: Synthetic peptide
  XENP022625 vhCDR3
RGVYQALDY

SEQ ID NO: 22209 - protein, 477 aa, Artificial Sequence; identical to SEQ ID NO: 21669
  Description of Artificial Sequence: Synthetic polypeptide
  XENP022625 2A11_H1.125_L2.132_Fab-ipilimumab_H3.23_L0.129 scFv-Fc Heavy Chain

SEQ ID NO: 22210 - protein, 118 aa, Artificial Sequence; identical to SEQ ID NO: 2632
  Description of Artificial Sequence: Synthetic polypeptide
  VH of XENP022625

SEQ ID NO: 22211 - protein, 108 aa, Artificial Sequence; identical to SEQ ID NO: 2768
  Description of Artificial Sequence: Synthetic polypeptide
  VL of XENP022625

SEQ ID NO: 22212 - protein, 231 aa, Artificial Sequence; identical to SEQ ID NO: 21532
  Description of Artificial Sequence: Synthetic polypeptide
  Fc chain of XENP022625

SEQ ID NO: 22213 - protein, 5 aa, Artificial Sequence
  Description of Artificial Sequence: Synthetic peptide
  XENP022625 vhCDR1
SYTMH

SEQ ID NO: 22214 - protein, 17 aa, Artificial Sequence
  Description of Artificial Sequence: Synthetic peptide
  XENP022625 vhCDR2
FISYDGNYKYYADSVKG

SEQ ID NO: 22215 - protein, 9 aa, Artificial Sequence
  Description of Artificial Sequence: Synthetic peptide
  XENP022625 vhCDR3
GGHLGPFDL

SEQ ID NO: 22216 - protein, 12 aa, Artificial Sequence
  Description of Artificial Sequence: Synthetic peptide
  XENP022625 vlCDR1
RASQSVGSSYLA

SEQ ID NO: 22217 - protein, 7 aa, Artificial Sequence
  Description of Artificial Sequence: Synthetic peptide
  XENP022625 vlCDR2
GASSRAT

SEQ ID NO: 22218 - protein, 9 aa, Artificial Sequence
  Description of Artificial Sequence: Synthetic peptide
  XENP022625 vlCDR3
QQYGSSPWT

SEQ ID NO: 22219 - protein, 214 aa, Artificial Sequence
  Description of Artificial Sequence: Synthetic polypeptide
  XENP022625 2A11_H1.125_L2.132_Fab-ipilimumab_H3.23_L0.129 Light Chain
DIQMTQSPAFLSVTPGEKVTITCQASQDIGNYLNWFQQKPGQTVKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22220 - protein, 107 aa, Artificial Sequence
  Description of Artificial Sequence: Synthetic polypeptide
  VL of XENP022625
DIQMTQSPAFLSVTPGEKVTITCQASQDIGNYLNWFQQKPGQTVKLLIYFTSYLHSGVPSRFSGSGSGTDYTFTISSLEAEDAATYFCQEGNTLPYTFGGGTKVEIK

SEQ ID NO: 22221 - protein, 11 aa, Artificial Sequence
  Description of Artificial Sequence: Synthetic peptide
  XENP022625 vlCDR1
QASQDIGNYLN

SEQ ID NO: 22222 - protein, 7 aa, Artificial Sequence
  Description of Artificial Sequence: Synthetic peptide
  XENP022625 vlCDR2
FTSYLHS

SEQ ID NO: 22223 - protein, 9 aa, Artificial Sequence
  Description of Artificial Sequence: Synthetic peptide
  XENP022625 vlCDR3
QEGNTLPYT

SEQ ID NO: 22224 - protein, 447 aa, Artificial Sequence; identical to SEQ ID NO: 22084
  Description of Artificial Sequence: Synthetic polypeptide
  XENP022630 2A11_H1.144_L2.137_Fab-ipilimumab_H3.23_L0.129 Fab-Fc Heavy Chain

SEQ ID NO: 22225 - protein, 118 aa, Artificial Sequence; identical to SEQ ID NO: 22085
  Description of Artificial Sequence: Synthetic polypeptide
  VH of XENP022630

SEQ ID NO: 22226 - protein, 5 aa, Artificial Sequence
  Description of Artificial Sequence: Synthetic peptide
  XENP022630 vhCDR1
DYFMH

SEQ ID NO: 22227 - protein, 17 aa, Artificial Sequence
  Description of Artificial Sequence: Synthetic peptide
  XENP022630 vhCDR2
WIDPELGDTEYAPKFQG

SEQ ID NO: 22228 - protein, 9 aa, Artificial Sequence
  Description of Artificial Sequence: Synthetic peptide
  XENP022630 vhCDR3
RGVYQALDY

SEQ ID NO: 22229 - protein, 477 aa, Artificial Sequence; identical to SEQ ID NO: 21669
  Description of Artificial Sequence: Synthetic polypeptide
  XENP022630 2A11_H1.144_L2.137_Fab-ipilimumab_H3.23_L0.129 scFv-Fc Heavy Chain

SEQ ID NO: 22230 - protein, 118 aa, Artificial Sequence; identical to SEQ ID NO: 2632
  Description of Artificial Sequence: Synthetic polypeptide
  VH of XENP022630

SEQ ID NO: 22231 - protein, 108 aa, Artificial Sequence; identical to SEQ ID NO: 2768
  Description of Artificial Sequence: Synthetic polypeptide
  VL of XENP022630

SEQ ID NO: 22232 - protein, 231 aa, Artificial Sequence; identical to SEQ ID NO: 21532
  Description of Artificial Sequence: Synthetic polypeptide
  Fc chain of XENP022630

SEQ ID NO: 22233 - protein, 5 aa, Artificial Sequence
  Description of Artificial Sequence: Synthetic peptide
  XENP022630 vhCDR1
SYTMH

SEQ ID NO: 22234 - protein, 17 aa, Artificial Sequence
  Description of Artificial Sequence: Synthetic peptide
  XENP022630 vhCDR2
FISYDGNYKYYADSVKG

SEQ ID NO: 22235 - protein, 9 aa, Artificial Sequence
  Description of Artificial Sequence: Synthetic peptide
  XENP022630 vhCDR3
GGHLGPFDL

SEQ ID NO: 22236 - protein, 12 aa, Artificial Sequence
  Description of Artificial Sequence: Synthetic peptide
  XENP022630 vlCDR1
RASQSVGSSYLA

SEQ ID NO: 22237 - protein, 7 aa, Artificial Sequence
  Description of Artificial Sequence: Synthetic peptide
  XENP022630 vlCDR2
GASSRAT

SEQ ID NO: 22238 - protein, 9 aa, Artificial Sequence
  Description of Artificial Sequence: Synthetic peptide
  XENP022630 vlCDR3
QQYGSSPWT

SEQ ID NO: 22239 - protein, 214 aa, Artificial Sequence
  Description of Artificial Sequence: Synthetic polypeptide
  XENP022630 2A11_H1.144_L2.137_Fab-ipilimumab_H3.23_L0.129 Light Chain
DIQMTQSPAFLSVTPGEKVTITCQASQDIGNYLNWFQQKPGKVPKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22240 - protein, 107 aa, Artificial Sequence
  Description of Artificial Sequence: Synthetic polypeptide
  VL of XENP022630
DIQMTQSPAFLSVTPGEKVTITCQASQDIGNYLNWFQQKPGKVPKLLIYFTSYLHSGVPSRFSGSGSGTDYTFTISSLEAEDAATYFCQEGNTLPYTFGGGTKVEIK

SEQ ID NO: 22241 - protein, 11 aa, Artificial Sequence
  Description of Artificial Sequence: Synthetic peptide
  XENP022630 vlCDR1
QASQDIGNYLN

SEQ ID NO: 22242 - protein, 7 aa, Artificial Sequence
  Description of Artificial Sequence: Synthetic peptide
  XENP022630 vlCDR2
FTSYLHS

SEQ ID NO: 22243 - protein, 9 aa, Artificial Sequence
  Description of Artificial Sequence: Synthetic peptide
  XENP022630 vlCDR3
QEGNTLPYT

SEQ ID NO: 22244 - protein, 447 aa, Artificial Sequence; identical to SEQ ID NO: 22064
  Description of Artificial Sequence: Synthetic polypeptide
  XENP022673 2A11_H1.125_L2.126_Fab-ipilimumab_H3.23_L0.129 Fab-Fc Heavy Chain

SEQ ID NO: 22245 - protein, 118 aa, Artificial Sequence; identical to SEQ ID NO: 22065
  Description of Artificial Sequence: Synthetic polypeptide
  VH of XENP022673

SEQ ID NO: 22246 - protein, 5 aa, Artificial Sequence
  Description of Artificial Sequence: Synthetic peptide
  XENP022673 vhCDR1
HYFMH

SEQ ID NO: 22247 - protein, 17 aa, Artificial Sequence
  Description of Artificial Sequence: Synthetic peptide
  XENP022673 vhCDR2
WIDPYLGDTEYAPKFQG

SEQ ID NO: 22248 - protein, 9 aa, Artificial Sequence
  Description of Artificial Sequence: Synthetic peptide
  XENP022673 vhCDR3
RGVYQALDY

SEQ ID NO: 22249 - protein, 477 aa, Artificial Sequence; identical to SEQ ID NO: 21669
  Description of Artificial Sequence: Synthetic polypeptide
  XENP022673 2A11_H1.125_L2.126_Fab-ipilimumab_H3.23_L0.129 scFv-Fc Heavy Chain

SEQ ID NO: 22250 - protein, 118 aa, Artificial Sequence; identical to SEQ ID NO: 2632
  Description of Artificial Sequence: Synthetic polypeptide
  VH of XENP022673

SEQ ID NO: 22251 - protein, 108 aa, Artificial Sequence; identical to SEQ ID NO: 2768
  Description of Artificial Sequence: Synthetic polypeptide
  VL of XENP022673

SEQ ID NO: 22252 - protein, 231 aa, Artificial Sequence; identical to SEQ ID NO: 21532
  Description of Artificial Sequence: Synthetic polypeptide
  Fc chain of XENP022673

SEQ ID NO: 22253 - protein, 5 aa, Artificial Sequence
  Description of Artificial Sequence: Synthetic peptide
  XENP022673 vhCDR1
SYTMH

SEQ ID NO: 22254 - protein, 17 aa, Artificial Sequence
  Description of Artificial Sequence: Synthetic peptide
  XENP022673 vhCDR2
FISYDGNYKYYADSVKG

SEQ ID NO: 22255 - protein, 9 aa, Artificial Sequence
  Description of Artificial Sequence: Synthetic peptide
  XENP022673 vhCDR3
GGHLGPFDL

SEQ ID NO: 22256 - protein, 12 aa, Artificial Sequence
  Description of Artificial Sequence: Synthetic peptide
  XENP022673 vlCDR1
RASQSVGSSYLA

SEQ ID NO: 22257 - protein, 7 aa, Artificial Sequence
  Description of Artificial Sequence: Synthetic peptide
  XENP022673 vlCDR2
GASSRAT

SEQ ID NO: 22258 - protein, 9 aa, Artificial Sequence
  Description of Artificial Sequence: Synthetic peptide
  XENP022673 vlCDR3
QQYGSSPWT

SEQ ID NO: 22259 - protein, 214 aa, Artificial Sequence
  Description of Artificial Sequence: Synthetic polypeptide
  XENP022673 2A11_H1.125_L2.126_Fab-ipilimumab_H3.23_L0.129 Light Chain
DIQMTQSPAFLSVTPGEKVTITCQASQDIGNYLNWFQQKPDQTVKLLIYFTSYLHSGVPSRFSGSGSGTDYTFTISSLEAEDAATYFCQEGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22260 - protein, 107 aa, Artificial Sequence
  Description of Artificial Sequence: Synthetic polypeptide
  VL of XENP022673
DIQMTQSPAFLSVTPGEKVTITCQASQDIGNYLNWFQQKPDQTVKLLIYFTSYLHSGVPSRFSGSGSGTDYTFTISSLEAEDAATYFCQEGNTLPYTFGGGTKVEIK

SEQ ID NO: 22261 - protein, 11 aa, Artificial Sequence
  Description of Artificial Sequence: Synthetic peptide
  XENP022673 vlCDR1
QASQDIGNYLN

SEQ ID NO: 22262 - protein, 7 aa, Artificial Sequence
  Description of Artificial Sequence: Synthetic peptide
  XENP022673 vlCDR2
FTSYLHS

SEQ ID NO: 22263 - protein, 9 aa, Artificial Sequence
  Description of Artificial Sequence: Synthetic peptide
  XENP022673 vlCDR3
QEGNTLPYT

SEQ ID NO: 22264 - protein, 447 aa, Artificial Sequence; identical to SEQ ID NO: 22084
  Description of Artificial Sequence: Synthetic polypeptide
  XENP022675 2A11_H1.144_L2.142_Fab-ipilimumab_H3.23_L0.129 Fab-Fc Heavy Chain

SEQ ID NO: 22265 - protein, 118 aa, Artificial Sequence; identical to SEQ ID NO: 22085
  Description of Artificial Sequence: Synthetic polypeptide
  VH of XENP022675

SEQ ID NO: 22266 - protein, 5 aa, Artificial Sequence
  Description of Artificial Sequence: Synthetic peptide
  XENP022675 vhCDR1
DYFMH

SEQ ID NO: 22267 - protein, 17 aa, Artificial Sequence
  Description of Artificial Sequence: Synthetic peptide
  XENP022675 vhCDR2
WIDPELGDTEYAPKFQG

SEQ ID NO: 22268 - protein, 9 aa, Artificial Sequence
  Description of Artificial Sequence: Synthetic peptide
  XENP022675 vhCDR3
RGVYQALDY

SEQ ID NO: 22269 - protein, 477 aa, Artificial Sequence; identical to SEQ ID NO: 21669
  Description of Artificial Sequence: Synthetic polypeptide
  XENP022675 2A11_H1.144_L2.142_Fab-ipilimumab_H3.23_L0.129 scFv-Fc Heavy Chain

SEQ ID NO: 22270 - protein, 118 aa, Artificial Sequence; identical to SEQ ID NO: 2632
  Description of Artificial Sequence: Synthetic polypeptide
  VH of XENP022675

SEQ ID NO: 22271 - protein, 108 aa, Artificial Sequence; identical to SEQ ID NO: 2768
  Description of Artificial Sequence: Synthetic polypeptide
  VL of XENP022675

SEQ ID NO: 22272 - protein, 231 aa, Artificial Sequence; identical to SEQ ID NO: 21532
  Description of Artificial Sequence: Synthetic polypeptide
  Fc chain of XENP022675

SEQ ID NO: 22273 - protein, 5 aa, Artificial Sequence
  Description of Artificial Sequence: Synthetic peptide
  XENP022675 vhCDR1
SYTMH

SEQ ID NO: 22274 - protein, 17 aa, Artificial Sequence
  Description of Artificial Sequence: Synthetic peptide
  XENP022675 vhCDR2
FISYDGNYKYYADSVKG

SEQ ID NO: 22275 - protein, 9 aa, Artificial Sequence
  Description of Artificial Sequence: Synthetic peptide
  XENP022675 vhCDR3
GGHLGPFDL

SEQ ID NO: 22276 - protein, 12 aa, Artificial Sequence
  Description of Artificial Sequence: Synthetic peptide
  XENP022675 vlCDR1
RASQSVGSSYLA

SEQ ID NO: 22277 - protein, 7 aa, Artificial Sequence
  Description of Artificial Sequence: Synthetic peptide
  XENP022675 vlCDR2
GASSRAT

SEQ ID NO: 22278 - protein, 9 aa, Artificial Sequence
  Description of Artificial Sequence: Synthetic peptide
  XENP022675 vlCDR3
QQYGSSPWT

SEQ ID NO: 22279 - protein, 214 aa, Artificial Sequence
  Description of Artificial Sequence: Synthetic polypeptide
  XENP022675 2A11_H1.144_L2.142_Fab-ipilimumab_H3.23_L0.129 Light Chain
DIQMTQSPAFLSVTPGEKVTITCQASQDIGNYLNWFQQKPGQTVKLLIYFTSYLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22280 - protein, 107 aa, Artificial Sequence
  Description of Artificial Sequence: Synthetic polypeptide
  VL of XENP022675
DIQMTQSPAFLSVTPGEKVTITCQASQDIGNYLNWFQQKPGQTVKLLIYFTSYLHSGVPSRFSGSGSGTDYTFTISSLEAEDAATYFCQQGNTLPYTFGGGTKVEIK

SEQ ID NO: 22281 - protein, 11 aa, Artificial Sequence
  Description of Artificial Sequence: Synthetic peptide
  XENP022675 vlCDR1
QASQDIGNYLN

SEQ ID NO: 22282 - protein, 7 aa, Artificial Sequence
  Description of Artificial Sequence: Synthetic peptide
  XENP022675 vlCDR2
FTSYLHS

SEQ ID NO: 22283 - protein, 9 aa, Artificial Sequence
  Description of Artificial Sequence: Synthetic peptide
  XENP022675 vlCDR3
QQGNTLPYT

SEQ ID NO: 22284 - protein, 450 aa, Artificial Sequence; identical to SEQ ID NO: 17625
  Description of Artificial Sequence: Synthetic polypeptide
  XENP020045 7G8_H2L2_Fab-ipilimumab_H3L0 Fab-Fc Heavy Chain

SEQ ID NO: 22285 - protein, 121 aa, Artificial Sequence; identical to SEQ ID NO: 17626
  Description of Artificial Sequence: Synthetic polypeptide
  VH of XENP020045

SEQ ID NO: 22286 - protein, 5 aa, Artificial Sequence
  Description of Artificial Sequence: Synthetic peptide
  XENP020045 vhCDR1
DAWMD

SEQ ID NO: 22287 - protein, 19 aa, Artificial Sequence
  Description of Artificial Sequence: Synthetic peptide
  XENP020045 vhCDR2
EIRTKANNHATYYAESVKG

SEQ ID NO: 22288 - protein, 10 aa, Artificial Sequence
  Description of Artificial Sequence: Synthetic peptide
  XENP020045 vhCDR3
LANWDWYFDV

SEQ ID NO: 22289 - protein, 477 aa, Artificial Sequence; identical to SEQ ID NO: 21769
  Description of Artificial Sequence: Synthetic polypeptide
  XENP020045 7G8_H2L2_Fab-ipilimumab_H3L0 scFv-Fc Heavy Chain

SEQ ID NO: 22290 - protein, 118 aa, Artificial Sequence; identical to SEQ ID NO: 139
  Description of Artificial Sequence: Synthetic polypeptide
  VH of XENP020045

SEQ ID NO: 22291 - protein, 108 aa, Artificial Sequence; identical to SEQ ID NO: 23
  Description of Artificial Sequence: Synthetic polypeptide
  VL of XENP020045

SEQ ID NO: 22292 - protein, 231 aa, Artificial Sequence; identical to SEQ ID NO: 21532
  Description of Artificial Sequence: Synthetic polypeptide
  Fc chain of XENP020045

SEQ ID NO: 22293 - protein, 5 aa, Artificial Sequence
  Description of Artificial Sequence: Synthetic peptide
  XENP020045 vhCDR1
SYTMH

SEQ ID NO: 22294 - protein, 17 aa, Artificial Sequence
  Description of Artificial Sequence: Synthetic peptide
  XENP020045 vhCDR2
FISYDGNNKYYADSVKG

SEQ ID NO: 22295 - protein, 9 aa, Artificial Sequence
  Description of Artificial Sequence: Synthetic peptide
  XENP020045 vhCDR3
TGWLGPFDY

SEQ ID NO: 22296 - protein, 12 aa, Artificial Sequence
  Description of Artificial Sequence: Synthetic peptide
  XENP020045 vlCDR1
RASQSVGSSYLA

SEQ ID NO: 22297 - protein, 7 aa, Artificial Sequence
  Description of Artificial Sequence: Synthetic peptide
  XENP020045 vlCDR2
GAFSRAT

SEQ ID NO: 22298 - protein, 9 aa, Artificial Sequence
  Description of Artificial Sequence: Synthetic peptide
  XENP020045 vlCDR3
QQYGSSPWT

SEQ ID NO: 22299 - protein, 218 aa, Artificial Sequence; identical to SEQ ID NO: 17610
  Description of Artificial Sequence: Synthetic polypeptide
  XENP020045 7G8_H2L2_Fab-ipilimumab_H3L0 Light Chain

SEQ ID NO: 22300 - protein, 111 aa, Artificial Sequence; identical to SEQ ID NO: 17611
  Description of Artificial Sequence: Synthetic polypeptide
  VL of XENP020045

SEQ ID NO: 22301 - protein, 15 aa, Artificial Sequence
  Description of Artificial Sequence: Synthetic peptide
  XENP020045 vlCDR1
RASQSVDYDGDSYMN

SEQ ID NO: 22302 - protein, 7 aa, Artificial Sequence
  Description of Artificial Sequence: Synthetic peptide
  XENP020045 vlCDR2
AASNLES

SEQ ID NO: 22303 - protein, 9 aa, Artificial Sequence
  Description of Artificial Sequence: Synthetic peptide
  XENP020045 vlCDR3
QQSNEDPFT

SEQ ID NO: 22304 - protein, 450 aa, Artificial Sequence
  Description of Artificial Sequence: Synthetic polypeptide
  XENP020833 7G8_H3L1_Fab-ipilimumab_H3.23_L0.129 Fab-Fc Heavy Chain
EVQLVESGGGLVQPGGSLRLSCAASGFTFSDAWMDWVRQAPGKGLEWVAEIRTKANNHATYYAESVKGRFTISRDDSKSSVYLQMNSLRAEDTAVYYCTRLANWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22305 - protein, 121 aa, Artificial Sequence; identical to SEQ ID NO: 17806
  Description of Artificial Sequence: Synthetic polypeptide
  VH of XENP020833

SEQ ID NO: 22306 - protein, 5 aa, Artificial Sequence
  Description of Artificial Sequence: Synthetic peptide
  XENP020833 vhCDR1
DAWMD

SEQ ID NO: 22307 - protein, 19 aa, Artificial Sequence
  Description of Artificial Sequence: Synthetic peptide
  XENP020833 vhCDR2
EIRTKANNHATYYAESVKG

SEQ ID NO: 22308 - protein, 10 aa, Artificial Sequence
  Description of Artificial Sequence: Synthetic peptide
  XENP020833 vhCDR3
LANWDWYFDV

SEQ ID NO: 22309 - protein, 477 aa, Artificial Sequence; identical to SEQ ID NO: 21669
  Description of Artificial Sequence: Synthetic polypeptide
  XENP020833 7G8_H3L1_Fab-ipilimumab_H3.23_L0.129 scFv-Fc Heavy Chain

SEQ ID NO: 22310 - protein, 118 aa, Artificial Sequence; identical to SEQ ID NO: 2632
  Description of Artificial Sequence: Synthetic polypeptide
  VH of XENP020833

SEQ ID NO: 22311 - protein, 108 aa, Artificial Sequence; identical to SEQ ID NO: 2768
  Description of Artificial Sequence: Synthetic polypeptide
  VL of XENP020833

SEQ ID NO: 22312 - protein, 231 aa, Artificial Sequence; identical to SEQ ID NO: 21532
  Description of Artificial Sequence: Synthetic polypeptide
  Fc chain of XENP020833

SEQ ID NO: 22313 - protein, 5 aa, Artificial Sequence
  Description of Artificial Sequence: Synthetic peptide
  XENP020833 vhCDR1
SYTMH

SEQ ID NO: 22314 - protein, 17 aa, Artificial Sequence
  Description of Artificial Sequence: Synthetic peptide
  XENP020833 vhCDR2
FISYDGNYKYYADSVKG

SEQ ID NO: 22315 - protein, 9 aa, Artificial Sequence
  Description of Artificial Sequence: Synthetic peptide
  XENP020833 vhCDR3
GGHLGPFDL

SEQ ID NO: 22316 - protein, 12 aa, Artificial Sequence
  Description of Artificial Sequence: Synthetic peptide
  XENP020833 vlCDR1
RASQSVGSSYLA

SEQ ID NO: 22317 - protein, 7 aa, Artificial Sequence
  Description of Artificial Sequence: Synthetic peptide
  XENP020833 vlCDR2
GASSRAT

SEQ ID NO: 22318 - protein, 9 aa, Artificial Sequence
  Description of Artificial Sequence: Synthetic peptide
  XENP020833 vlCDR3
QQYGSSPWT

SEQ ID NO: 22319 - protein, 218 aa, Artificial Sequence; identical to SEQ ID NO: 17600
  Description of Artificial Sequence: Synthetic polypeptide
  XENP020833 7G8_H3L1_Fab-ipilimumab_H3.23_L0.129 Light Chain

SEQ ID NO: 22320 - protein, 111 aa, Artificial Sequence; identical to SEQ ID NO: 17601
  Description of Artificial Sequence: Synthetic polypeptide
  VL of XENP020833

SEQ ID NO: 22321 - protein, 15 aa, Artificial Sequence
  Description of Artificial Sequence: Synthetic peptide
  XENP020833 vlCDR1
RASQSVDYDGDSYMN

SEQ ID NO: 22322 - protein, 7 aa, Artificial Sequence
  Description of Artificial Sequence: Synthetic peptide
  XENP020833 vlCDR2
AASNLES

SEQ ID NO: 22323 - protein, 9 aa, Artificial Sequence
  Description of Artificial Sequence: Synthetic peptide
  XENP020833 vlCDR3
QQSNEDPFT

SEQ ID NO: 22324 - protein, 450 aa, Artificial Sequence
  Description of Artificial Sequence: Synthetic polypeptide
  XENP021895 7G8_H3.18_L1-ipilimumab_H3.23_L0.129 Fab-Fc Heavy Chain
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22325 - protein, 121 aa, Artificial Sequence
  Description of Artificial Sequence: Synthetic polypeptide
  VH of XENP021895
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 22326 - protein, 5 aa, Artificial Sequence
  Description of Artificial Sequence: Synthetic peptide
  XENP021895 vhCDR1
DAWMD

SEQ ID NO: 22327 - protein, 19 aa, Artificial Sequence
  Description of Artificial Sequence: Synthetic peptide
  XENP021895 vhCDR2
EISTKANNHATYYAESVKG

SEQ ID NO: 22328 - protein, 10 aa, Artificial Sequence
  Description of Artificial Sequence: Synthetic peptide
  XENP021895 vhCDR3
LATWDWYFDV

SEQ ID NO: 22329 - protein, 477 aa, Artificial Sequence; identical to SEQ ID NO: 21669
  Description of Artificial Sequence: Synthetic polypeptide
  XENP021895 7G8_H3.18_L1-ipilimumab_H3.23_L0.129 scFv-Fc Heavy Chain

SEQ ID NO: 22330 - protein, 118 aa, Artificial Sequence; identical to SEQ ID NO: 2632
  Description of Artificial Sequence: Synthetic polypeptide
  VH of XENP021895

SEQ ID NO: 22331 - protein, 108 aa, Artificial Sequence; identical to SEQ ID NO: 2768
  Description of Artificial Sequence: Synthetic polypeptide
  VL of XENP021895

SEQ ID NO: 22332 - protein, 231 aa, Artificial Sequence; identical to SEQ ID NO: 21532
  Description of Artificial Sequence: Synthetic polypeptide
  Fc chain of XENP021895

SEQ ID NO: 22333 - protein, 5 aa, Artificial Sequence
  Description of Artificial Sequence: Synthetic peptide
  XENP021895 vhCDR1
SYTMH

SEQ ID NO: 22334 - protein, 17 aa, Artificial Sequence
  Description of Artificial Sequence: Synthetic peptide
  XENP021895 vhCDR2
FISYDGNYKYYADSVKG

SEQ ID NO: 22335 - protein, 9 aa, Artificial Sequence
  Description of Artificial Sequence: Synthetic peptide
  XENP021895 vhCDR3
GGHLGPFDL

SEQ ID NO: 22336 - protein, 12 aa, Artificial Sequence
  Description of Artificial Sequence: Synthetic peptide
  XENP021895 vlCDR1
RASQSVGSSYLA

SEQ ID NO: 22337 - protein, 7 aa, Artificial Sequence
  Description of Artificial Sequence: Synthetic peptide
  XENP021895 vlCDR2
GASSRAT

SEQ ID NO: 22338 - protein, 9 aa, Artificial Sequence
  Description of Artificial Sequence: Synthetic peptide
  XENP021895 vlCDR3
QQYGSSPWT

SEQ ID NO: 22339 - protein, 218 aa, Artificial Sequence; identical to SEQ ID NO: 17600
  Description of Artificial Sequence: Synthetic polypeptide
  XENP021895 7G8_H3.18_L1-ipilimumab_H3.23_L0.129 Light Chain

SEQ ID NO: 22340 - protein, 111 aa, Artificial Sequence; identical to SEQ ID NO: 17601
  Description of Artificial Sequence: Synthetic polypeptide
  VL of XENP021895

SEQ ID NO: 22341 - protein, 15 aa, Artificial Sequence
  Description of Artificial Sequence: Synthetic peptide
  XENP021895 vlCDR1
RASQSVDYDGDSYMN

SEQ ID NO: 22342 - protein, 7 aa, Artificial Sequence
  Description of Artificial Sequence: Synthetic peptide
  XENP021895 vlCDR2
AASNLES

SEQ ID NO: 22343 - protein, 9 aa, Artificial Sequence
  Description of Artificial Sequence: Synthetic peptide
  XENP021895 vlCDR3
QQSNEDPFT

SEQ ID NO: 22344 - protein, 450 aa, Artificial Sequence; identical to SEQ ID NO: 22324
  Description of Artificial Sequence: Synthetic polypeptide
  XENP021896 7G8_H3.18_L1.11-ipilimumab_H3.23_L0.129 Fab-Fc Heavy Chain

SEQ ID NO: 22345 - protein, 121 aa, Artificial Sequence; identical to SEQ ID NO: 22325
  Description of Artificial Sequence: Synthetic polypeptide
  VH of XENP021896

SEQ ID NO: 22346 - protein, 5 aa, Artificial Sequence
  Description of Artificial Sequence: Synthetic peptide
  XENP021896 vhCDR1
DAWMD

SEQ ID NO: 22347 - protein, 19 aa, Artificial Sequence
  Description of Artificial Sequence: Synthetic peptide
  XENP021896 vhCDR2
EISTKANNHATYYAESVKG

SEQ ID NO: 22348 - protein, 10 aa, Artificial Sequence
  Description of Artificial Sequence: Synthetic peptide
  XENP021896 vhCDR3
LATWDWYFDV

SEQ ID NO: 22349 - protein, 477 aa, Artificial Sequence; identical to SEQ ID NO: 21669
  Description of Artificial Sequence: Synthetic polypeptide
  XENP021896 7G8_H3.18_L1.11-ipilimumab_H3.23_L0.129 scFv-Fc Heavy Chain

SEQ ID NO: 22350 - protein, 118 aa, Artificial Sequence; identical to SEQ ID NO: 2632
  Description of Artificial Sequence: Synthetic polypeptide
  VH of XENP021896

SEQ ID NO: 22351 - protein, 108 aa, Artificial Sequence; identical to SEQ ID NO: 2768
  Description of Artificial Sequence: Synthetic polypeptide
  VL of XENP021896

SEQ ID NO: 22352 - protein, 231 aa, Artificial Sequence; identical to SEQ ID NO: 21532
  Description of Artificial Sequence: Synthetic polypeptide
  Fc chain of XENP021896

SEQ ID NO: 22353 - protein, 5 aa, Artificial Sequence
  Description of Artificial Sequence: Synthetic peptide
  XENP021896 vhCDR1
SYTMH

SEQ ID NO: 22354 - protein, 17 aa, Artificial Sequence
  Description of Artificial Sequence: Synthetic peptide
  XENP021896 vhCDR2
FISYDGNYKYYADSVKG

SEQ ID NO: 22355 - protein, 9 aa, Artificial Sequence
  Description of Artificial Sequence: Synthetic peptide
  XENP021896 vhCDR3
GGHLGPFDL

SEQ ID NO: 22356 - protein, 12 aa, Artificial Sequence
  Description of Artificial Sequence: Synthetic peptide
  XENP021896 vlCDR1
RASQSVGSSYLA

SEQ ID NO: 22357 - protein, 7 aa, Artificial Sequence
  Description of Artificial Sequence: Synthetic peptide
  XENP021896 vlCDR2
GASSRAT

SEQ ID NO: 22358 - protein, 9 aa, Artificial Sequence
  Description of Artificial Sequence: Synthetic peptide
  XENP021896 vlCDR3
QQYGSSPWT

SEQ ID NO: 22359 - protein, 218 aa, Artificial Sequence
  Description of Artificial Sequence: Synthetic polypeptide
  XENP021896 7G8_H3.18_L1.11-ipilimumab_H3.23_L0.129 Light Chain
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22360 - protein, 111 aa, Artificial Sequence
  Description of Artificial Sequence: Synthetic polypeptide
  VL of XENP021896
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 22361 - protein, 15 aa, Artificial Sequence
  Description of Artificial Sequence: Synthetic peptide
  XENP021896 vlCDR1
RASQSVDYDGDSYMN

SEQ ID NO: 22362 - protein, 7 aa, Artificial Sequence
  Description of Artificial Sequence: Synthetic peptide
  XENP021896 vlCDR2
AASELES

SEQ ID NO: 22363 - protein, 9 aa, Artificial Sequence
  Description of Artificial Sequence: Synthetic peptide
  XENP021896 vlCDR3
QQSNEDPFT

SEQ ID NO: 22364 - protein, 450 aa, Artificial Sequence
  Description of Artificial Sequence: Synthetic polypeptide
  XENP021901 7G8_H3.15_L1.11-ipilimumab_H3.23_L0.129 Fab-Fc Heavy Chain
EVQLVESGGGLVQPGGSLRLSCAASGDTFDDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22365 - protein, 121 aa, Artificial Sequence
  Description of Artificial Sequence: Synthetic polypeptide
  VH of XENP021901
EVQLVESGGGLVQPGGSLRLSCAASGDTFDDAWMDWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 22366 - protein, 5 aa, Artificial Sequence
  Description of Artificial Sequence: Synthetic peptide
  XENP021901 vhCDR1
DAWMD

SEQ ID NO: 22367 - protein, 19 aa, Artificial Sequence
  Description of Artificial Sequence: Synthetic peptide
  XENP021901 vhCDR2
EISTKANNHATYYAESVKG

SEQ ID NO: 22368 - protein, 10 aa, Artificial Sequence
  Description of Artificial Sequence: Synthetic peptide
  XENP021901 vhCDR3
LATWDWYFDV

SEQ ID NO: 22369 - protein, 477 aa, Artificial Sequence; identical to SEQ ID NO: 21669
  Description of Artificial Sequence: Synthetic polypeptide
  XENP021901 7G8_H3.15_L1.11-ipilimumab_H3.23_L0.129 scFv-Fc Heavy Chain

SEQ ID NO: 22370 - protein, 118 aa, Artificial Sequence; identical to SEQ ID NO: 2632
  Description of Artificial Sequence: Synthetic polypeptide
  VH of XENP021901

SEQ ID NO: 22371 - protein, 108 aa, Artificial Sequence; identical to SEQ ID NO: 2768
  Description of Artificial Sequence: Synthetic polypeptide
  VL of XENP021901

SEQ ID NO: 22372 - protein, 231 aa, Artificial Sequence; identical to SEQ ID NO: 21532
  Description of Artificial Sequence: Synthetic polypeptide
  Fc chain of XENP021901

SEQ ID NO: 22373 - protein, 5 aa, Artificial Sequence
  Description of Artificial Sequence: Synthetic peptide
  XENP021901 vhCDR1
SYTMH

SEQ ID NO: 22374 - protein, 17 aa, Artificial Sequence
  Description of Artificial Sequence: Synthetic peptide
  XENP021901 vhCDR2
FISYDGNYKYYADSVKG

SEQ ID NO: 22375 - protein, 9 aa, Artificial Sequence
  Description of Artificial Sequence: Synthetic peptide
  XENP021901 vhCDR3
GGHLGPFDL

SEQ ID NO: 22376 - protein, 12 aa, Artificial Sequence
  Description of Artificial Sequence: Synthetic peptide
  XENP021901 vlCDR1
RASQSVGSSYLA

SEQ ID NO: 22377 - protein, 7 aa, Artificial Sequence
  Description of Artificial Sequence: Synthetic peptide
  XENP021901 vlCDR2
GASSRAT

SEQ ID NO: 22378 - protein, 9 aa, Artificial Sequence
  Description of Artificial Sequence: Synthetic peptide
  XENP021901 vlCDR3
QQYGSSPWT

SEQ ID NO: 22379 - protein, 218 aa, Artificial Sequence; identical to SEQ ID NO: 22359
  Description of Artificial Sequence: Synthetic polypeptide
  XENP021901 7G8_H3.15_L1.11-ipilimumab_H3.23_L0.129 Light Chain

SEQ ID NO: 22380 - protein, 111 aa, Artificial Sequence; identical to SEQ ID NO: 22360
  Description of Artificial Sequence: Synthetic polypeptide
  VL of XENP021901

SEQ ID NO: 22381 - protein, 15 aa, Artificial Sequence
  Description of Artificial Sequence: Synthetic peptide
  XENP021901 vlCDR1
RASQSVDYDGDSYMN

SEQ ID NO: 22382 - protein, 7 aa, Artificial Sequence
  Description of Artificial Sequence: Synthetic peptide
  XENP021901 vlCDR2
AASELES

SEQ ID NO: 22383 - protein, 9 aa, Artificial Sequence
  Description of Artificial Sequence: Synthetic peptide
  XENP021901 vlCDR3
QQSNEDPFT

SEQ ID NO: 22384 - protein, 450 aa, Artificial Sequence
  Description of Artificial Sequence: Synthetic polypeptide
  XENP021902 7G8_H3.23_L1.11-ipilimumab_H3.23_L0.129 Fab-Fc Heavy Chain
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22385 - protein, 121 aa, Artificial Sequence
  Description of Artificial Sequence: Synthetic polypeptide
  VH of XENP021902
EVQLVESGGGLVQPGGSLRLSCAASGFTFSDAWMDWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 22386 - protein, 5 aa, Artificial Sequence
  Description of Artificial Sequence: Synthetic peptide
  XENP021902 vhCDR1
DAWMD

SEQ ID NO: 22387 - protein, 19 aa, Artificial Sequence
  Description of Artificial Sequence: Synthetic peptide
  XENP021902 vhCDR2
EISTKANNHATYYAESVKG

SEQ ID NO: 22388 - protein, 10 aa, Artificial Sequence
  Description of Artificial Sequence: Synthetic peptide
  XENP021902 vhCDR3
LATWDWYFDV

SEQ ID NO: 22389 - protein, 477 aa, Artificial Sequence; identical to SEQ ID NO: 21669
  Description of Artificial Sequence: Synthetic polypeptide
  XENP021902 7G8_H3.23_L1.11-ipilimumab_H3.23_L0.129 scFv-Fc Heavy Chain

SEQ ID NO: 22390 - protein, 118 aa, Artificial Sequence; identical to SEQ ID NO: 2632
  Description of Artificial Sequence: Synthetic polypeptide
  VH of XENP021902

SEQ ID NO: 22391 - protein, 108 aa, Artificial Sequence; identical to SEQ ID NO: 2768
  Description of Artificial Sequence: Synthetic polypeptide
  VL of XENP021902

SEQ ID NO: 22392 - protein, 231 aa, Artificial Sequence; identical to SEQ ID NO: 21532
  Description of Artificial Sequence: Synthetic polypeptide
  Fc chain of XENP021902

SEQ ID NO: 22393 - protein, 5 aa, Artificial Sequence
  Description of Artificial Sequence: Synthetic peptide
  XENP021902 vhCDR1
SYTMH

SEQ ID NO: 22394 - protein, 17 aa, Artificial Sequence
  Description of Artificial Sequence: Synthetic peptide
  XENP021902 vhCDR2
FISYDGNYKYYADSVKG

SEQ ID NO: 22395 - protein, 9 aa, Artificial Sequence
  Description of Artificial Sequence: Synthetic peptide
  XENP021902 vhCDR3
GGHLGPFDL

SEQ ID NO: 22396 - protein, 12 aa, Artificial Sequence
  Description of Artificial Sequence: Synthetic peptide
  XENP021902 vlCDR1
RASQSVGSSYLA

SEQ ID NO: 22397 - protein, 7 aa, Artificial Sequence
  Description of Artificial Sequence: Synthetic peptide
  XENP021902 vlCDR2
GASSRAT

SEQ ID NO: 22398 - protein, 9 aa, Artificial Sequence
  Description of Artificial Sequence: Synthetic peptide
  XENP021902 vlCDR3
QQYGSSPWT

SEQ ID NO: 22399 - protein, 218 aa, Artificial Sequence; identical to SEQ ID NO: 22359
  Description of Artificial Sequence: Synthetic polypeptide
  XENP021902 7G8_H3.23_L1.11-ipilimumab_H3.23_L0.129 Light Chain

SEQ ID NO: 22400 - protein, 111 aa, Artificial Sequence; identical to SEQ ID NO: 22360
  Description of Artificial Sequence: Synthetic polypeptide
  VL of XENP021902

SEQ ID NO: 22401 - protein, 15 aa, Artificial Sequence
  Description of Artificial Sequence: Synthetic peptide
  XENP021902 vlCDR1
RASQSVDYDGDSYMN

SEQ ID NO: 22402 - protein, 7 aa, Artificial Sequence
  Description of Artificial Sequence: Synthetic peptide
  XENP021902 vlCDR2
AASELES

SEQ ID NO: 22403 - protein, 9 aa, Artificial Sequence
  Description of Artificial Sequence: Synthetic peptide
  XENP021902 vlCDR3
QQSNEDPFT

SEQ ID NO: 22404 - protein, 450 aa, Artificial Sequence; identical to SEQ ID NO: 22324
  Description of Artificial Sequence: Synthetic polypeptide
  XENP021903 7G8_H3.18_L1.13-ipilimumab_H3.23_L0.129 Fab-Fc Heavy Chain

SEQ ID NO: 22405 - protein, 121 aa, Artificial Sequence; identical to SEQ ID NO: 22325
  Description of Artificial Sequence: Synthetic polypeptide
  VH of XENP021903

SEQ ID NO: 22406 - protein, 5 aa, Artificial Sequence
  Description of Artificial Sequence: Synthetic peptide
  XENP021903 vhCDR1
DAWMD

SEQ ID NO: 22407 - protein, 19 aa, Artificial Sequence
  Description of Artificial Sequence: Synthetic peptide
  XENP021903 vhCDR2
EISTKANNHATYYAESVKG

SEQ ID NO: 22408 - protein, 10 aa, Artificial Sequence
  Description of Artificial Sequence: Synthetic peptide
  XENP021903 vhCDR3
LATWDWYFDV

SEQ ID NO: 22409 - protein, 477 aa, Artificial Sequence; identical to SEQ ID NO: 21669
  Description of Artificial Sequence: Synthetic polypeptide
  XENP021903 7G8_H3.18_L1.13-ipilimumab_H3.23_L0.129 scFv-Fc Heavy Chain

SEQ ID NO: 22410 - protein, 118 aa, Artificial Sequence; identical to SEQ ID NO: 2632
  Description of Artificial Sequence: Synthetic polypeptide
  VH of XENP021903

SEQ ID NO: 22411 - protein, 108 aa, Artificial Sequence; identical to SEQ ID NO: 2768
  Description of Artificial Sequence: Synthetic polypeptide
  VL of XENP021903

SEQ ID NO: 22412 - protein, 231 aa, Artificial Sequence; identical to SEQ ID NO: 21532
  Description of Artificial Sequence: Synthetic polypeptide
  Fc chain of XENP021903

SEQ ID NO: 22413 - protein, 5 aa, Artificial Sequence
  Description of Artificial Sequence: Synthetic peptide
  XENP021903 vhCDR1
SYTMH

SEQ ID NO: 22414 - protein, 17 aa, Artificial Sequence
  Description of Artificial Sequence: Synthetic peptide
  XENP021903 vhCDR2
FISYDGNYKYYADSVKG

SEQ ID NO: 22415 - protein, 9 aa, Artificial Sequence
  Description of Artificial Sequence: Synthetic peptide
  XENP021903 vhCDR3
GGHLGPFDL

SEQ ID NO: 22416 - protein, 12 aa, Artificial Sequence
  Description of Artificial Sequence: Synthetic peptide
  XENP021903 vlCDR1
RASQSVGSSYLA

SEQ ID NO: 22417 - protein, 7 aa, Artificial Sequence
  Description of Artificial Sequence: Synthetic peptide
  XENP021903 vlCDR2
GASSRAT

SEQ ID NO: 22418 - protein, 9 aa, Artificial Sequence
  Description of Artificial Sequence: Synthetic peptide
  XENP021903 vlCDR3
QQYGSSPWT

SEQ ID NO: 22419 - protein, 218 aa, Artificial Sequence
  Description of Artificial Sequence: Synthetic polypeptide
  XENP021903 7G8_H3.18_L1.13-ipilimumab_H3.23_L0.129 Light Chain
DTVLTQSPSSLSASVGDRVTITCRASQSVDHDGDSYMNWYQQKPGKPPKLLIYAASELESGIPARLSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22420 - protein, 111 aa, Artificial Sequence
  Description of Artificial Sequence: Synthetic polypeptide
  VL of XENP021903
DTVLTQSPSSLSASVGDRVTITCRASQSVDHDGDSYMNWYQQKPGKPPKLLIYAASELESGIPARLSGSGSGTDFTLTISSLQPEDFATYYCQQSNEDPFTFGSGTKLEIK

SEQ ID NO: 22421 - protein, 15 aa, Artificial Sequence
  Description of Artificial Sequence: Synthetic peptide
  XENP021903 vlCDR1
RASQSVDHDGDSYMN

SEQ ID NO: 22422 - protein, 7 aa, Artificial Sequence
  Description of Artificial Sequence: Synthetic peptide
  XENP021903 vlCDR2
AASELES

SEQ ID NO: 22423 - protein, 9 aa, Artificial Sequence
  Description of Artificial Sequence: Synthetic peptide
  XENP021903 vlCDR3
QQSNEDPFT

SEQ ID NO: 22424 - protein, 450 aa, Artificial Sequence
  Description of Artificial Sequence: Synthetic polypeptide
  XENP021904 7G8_H3.28_L1-ipilimumab_H3.23_L0.129 Fab-Fc Heavy Chain
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22425 - protein, 121 aa, Artificial Sequence
  Description of Artificial Sequence: Synthetic polypeptide
  VH of XENP021904
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 22426 - protein, 5 aa, Artificial Sequence
  Description of Artificial Sequence: Synthetic peptide
  XENP021904 vhCDR1
DAWMD

SEQ ID NO: 22427 - protein, 19 aa, Artificial Sequence
  Description of Artificial Sequence: Synthetic peptide
  XENP021904 vhCDR2
EISTKAYNHATYYAESVKG

SEQ ID NO: 22428 - protein, 10 aa, Artificial Sequence
  Description of Artificial Sequence: Synthetic peptide
  XENP021904 vhCDR3
LATWDWYFDV

SEQ ID NO: 22429 - protein, 477 aa, Artificial Sequence; identical to SEQ ID NO: 21669
  Description of Artificial Sequence: Synthetic polypeptide
  XENP021904 7G8_H3.28_L1-ipilimumab_H3.23_L0.129 scFv-Fc Heavy Chain

SEQ ID NO: 22430 - protein, 118 aa, Artificial Sequence; identical to SEQ ID NO: 2632
  Description of Artificial Sequence: Synthetic polypeptide
  VH of XENP021904

SEQ ID NO: 22431 - protein, 108 aa, Artificial Sequence; identical to SEQ ID NO: 2768
  Description of Artificial Sequence: Synthetic polypeptide
  VL of XENP021904

SEQ ID NO: 22432 - protein, 231 aa, Artificial Sequence; identical to SEQ ID NO: 21532
  Description of Artificial Sequence: Synthetic polypeptide
  Fc chain of XENP021904

SEQ ID NO: 22433 - protein, 5 aa, Artificial Sequence
  Description of Artificial Sequence: Synthetic peptide
  XENP021904 vhCDR1
SYTMH

SEQ ID NO: 22434 - protein, 17 aa, Artificial Sequence
  Description of Artificial Sequence: Synthetic peptide
  XENP021904 vhCDR2
FISYDGNYKYYADSVKG

SEQ ID NO: 22435 - protein, 9 aa, Artificial Sequence
  Description of Artificial Sequence: Synthetic peptide
  XENP021904 vhCDR3
GGHLGPFDL

SEQ ID NO: 22436 - protein, 12 aa, Artificial Sequence
  Description of Artificial Sequence: Synthetic peptide
  XENP021904 vlCDR1
RASQSVGSSYLA

SEQ ID NO: 22437 - protein, 7 aa, Artificial Sequence
  Description of Artificial Sequence: Synthetic peptide
  XENP021904 vlCDR2
GASSRAT

SEQ ID NO: 22438 - protein, 9 aa, Artificial Sequence
  Description of Artificial Sequence: Synthetic peptide
  XENP021904 vlCDR3
QQYGSSPWT

SEQ ID NO: 22439 - protein, 218 aa, Artificial Sequence; identical to SEQ ID NO: 17600
  Description of Artificial Sequence: Synthetic polypeptide
  XENP021904 7G8_H3.28_L1-ipilimumab_H3.23_L0.129 Light Chain

SEQ ID NO: 22440 - protein, 111 aa, Artificial Sequence; identical to SEQ ID NO: 17601
  Description of Artificial Sequence: Synthetic polypeptide
  VL of XENP021904

SEQ ID NO: 22441 - protein, 15 aa, Artificial Sequence
  Description of Artificial Sequence: Synthetic peptide
  XENP021904 vlCDR1
RASQSVDYDGDSYMN

SEQ ID NO: 22442 - protein, 7 aa, Artificial Sequence
  Description of Artificial Sequence: Synthetic peptide
  XENP021904 vlCDR2
AASNLES

SEQ ID NO: 22443 - protein, 9 aa, Artificial Sequence
  Description of Artificial Sequence: Synthetic peptide
  XENP021904 vlCDR3
QQSNEDPFT

SEQ ID NO: 22444 - protein, 450 aa, Artificial Sequence; identical to SEQ ID NO: 22424
  Description of Artificial Sequence: Synthetic polypeptide
  XENP021905 7G8_H3.28_L1.11-ipilimumab_H3.23_L0.129 Fab-Fc Heavy Chain

SEQ ID NO: 22445 - protein, 121 aa, Artificial Sequence; identical to SEQ ID NO: 22425
  Description of Artificial Sequence: Synthetic polypeptide
  VH of XENP021905

SEQ ID NO: 22446 - protein, 5 aa, Artificial Sequence
  Description of Artificial Sequence: Synthetic peptide
  XENP021905 vhCDR1
DAWMD

SEQ ID NO: 22447 - protein, 19 aa, Artificial Sequence
  Description of Artificial Sequence: Synthetic peptide
  XENP021905 vhCDR2
EISTKAYNHATYYAESVKG

SEQ ID NO: 22448 - protein, 10 aa, Artificial Sequence
  Description of Artificial Sequence: Synthetic peptide
  XENP021905 vhCDR3
LATWDWYFDV

SEQ ID NO: 22449 - protein, 477 aa, Artificial Sequence; identical to SEQ ID NO: 21669
  Description of Artificial Sequence: Synthetic polypeptide
  XENP021905 7G8_H3.28_L1.11-ipilimumab_H3.23_L0.129 scFv-Fc Heavy Chain

SEQ ID NO: 22450 - protein, 118 aa, Artificial Sequence; identical to SEQ ID NO: 2632
  Description of Artificial Sequence: Synthetic polypeptide
  VH of XENP021905

SEQ ID NO: 22451 - protein, 108 aa, Artificial Sequence; identical to SEQ ID NO: 2768
  Description of Artificial Sequence: Synthetic polypeptide
  VL of XENP021905

SEQ ID NO: 22452 - protein, 231 aa, Artificial Sequence; identical to SEQ ID NO: 21532
  Description of Artificial Sequence: Synthetic polypeptide
  Fc chain of XENP021905

SEQ ID NO: 22453 - protein, 5 aa, Artificial Sequence
  Description of Artificial Sequence: Synthetic peptide
  XENP021905 vhCDR1
SYTMH

SEQ ID NO: 22454 - protein, 17 aa, Artificial Sequence
  Description of Artificial Sequence: Synthetic peptide
  XENP021905 vhCDR2
FISYDGNYKYYADSVKG

SEQ ID NO: 22455 - protein, 9 aa, Artificial Sequence
  Description of Artificial Sequence: Synthetic peptide
  XENP021905 vhCDR3
GGHLGPFDL

SEQ ID NO: 22456 - protein, 12 aa, Artificial Sequence
  Description of Artificial Sequence: Synthetic peptide
  XENP021905 vlCDR1
RASQSVGSSYLA

SEQ ID NO: 22457 - protein, 7 aa, Artificial Sequence
  Description of Artificial Sequence: Synthetic peptide
  XENP021905 vlCDR2
GASSRAT

SEQ ID NO: 22458 - protein, 9 aa, Artificial Sequence
  Description of Artificial Sequence: Synthetic peptide
  XENP021905 vlCDR3
QQYGSSPWT

SEQ ID NO: 22459 - protein, 218 aa, Artificial Sequence; identical to SEQ ID NO: 22359
  Description of Artificial Sequence: Synthetic polypeptide
  XENP021905 7G8_H3.28_L1.11-ipilimumab_H3.23_L0.129 Light Chain

SEQ ID NO: 22460 - protein, 111 aa, Artificial Sequence; identical to SEQ ID NO: 22360
  Description of Artificial Sequence: Synthetic polypeptide
  VL of XENP021905

SEQ ID NO: 22461 - protein, 15 aa, Artificial Sequence
  Description of Artificial Sequence: Synthetic peptide
  XENP021905 vlCDR1
RASQSVDYDGDSYMN

SEQ ID NO: 22462 - protein, 7 aa, Artificial Sequence
  Description of Artificial Sequence: Synthetic peptide
  XENP021905 vlCDR2
AASELES

SEQ ID NO: 22463 - protein, 9 aa, Artificial Sequence
  Description of Artificial Sequence: Synthetic peptide
  XENP021905 vlCDR3
QQSNEDPFT

SEQ ID NO: 22464 - protein, 450 aa, Artificial Sequence; identical to SEQ ID NO: 22424
  Description of Artificial Sequence: Synthetic polypeptide
  XENP021906 7G8_H3.28_L1.13-ipilimumab_H3.23_L0.129 Fab-Fc Heavy Chain

SEQ ID NO: 22465 - protein, 121 aa, Artificial Sequence; identical to SEQ ID NO: 22425
  Description of Artificial Sequence: Synthetic polypeptide
  VH of XENP021906

SEQ ID NO: 22466 - protein, 5 aa, Artificial Sequence
  Description of Artificial Sequence: Synthetic peptide
  XENP021906 vhCDR1
DAWMD

SEQ ID NO: 22467 - protein, 19 aa, Artificial Sequence
  Description of Artificial Sequence: Synthetic peptide
  XENP021906 vhCDR2
EISTKAYNHATYYAESVKG

SEQ ID NO: 22468 - protein, 10 aa, Artificial Sequence
  Description of Artificial Sequence: Synthetic peptide
  XENP021906 vhCDR3
LATWDWYFDV

SEQ ID NO: 22469 - protein, 477 aa, Artificial Sequence; identical to SEQ ID NO: 21669
  Description of Artificial Sequence: Synthetic polypeptide
  XENP021906 7G8_H3.28_L1.13-ipilimumab_H3.23_L0.129 scFv-Fc Heavy Chain

SEQ ID NO: 22470 - protein, 118 aa, Artificial Sequence; identical to SEQ ID NO: 2632
  Description of Artificial Sequence: Synthetic polypeptide
  VH of XENP021906

SEQ ID NO: 22471 - protein, 108 aa, Artificial Sequence; identical to SEQ ID NO: 2768
  Description of Artificial Sequence: Synthetic polypeptide
  VL of XENP021906

SEQ ID NO: 22472 - protein, 231 aa, Artificial Sequence; identical to SEQ ID NO: 21532
  Description of Artificial Sequence: Synthetic polypeptide
  Fc chain of XENP021906

SEQ ID NO: 22473 - protein, 5 aa, Artificial Sequence
  Description of Artificial Sequence: Synthetic peptide
  XENP021906 vhCDR1
SYTMH

SEQ ID NO: 22474 - protein, 17 aa, Artificial Sequence
  Description of Artificial Sequence: Synthetic peptide
  XENP021906 vhCDR2
FISYDGNYKYYADSVKG

SEQ ID NO: 22475 - protein, 9 aa, Artificial Sequence
  Description of Artificial Sequence: Synthetic peptide
  XENP021906 vhCDR3
GGHLGPFDL

SEQ ID NO: 22476 - protein, 12 aa, Artificial Sequence
  Description of Artificial Sequence: Synthetic peptide
  XENP021906 vlCDR1
RASQSVGSSYLA

SEQ ID NO: 22477 - protein, 7 aa, Artificial Sequence
  Description of Artificial Sequence: Synthetic peptide
  XENP021906 vlCDR2
GASSRAT

SEQ ID NO: 22478 - protein, 9 aa, Artificial Sequence
  Description of Artificial Sequence: Synthetic peptide
  XENP021906 vlCDR3
QQYGSSPWT

SEQ ID NO: 22479 - protein, 218 aa, Artificial Sequence; identical to SEQ ID NO: 22419
  Description of Artificial Sequence: Synthetic polypeptide
  XENP021906 7G8_H3.28_L1.13-ipilimumab_H3.23_L0.129 Light Chain

SEQ ID NO: 22480 - protein, 111 aa, Artificial Sequence; identical to SEQ ID NO: 22420
  Description of Artificial Sequence: Synthetic polypeptide
  VL of XENP021906

SEQ ID NO: 22481 - protein, 15 aa, Artificial Sequence
  Description of Artificial Sequence: Synthetic peptide
  XENP021906 vlCDR1
RASQSVDHDGDSYMN

SEQ ID NO: 22482 - protein, 7 aa, Artificial Sequence
  Description of Artificial Sequence: Synthetic peptide
  XENP021906 vlCDR2
AASELES

SEQ ID NO: 22483 - protein, 9 aa, Artificial Sequence
  Description of Artificial Sequence: Synthetic peptide
  XENP021906 vlCDR3
QQSNEDPFT

SEQ ID NO: 22484 - protein, 450 aa, Artificial Sequence
  Description of Artificial Sequence: Synthetic polypeptide
  XENP022555 7G8_H3.30_L1.11-ipilimumab_H3.23_L0.129 Fab-Fc Heavy Chain
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22485 - protein, 121 aa, Artificial Sequence
  Description of Artificial Sequence: Synthetic polypeptide
  VH of XENP022555
EVQLVESGGGLVQPGGSLRLSCAASGFTFDDAWMSWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 22486 - protein, 5 aa, Artificial Sequence
  Description of Artificial Sequence: Synthetic peptide
  XENP022555 vhCDR1
DAWMS

SEQ ID NO: 22487 - protein, 19 aa, Artificial Sequence
  Description of Artificial Sequence: Synthetic peptide
  XENP022555 vhCDR2
EISTKANNHATYYAESVKG

SEQ ID NO: 22488 - protein, 10 aa, Artificial Sequence
  Description of Artificial Sequence: Synthetic peptide
  XENP022555 vhCDR3
LATWDWYFDV

SEQ ID NO: 22489 - protein, 477 aa, Artificial Sequence; identical to SEQ ID NO: 21669
  Description of Artificial Sequence: Synthetic polypeptide
  XENP022555 7G8_H3.30_L1.11-ipilimumab_H3.23_L0.129 scFv-Fc Heavy Chain

SEQ ID NO: 22490 - protein, 118 aa, Artificial Sequence; identical to SEQ ID NO: 2632
  Description of Artificial Sequence: Synthetic polypeptide
  VH of XENP022555

SEQ ID NO: 22491 - protein, 108 aa, Artificial Sequence; identical to SEQ ID NO: 2768
  Description of Artificial Sequence: Synthetic polypeptide
  VL of XENP022555

SEQ ID NO: 22492 - protein, 231 aa, Artificial Sequence; identical to SEQ ID NO: 21532
  Description of Artificial Sequence: Synthetic polypeptide
  Fc chain of XENP022555

SEQ ID NO: 22493 - protein, 5 aa, Artificial Sequence
  Description of Artificial Sequence: Synthetic peptide
  XENP022555 vhCDR1
SYTMH

SEQ ID NO: 22494 - protein, 17 aa, Artificial Sequence
  Description of Artificial Sequence: Synthetic peptide
  XENP022555 vhCDR2
FISYDGNYKYYADSVKG

SEQ ID NO: 22495 - protein, 9 aa, Artificial Sequence
  Description of Artificial Sequence: Synthetic peptide
  XENP022555 vhCDR3
GGHLGPFDL

SEQ ID NO: 22496 - protein, 12 aa, Artificial Sequence
  Description of Artificial Sequence: Synthetic peptide
  XENP022555 vlCDR1
RASQSVGSSYLA

SEQ ID NO: 22497 - protein, 7 aa, Artificial Sequence
  Description of Artificial Sequence: Synthetic peptide
  XENP022555 vlCDR2
GASSRAT

SEQ ID NO: 22498 - protein, 9 aa, Artificial Sequence
  Description of Artificial Sequence: Synthetic peptide
  XENP022555 vlCDR3
QQYGSSPWT

SEQ ID NO: 22499 - protein, 218 aa, Artificial Sequence; identical to SEQ ID NO: 22359
  Description of Artificial Sequence: Synthetic polypeptide
  XENP022555 7G8_H3.30_L1.11-ipilimumab_H3.23_L0.129 Light Chain

SEQ ID NO: 22500 - protein, 111 aa, Artificial Sequence; identical to SEQ ID NO: 22360
  Description of Artificial Sequence: Synthetic polypeptide
  VL of XENP022555

SEQ ID NO: 22501 - protein, 15 aa, Artificial Sequence
  Description of Artificial Sequence: Synthetic peptide
  XENP022555 vlCDR1
RASQSVDYDGDSYMN

SEQ ID NO: 22502 - protein, 7 aa, Artificial Sequence
  Description of Artificial Sequence: Synthetic peptide
  XENP022555 vlCDR2
AASELES

SEQ ID NO: 22503 - protein, 9 aa, Artificial Sequence
  Description of Artificial Sequence: Synthetic peptide
  XENP022555 vlCDR3
QQSNEDPFT

SEQ ID NO: 22504 - protein, 450 aa, Artificial Sequence
  Description of Artificial Sequence: Synthetic polypeptide
  XENP022556 7G8_H3.33_L1.11-ipilimumab_H3.23_L0.129 Fab-Fc Heavy Chain
EVQLVESGGGLVQPGGSLRLSCAASGFTFDDAWMGWVRQAPGKGLEWVAEISTKANNHATYYAESVKGRFTISRDDSKSSVYLQMNSLRAEDTAVYYCTRLATWDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22505 - protein, 121 aa, Artificial Sequence
  Description of Artificial Sequence: Synthetic polypeptide
  VH of XENP022556
EVQLVESGGGLVQPGGSLRLSCAASGFTFDDAWMGWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 22506 - protein, 5 aa, Artificial Sequence
  Description of Artificial Sequence: Synthetic peptide
  XENP022556 vhCDR1
DAWMG

SEQ ID NO: 22507 - protein, 19 aa, Artificial Sequence
  Description of Artificial Sequence: Synthetic peptide
  XENP022556 vhCDR2
EISTKANNHATYYAESVKG

SEQ ID NO: 22508 - protein, 10 aa, Artificial Sequence
  Description of Artificial Sequence: Synthetic peptide
  XENP022556 vhCDR3
LATWDWYFDV

SEQ ID NO: 22509 - protein, 477 aa, Artificial Sequence; identical to SEQ ID NO: 21669
  Description of Artificial Sequence: Synthetic polypeptide
  XENP022556 7G8_H3.33_L1.11-ipilimumab_H3.23_L0.129 scFv-Fc Heavy Chain

SEQ ID NO: 22510 - protein, 118 aa, Artificial Sequence; identical to SEQ ID NO: 2632
  Description of Artificial Sequence: Synthetic polypeptide
  VH of XENP022556

SEQ ID NO: 22511 - protein, 108 aa, Artificial Sequence; identical to SEQ ID NO: 2768
  Description of Artificial Sequence: Synthetic polypeptide
  VL of XENP022556

SEQ ID NO: 22512 - protein, 231 aa, Artificial Sequence; identical to SEQ ID NO: 21532
  Description of Artificial Sequence: Synthetic polypeptide
  Fc chain of XENP022556

SEQ ID NO: 22513 - protein, 5 aa, Artificial Sequence
  Description of Artificial Sequence: Synthetic peptide
  XENP022556 vhCDR1
SYTMH

SEQ ID NO: 22514 - protein, 17 aa, Artificial Sequence
  Description of Artificial Sequence: Synthetic peptide
  XENP022556 vhCDR2
FISYDGNYKYYADSVKG

SEQ ID NO: 22515 - protein, 9 aa, Artificial Sequence
  Description of Artificial Sequence: Synthetic peptide
  XENP022556 vhCDR3
GGHLGPFDL

SEQ ID NO: 22516 - protein, 12 aa, Artificial Sequence
  Description of Artificial Sequence: Synthetic peptide
  XENP022556 vlCDR1
RASQSVGSSYLA

SEQ ID NO: 22517 - protein, 7 aa, Artificial Sequence
  Description of Artificial Sequence: Synthetic peptide
  XENP022556 vlCDR2
GASSRAT

SEQ ID NO: 22518 - protein, 9 aa, Artificial Sequence
  Description of Artificial Sequence: Synthetic peptide
  XENP022556 vlCDR3
QQYGSSPWT

SEQ ID NO: 22519 - protein, 218 aa, Artificial Sequence; identical to SEQ ID NO: 22359
  Description of Artificial Sequence: Synthetic polypeptide
  XENP022556 7G8_H3.33_L1.11-ipilimumab_H3.23_L0.129 Light Chain

SEQ ID NO: 22520 - protein, 111 aa, Artificial Sequence; identical to SEQ ID NO: 22360
  Description of Artificial Sequence: Synthetic polypeptide
  VL of XENP022556

SEQ ID NO: 22521 - protein, 15 aa, Artificial Sequence
  Description of Artificial Sequence: Synthetic peptide
  XENP022556 vlCDR1
RASQSVDYDGDSYMN

SEQ ID NO: 22522 - protein, 7 aa, Artificial Sequence
  Description of Artificial Sequence: Synthetic peptide
  XENP022556 vlCDR2
AASELES

SEQ ID NO: 22523 - protein, 9 aa, Artificial Sequence
  Description of Artificial Sequence: Synthetic peptide
  XENP022556 vlCDR3
QQSNEDPFT

SEQ ID NO: 22524 - protein, 450 aa, Artificial Sequence; identical to SEQ ID NO: 22324
  Description of Artificial Sequence: Synthetic polypeptide
  XENP022557 7G8_H3.18_L1.30-ipilimumab_H3.23_L0.129 Fab-Fc Heavy Chain

SEQ ID NO: 22525 - protein, 121 aa, Artificial Sequence; identical to SEQ ID NO: 22325
  Description of Artificial Sequence: Synthetic polypeptide
  VH of XENP022557

SEQ ID NO: 22526 - protein, 5 aa, Artificial Sequence
  Description of Artificial Sequence: Synthetic peptide
  XENP022557 vhCDR1
DAWMD

SEQ ID NO: 22527 - protein, 19 aa, Artificial Sequence
  Description of Artificial Sequence: Synthetic peptide
  XENP022557 vhCDR2
EISTKANNHATYYAESVKG

SEQ ID NO: 22528 - protein, 10 aa, Artificial Sequence
  Description of Artificial Sequence: Synthetic peptide
  XENP022557 vhCDR3
LATWDWYFDV

SEQ ID NO: 22529 - protein, 477 aa, Artificial Sequence; identical to SEQ ID NO: 21669
  Description of Artificial Sequence: Synthetic polypeptide
  XENP022557 7G8_H3.18_L1.30-ipilimumab_H3.23_L0.129 scFv-Fc Heavy Chain

SEQ ID NO: 22530 - protein, 118 aa, Artificial Sequence; identical to SEQ ID NO: 2632
  Description of Artificial Sequence: Synthetic polypeptide
  VH of XENP022557

SEQ ID NO: 22531 - protein, 108 aa, Artificial Sequence; identical to SEQ ID NO: 2768
  Description of Artificial Sequence: Synthetic polypeptide
  VL of XENP022557

SEQ ID NO: 22532 - protein, 231 aa, Artificial Sequence; identical to SEQ ID NO: 21532
  Description of Artificial Sequence: Synthetic polypeptide
  Fc chain of XENP022557

SEQ ID NO: 22533 - protein, 5 aa, Artificial Sequence
  Description of Artificial Sequence: Synthetic peptide
  XENP022557 vhCDR1
SYTMH

SEQ ID NO: 22534 - protein, 17 aa, Artificial Sequence
  Description of Artificial Sequence: Synthetic peptide
  XENP022557 vhCDR2
FISYDGNYKYYADSVKG

SEQ ID NO: 22535 - protein, 9 aa, Artificial Sequence
  Description of Artificial Sequence: Synthetic peptide
  XENP022557 vhCDR3
GGHLGPFDL

SEQ ID NO: 22536 - protein, 12 aa, Artificial Sequence
  Description of Artificial Sequence: Synthetic peptide
  XENP022557 vlCDR1
RASQSVGSSYLA

SEQ ID NO: 22537 - protein, 7 aa, Artificial Sequence
  Description of Artificial Sequence: Synthetic peptide
  XENP022557 vlCDR2
GASSRAT

SEQ ID NO: 22538 - protein, 9 aa, Artificial Sequence
  Description of Artificial Sequence: Synthetic peptide
  XENP022557 vlCDR3
QQYGSSPWT

SEQ ID NO: 22539 - protein, 218 aa, Artificial Sequence
  Description of Artificial Sequence: Synthetic polypeptide
  XENP022557 7G8_H3.18_L1.30-ipilimumab_H3.23_L0.129 Light Chain
DTVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22540 - protein, 111 aa, Artificial Sequence
  Description of Artificial Sequence: Synthetic polypeptide
  VL of XENP022557
DTVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIK

SEQ ID NO: 22541 - protein, 15 aa, Artificial Sequence
  Description of Artificial Sequence: Synthetic peptide
  XENP022557 vlCDR1
RASQSVDYDGDSYMN

SEQ ID NO: 22542 - protein, 7 aa, Artificial Sequence
  Description of Artificial Sequence: Synthetic peptide
  XENP022557 vlCDR2
AASELES

SEQ ID NO: 22543 - protein, 9 aa, Artificial Sequence
  Description of Artificial Sequence: Synthetic peptide
  XENP022557 vlCDR3
QQSNEDPFT

SEQ ID NO: 22544 - protein, 450 aa, Artificial Sequence; identical to SEQ ID NO: 22484
  Description of Artificial Sequence: Synthetic polypeptide
  XENP022558 7G8_H3.30_L1.30-ipilimumab_H3.23_L0.129 Fab-Fc Heavy Chain

SEQ ID NO: 22545 - protein, 121 aa, Artificial Sequence; identical to SEQ ID NO: 22485
  Description of Artificial Sequence: Synthetic polypeptide
  VH of XENP022558

SEQ ID NO: 22546 - protein, 5 aa, Artificial Sequence
  Description of Artificial Sequence: Synthetic peptide
  XENP022558 vhCDR1
DAWMS

SEQ ID NO: 22547 - protein, 19 aa, Artificial Sequence
  Description of Artificial Sequence: Synthetic peptide
  XENP022558 vhCDR2
EISTKANNHATYYAESVKG

SEQ ID NO: 22548 - protein, 10 aa, Artificial Sequence
  Description of Artificial Sequence: Synthetic peptide
  XENP022558 vhCDR3
LATWDWYFDV

SEQ ID NO: 22549 - protein, 477 aa, Artificial Sequence; identical to SEQ ID NO: 21669
  Description of Artificial Sequence: Synthetic polypeptide
  XENP022558 7G8_H3.30_L1.30-ipilimumab_H3.23_L0.129 scFv-Fc Heavy Chain

SEQ ID NO: 22550 - protein, 118 aa, Artificial Sequence; identical to SEQ ID NO: 2632
  Description of Artificial Sequence: Synthetic polypeptide
  VH of XENP022558

SEQ ID NO: 22551 - protein, 108 aa, Artificial Sequence; identical to SEQ ID NO: 2768
  Description of Artificial Sequence: Synthetic polypeptide
  VL of XENP022558

SEQ ID NO: 22552 - protein, 231 aa, Artificial Sequence; identical to SEQ ID NO: 21532
  Description of Artificial Sequence: Synthetic polypeptide
  Fc chain of XENP022558

SEQ ID NO: 22553 - protein, 5 aa, Artificial Sequence
  Description of Artificial Sequence: Synthetic peptide
  XENP022558 vhCDR1
SYTMH

SEQ ID NO: 22554 - protein, 17 aa, Artificial Sequence
  Description of Artificial Sequence: Synthetic peptide
  XENP022558 vhCDR2
FISYDGNYKYYADSVKG

SEQ ID NO: 22555 - protein, 9 aa, Artificial Sequence
  Description of Artificial Sequence: Synthetic peptide
  XENP022558 vhCDR3
GGHLGPFDL

SEQ ID NO: 22556 - protein, 12 aa, Artificial Sequence
  Description of Artificial Sequence: Synthetic peptide
  XENP022558 vlCDR1
RASQSVGSSYLA

SEQ ID NO: 22557 - protein, 7 aa, Artificial Sequence
  Description of Artificial Sequence: Synthetic peptide
  XENP022558 vlCDR2
GASSRAT

SEQ ID NO: 22558 - protein, 9 aa, Artificial Sequence
  Description of Artificial Sequence: Synthetic peptide
  XENP022558 vlCDR3
QQYGSSPWT

SEQ ID NO: 22559 - protein, 218 aa, Artificial Sequence; identical to SEQ ID NO: 22539
  Description of Artificial Sequence: Synthetic polypeptide
  XENP022558 7G8_H3.30_L1.30-ipilimumab_H3.23_L0.129 Light Chain

SEQ ID NO: 22560 - protein, 111 aa, Artificial Sequence; identical to SEQ ID NO: 22540
  Description of Artificial Sequence: Synthetic polypeptide
  VL of XENP022558

SEQ ID NO: 22561 - protein, 15 aa, Artificial Sequence
  Description of Artificial Sequence: Synthetic peptide
  XENP022558 vlCDR1
RASQSVDYDGDSYMN

SEQ ID NO: 22562 - protein, 7 aa, Artificial Sequence
  Description of Artificial Sequence: Synthetic peptide
  XENP022558 vlCDR2
AASELES

SEQ ID NO: 22563 - protein, 9 aa, Artificial Sequence
  Description of Artificial Sequence: Synthetic peptide
  XENP022558 vlCDR3
QQSNEDPFT

SEQ ID NO: 22564 - protein, 450 aa, Artificial Sequence; identical to SEQ ID NO: 22504
  Description of Artificial Sequence: Synthetic polypeptide
  XENP022559 7G8_H3.33_L1.30-ipilimumab_H3.23_L0.129 Fab-Fc Heavy Chain

SEQ ID NO: 22565 - protein, 121 aa, Artificial Sequence; identical to SEQ ID NO: 22505
  Description of Artificial Sequence: Synthetic polypeptide
  VH of XENP022559

SEQ ID NO: 22566 - protein, 5 aa, Artificial Sequence
  Description of Artificial Sequence: Synthetic peptide
  XENP022559 vhCDR1
DAWMG

SEQ ID NO: 22567 - protein, 19 aa, Artificial Sequence
  Description of Artificial Sequence: Synthetic peptide
  XENP022559 vhCDR2
EISTKANNHATYYAESVKG

SEQ ID NO: 22568 - protein, 10 aa, Artificial Sequence
  Description of Artificial Sequence: Synthetic peptide
  XENP022559 vhCDR3
LATWDWYFDV

SEQ ID NO: 22569 - protein, 477 aa, Artificial Sequence; identical to SEQ ID NO: 21669
  Description of Artificial Sequence: Synthetic polypeptide
  XENP022559 7G8_H3.33_L1.30-ipilimumab_H3.23_L0.129 scFv-Fc Heavy Chain

SEQ ID NO: 22570 - protein, 118 aa, Artificial Sequence; identical to SEQ ID NO: 2632
  Description of Artificial Sequence: Synthetic polypeptide
  VH of XENP022559

SEQ ID NO: 22571 - protein, 108 aa, Artificial Sequence; identical to SEQ ID NO: 2768
  Description of Artificial Sequence: Synthetic polypeptide
  VL of XENP022559

SEQ ID NO: 22572 - protein, 231 aa, Artificial Sequence; identical to SEQ ID NO: 21532
  Description of Artificial Sequence: Synthetic polypeptide
  Fc chain of XENP022559

SEQ ID NO: 22573 - protein, 5 aa, Artificial Sequence
  Description of Artificial Sequence: Synthetic peptide
  XENP022559 vhCDR1
SYTMH

SEQ ID NO: 22574 - protein, 17 aa, Artificial Sequence
  Description of Artificial Sequence: Synthetic peptide
  XENP022559 vhCDR2
FISYDGNYKYYADSVKG

SEQ ID NO: 22575 - protein, 9 aa, Artificial Sequence
  Description of Artificial Sequence: Synthetic peptide
  XENP022559 vhCDR3
GGHLGPFDL

SEQ ID NO: 22576 - protein, 12 aa, Artificial Sequence
  Description of Artificial Sequence: Synthetic peptide
  XENP022559 vlCDR1
RASQSVGSSYLA

SEQ ID NO: 22577 - protein, 7 aa, Artificial Sequence
  Description of Artificial Sequence: Synthetic peptide
  XENP022559 vlCDR2
GASSRAT

SEQ ID NO: 22578 - protein, 9 aa, Artificial Sequence
  Description of Artificial Sequence: Synthetic peptide
  XENP022559 vlCDR3
QQYGSSPWT

SEQ ID NO: 22579 - protein, 218 aa, Artificial Sequence; identical to SEQ ID NO: 22539
  Description of Artificial Sequence: Synthetic polypeptide
  XENP022559 7G8_H3.33_L1.30-ipilimumab_H3.23_L0.129 Light Chain

SEQ ID NO: 22580 - protein, 111 aa, Artificial Sequence; identical to SEQ ID NO: 22540
  Description of Artificial Sequence: Synthetic polypeptide
  VL of XENP022559

SEQ ID NO: 22581 - protein, 15 aa, Artificial Sequence
  Description of Artificial Sequence: Synthetic peptide
  XENP022559 vlCDR1
RASQSVDYDGDSYMN

SEQ ID NO: 22582 - protein, 7 aa, Artificial Sequence
  Description of Artificial Sequence: Synthetic peptide
  XENP022559 vlCDR2
AASELES

SEQ ID NO: 22583 - protein, 9 aa, Artificial Sequence
  Description of Artificial Sequence: Synthetic peptide
  XENP022559 vlCDR3
QQSNEDPFT

SEQ ID NO: 22584 - protein, 450 aa, Artificial Sequence; identical to SEQ ID NO: 22484
  Description of Artificial Sequence: Synthetic polypeptide
  XENP022602 7G8_H3.30_L1.34-ipilimumab_H3.23_L0.129 Fab-Fc Heavy Chain

SEQ ID NO: 22585 - protein, 121 aa, Artificial Sequence; identical to SEQ ID NO: 22485
  Description of Artificial Sequence: Synthetic polypeptide
  VH of XENP022602

SEQ ID NO: 22586 - protein, 5 aa, Artificial Sequence
  Description of Artificial Sequence: Synthetic peptide
  XENP022602 vhCDR1
DAWMS

SEQ ID NO: 22587 - protein, 19 aa, Artificial Sequence
  Description of Artificial Sequence: Synthetic peptide
  XENP022602 vhCDR2
EISTKANNHATYYAESVKG

SEQ ID NO: 22588 - protein, 10 aa, Artificial Sequence
  Description of Artificial Sequence: Synthetic peptide
  XENP022602 vhCDR3
LATWDWYFDV

SEQ ID NO: 22589 - protein, 477 aa, Artificial Sequence; identical to SEQ ID NO: 21669
  Description of Artificial Sequence: Synthetic polypeptide
  XENP022602 7G8_H3.30_L1.34-ipilimumab_H3.23_L0.129 scFv-Fc Heavy Chain

SEQ ID NO: 22590 - protein, 118 aa, Artificial Sequence; identical to SEQ ID NO: 2632
  Description of Artificial Sequence: Synthetic polypeptide
  VH of XENP022602

SEQ ID NO: 22591 - protein, 108 aa, Artificial Sequence; identical to SEQ ID NO: 2768
  Description of Artificial Sequence: Synthetic polypeptide
  VL of XENP022602

SEQ ID NO: 22592 - protein, 231 aa, Artificial Sequence; identical to SEQ ID NO: 21532
  Description of Artificial Sequence: Synthetic polypeptide
  Fc chain of XENP022602

SEQ ID NO: 22593 - protein, 5 aa, Artificial Sequence
  Description of Artificial Sequence: Synthetic peptide
  XENP022602 vhCDR1
SYTMH

SEQ ID NO: 22594 - protein, 17 aa, Artificial Sequence
  Description of Artificial Sequence: Synthetic peptide
  XENP022602 vhCDR2
FISYDGNYKYYADSVKG

SEQ ID NO: 22595 - protein, 9 aa, Artificial Sequence
  Description of Artificial Sequence: Synthetic peptide
  XENP022602 vhCDR3
GGHLGPFDL

SEQ ID NO: 22596 - protein, 12 aa, Artificial Sequence
  Description of Artificial Sequence: Synthetic peptide
  XENP022602 vlCDR1
RASQSVGSSYLA

SEQ ID NO: 22597 - protein, 7 aa, Artificial Sequence
  Description of Artificial Sequence: Synthetic peptide
  XENP022602 vlCDR2
GASSRAT

SEQ ID NO: 22598 - protein, 9 aa, Artificial Sequence
  Description of Artificial Sequence: Synthetic peptide
  XENP022602 vlCDR3
QQYGSSPWT

SEQ ID NO: 22599 - protein, 218 aa, Artificial Sequence
  Description of Artificial Sequence: Synthetic polypeptide
  XENP022602 7G8_H3.30_L1.34-ipilimumab_H3.23_L0.129 Light Chain
DIVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22600 - protein, 111 aa, Artificial Sequence
  Description of Artificial Sequence: Synthetic polypeptide
  VL of XENP022602
DIVLTQSPSSLSASVGDRVTITCRASQSVDYDGDSYMNWYQQKPGKPPKLLIYAASELESGIPARFSGSGSGTDFTLTISSLQPEDFATYYCQQSNEDPFTFGSGTKLEIK

SEQ ID NO: 22601 - protein, 15 aa, Artificial Sequence
  Description of Artificial Sequence: Synthetic peptide
  XENP022602 vlCDR1
RASQSVDYDGDSYMN

SEQ ID NO: 22602 - protein, 7 aa, Artificial Sequence
  Description of Artificial Sequence: Synthetic peptide
  XENP022602 vlCDR2
AASELES

SEQ ID NO: 22603 - protein, 9 aa, Artificial Sequence
  Description of Artificial Sequence: Synthetic peptide
  XENP022602 vlCDR3
QQSNEDPFT

SEQ ID NO: 22604 - protein, 450 aa, Artificial Sequence; identical to SEQ ID NO: 22484
  Description of Artificial Sequence: Synthetic polypeptide
  XENP022603 7G8_H3.30_L1.36-ipilimumab_H3.23_L0.129 Fab-Fc Heavy Chain

SEQ ID NO: 22605 - protein, 121 aa, Artificial Sequence; identical to SEQ ID NO: 22485
  Description of Artificial Sequence: Synthetic polypeptide
  VH of XENP022603

SEQ ID NO: 22606 - protein, 5 aa, Artificial Sequence
  Description of Artificial Sequence: Synthetic peptide
  XENP022603 vhCDR1
DAWMS

SEQ ID NO: 22607 - protein, 19 aa, Artificial Sequence
  Description of Artificial Sequence: Synthetic peptide
  XENP022603 vhCDR2
EISTKANNHATYYAESVKG

SEQ ID NO: 22608 - protein, 10 aa, Artificial Sequence
  Description of Artificial Sequence: Synthetic peptide
  XENP022603 vhCDR3
LATWDWYFDV

SEQ ID NO: 22609 - protein, 477 aa, Artificial Sequence; identical to SEQ ID NO: 21669
  Description of Artificial Sequence: Synthetic polypeptide
  XENP022603 7G8_H3.30_L1.36-ipilimumab_H3.23_L0.129 scFv-Fc Heavy Chain

SEQ ID NO: 22610 - protein, 118 aa, Artificial Sequence; identical to SEQ ID NO: 2632
  Description of Artificial Sequence: Synthetic polypeptide
  VH of XENP022603

SEQ ID NO: 22611 - protein, 108 aa, Artificial Sequence; identical to SEQ ID NO: 2768
  Description of Artificial Sequence: Synthetic polypeptide
  VL of XENP022603

SEQ ID NO: 22612 - protein, 231 aa, Artificial Sequence; identical to SEQ ID NO: 21532
  Description of Artificial Sequence: Synthetic polypeptide
  Fc chain of XENP022603

SEQ ID NO: 22613 - protein, 5 aa, Artificial Sequence
  Description of Artificial Sequence: Synthetic peptide
  XENP022603 vhCDR1
SYTMH

SEQ ID NO: 22614 - protein, 17 aa, Artificial Sequence
  Description of Artificial Sequence: Synthetic peptide
  XENP022603 vhCDR2
FISYDGNYKYYADSVKG

SEQ ID NO: 22615 - protein, 9 aa, Artificial Sequence
  Description of Artificial Sequence: Synthetic peptide
  XENP022603 vhCDR3
GGHLGPFDL

SEQ ID NO: 22616 - protein, 12 aa, Artificial Sequence
  Description of Artificial Sequence: Synthetic peptide
  XENP022603 vlCDR1
RASQSVGSSYLA

SEQ ID NO: 22617 - protein, 7 aa, Artificial Sequence
  Description of Artificial Sequence: Synthetic peptide
  XENP022603 vlCDR2
GASSRAT

SEQ ID NO: 22618 - protein, 9 aa, Artificial Sequence
  Description of Artificial Sequence: Synthetic peptide
  XENP022603 vlCDR3
QQYGSSPWT

SEQ ID NO: 22619 - protein, 218 aa, Artificial Sequence
  Description of Artificial Sequence: Synthetic polypeptide
  XENP022603 7G8_H3.30_L1.36-ipilimumab_H3.23_L0.129 Light Chain
DIVLTQSPSSLSASVGDRVTITCRASQSVDHDGDSYMNWYQQKPGKPPKLLIYAASELESGIPARFSGSGSGTDFTLTISSLQPEDFATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22620 - protein, 111 aa, Artificial Sequence
  Description of Artificial Sequence: Synthetic polypeptide
  VL of XENP022603
DIVLTQSPSSLSASVGDRVTITCRASQSVDHDGDSYMNWYQQKPGKPPKLLIYAASELESGIPARFSGSGSGTDFTLTISSLQPEDFATYYCQQSNEDPFTFGSGTKLEIK

SEQ ID NO: 22621 - protein, 15 aa, Artificial Sequence
  Description of Artificial Sequence: Synthetic peptide
  XENP022603 vlCDR1
RASQSVDHDGDSYMN

SEQ ID NO: 22622 - protein, 7 aa, Artificial Sequence
  Description of Artificial Sequence: Synthetic peptide
  XENP022603 vlCDR2
AASELES

SEQ ID NO: 22623 - protein, 9 aa, Artificial Sequence
  Description of Artificial Sequence: Synthetic peptide
  XENP022603 vlCDR3
QQSNEDPFT

SEQ ID NO: 22624 - protein, 448 aa, Artificial Sequence
  Description of Artificial Sequence: Synthetic polypeptide
  XENP017979 4C7_H0L0-ipilimumab_H0L0 Fab-Fc Heavy Chain
QVQLQESGPGLVKPSETLSLTCTVHGGSINHYYWSWIRQPPGKGLEWIGYIYYSGSTKYNPSLKSRVSISVDTSKNQFSLKLTSVTAADTAVYYCAREWPYYYYEMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22625 - protein, 119 aa, Artificial Sequence; identical to SEQ ID NO: 20886
  Description of Artificial Sequence: Synthetic polypeptide
  VH of XENP017979

SEQ ID NO: 22626 - protein, 5 aa, Artificial Sequence
  Description of Artificial Sequence: Synthetic peptide
  XENP017979 vhCDR1
HYYWS

SEQ ID NO: 22627 - protein, 16 aa, Artificial Sequence
  Description of Artificial Sequence: Synthetic peptide
  XENP017979 vhCDR2
YIYYSGSTKYNPSLKS

SEQ ID NO: 22628 - protein, 11 aa, Artificial Sequence
  Description of Artificial Sequence: Synthetic peptide
  XENP017979 vhCDR3
EWPYYYYEMDV

SEQ ID NO: 22629 - protein, 477 aa, Artificial Sequence; identical to SEQ ID NO: 21529
  Description of Artificial Sequence: Synthetic polypeptide
  XENP017979 4C7_H0L0-ipilimumab_H0L0 scFv-Fc Heavy Chain

SEQ ID NO: 22630 - protein, 118 aa, Artificial Sequence; identical to SEQ ID NO: 22
  Description of Artificial Sequence: Synthetic polypeptide
  VH of XENP017979

SEQ ID NO: 22631 - protein, 108 aa, Artificial Sequence; identical to SEQ ID NO: 23
  Description of Artificial Sequence: Synthetic polypeptide
  VL of XENP017979

SEQ ID NO: 22632 - protein, 231 aa, Artificial Sequence; identical to SEQ ID NO: 21532
  Description of Artificial Sequence: Synthetic polypeptide
  Fc chain of XENP017979

SEQ ID NO: 22633 - protein, 5 aa, Artificial Sequence
  Description of Artificial Sequence: Synthetic peptide
  XENP017979 vhCDR1
SYTMH

SEQ ID NO: 22634 - protein, 17 aa, Artificial Sequence
  Description of Artificial Sequence: Synthetic peptide
  XENP017979 vhCDR2
FISYDGNNKYYADSVKG

SEQ ID NO: 22635 - protein, 9 aa, Artificial Sequence
  Description of Artificial Sequence: Synthetic peptide
  XENP017979 vhCDR3
TGWLGPFDY

SEQ ID NO: 22636 - protein, 12 aa, Artificial Sequence
  Description of Artificial Sequence: Synthetic peptide
  XENP017979 vlCDR1
RASQSVGSSYLA

SEQ ID NO: 22637 - protein, 7 aa, Artificial Sequence
  Description of Artificial Sequence: Synthetic peptide
  XENP017979 vlCDR2
GAFSRAT

SEQ ID NO: 22638 - protein, 9 aa, Artificial Sequence
  Description of Artificial Sequence: Synthetic peptide
  XENP017979 vlCDR3
QQYGSSPWT

SEQ ID NO: 22639 - protein, 215 aa, Artificial Sequence; identical to SEQ ID NO: 20890
  Description of Artificial Sequence: Synthetic polypeptide
  XENP017979 4C7_H0L0-ipilimumab_H0L0 Light Chain

SEQ ID NO: 22640 - protein, 108 aa, Artificial Sequence; identical to SEQ ID NO: 20891
  Description of Artificial Sequence: Synthetic polypeptide
  VL of XENP017979

SEQ ID NO: 22641 - protein, 12 aa, Artificial Sequence
  Description of Artificial Sequence: Synthetic peptide
  XENP017979 vlCDR1
RASQSVSSSYLA

SEQ ID NO: 22642 - protein, 7 aa, Artificial Sequence
  Description of Artificial Sequence: Synthetic peptide
  XENP017979 vlCDR2
GASSRAT

SEQ ID NO: 22643 - protein, 9 aa, Artificial Sequence
  Description of Artificial Sequence: Synthetic peptide
  XENP017979 vlCDR3
QQYGSSFRT

SEQ ID NO: 22644 - protein, 450 aa, Artificial Sequence
  Description of Artificial Sequence: Synthetic polypeptide
  XENP017980 8D5_H0L0-ipilimumab_H0L0 Fab-Fc Heavy Chain
EVQLVESGGGLVQPGGSLRLSCAASGFTISSYDMHWVRQATGKGLEWVSVIGPAGDTYYPGSVKGRFTISRENAKNSLYLQMNSLRAGDTAVYYCAREGMAAHNYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22645 - protein, 121 aa, Artificial Sequence; identical to SEQ ID NO: 20896
  Description of Artificial Sequence: Synthetic polypeptide
  VH of XENP017980

SEQ ID NO: 22646 - protein, 5 aa, Artificial Sequence
  Description of Artificial Sequence: Synthetic peptide
  XENP017980 vhCDR1
SYDMH

SEQ ID NO: 22647 - protein, 16 aa, Artificial Sequence
  Description of Artificial Sequence: Synthetic peptide
  XENP017980 vhCDR2
VIGPAGDTYYPGSVKG

SEQ ID NO: 22648 - protein, 13 aa, Artificial Sequence
  Description of Artificial Sequence: Synthetic peptide
  XENP017980 vhCDR3
EGMAAHNYYGMDV

SEQ ID NO: 22649 - protein, 477 aa, Artificial Sequence; identical to SEQ ID NO: 21529
  Description of Artificial Sequence: Synthetic polypeptide
  XENP017980 8D5_H0L0-ipilimumab_H0L0 scFv-Fc Heavy Chain

SEQ ID NO: 22650 - protein, 118 aa, Artificial Sequence; identical to SEQ ID NO: 22
  Description of Artificial Sequence: Synthetic polypeptide
  VH of XENP017980

SEQ ID NO: 22651 - protein, 108 aa, Artificial Sequence; identical to SEQ ID NO: 23
  Description of Artificial Sequence: Synthetic polypeptide
  VL of XENP017980

SEQ ID NO: 22652 - protein, 231 aa, Artificial Sequence; identical to SEQ ID NO: 21532
  Description of Artificial Sequence: Synthetic polypeptide
  Fc chain of XENP017980

SEQ ID NO: 22653 - protein, 5 aa, Artificial Sequence
  Description of Artificial Sequence: Synthetic peptide
  XENP017980 vhCDR1
SYTMH

SEQ ID NO: 22654 - protein, 17 aa, Artificial Sequence
  Description of Artificial Sequence: Synthetic peptide
  XENP017980 vhCDR2
FISYDGNNKYYADSVKG

SEQ ID NO: 22655 - protein, 9 aa, Artificial Sequence
  Description of Artificial Sequence: Synthetic peptide
  XENP017980 vhCDR3
TGWLGPFDY

SEQ ID NO: 22656 - protein, 12 aa, Artificial Sequence
  Description of Artificial Sequence: Synthetic peptide
  XENP017980 vlCDR1
RASQSVGSSYLA

SEQ ID NO: 22657 - protein, 7 aa, Artificial Sequence
  Description of Artificial Sequence: Synthetic peptide
  XENP017980 vlCDR2
GAFSRAT

SEQ ID NO: 22658 - protein, 9 aa, Artificial Sequence
  Description of Artificial Sequence: Synthetic peptide
  XENP017980 vlCDR3
QQYGSSPWT

SEQ ID NO: 22659 - protein, 215 aa, Artificial Sequence; identical to SEQ ID NO: 20900
  Description of Artificial Sequence: Synthetic polypeptide
  XENP017980 8D5_H0L0-ipilimumab_H0L0 Light Chain

SEQ ID NO: 22660 - protein, 108 aa, Artificial Sequence; identical to SEQ ID NO: 20901
  Description of Artificial Sequence: Synthetic polypeptide
  VL of XENP017980

SEQ ID NO: 22661 - protein, 11 aa, Artificial Sequence
  Description of Artificial Sequence: Synthetic peptide
  XENP017980 vlCDR1
RASQSVSSYLA

SEQ ID NO: 22662 - protein, 7 aa, Artificial Sequence
  Description of Artificial Sequence: Synthetic peptide
  XENP017980 vlCDR2
DASNRAT

SEQ ID NO: 22663 - protein, 10 aa, Artificial Sequence
  Description of Artificial Sequence: Synthetic peptide
  XENP017980 vlCDR3
QQRSNWPPIT

SEQ ID NO: 22664 - protein, 457 aa, Artificial Sequence
  Description of Artificial Sequence: Synthetic polypeptide
  XENP017981 E8D9_H0L0-ipilimumab_H0L0 Fab-Fc Heavy Chain
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHTSITEVRGAIIYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22665 - protein, 128 aa, Artificial Sequence; identical to SEQ ID NO: 20906
  Description of Artificial Sequence: Synthetic polypeptide
  VH of XENP017981

SEQ ID NO: 22666 - protein, 7 aa, Artificial Sequence
  Description of Artificial Sequence: Synthetic peptide
  XENP017981 vhCDR1
TSGVGVG

SEQ ID NO: 22667 - protein, 16 aa, Artificial Sequence
  Description of Artificial Sequence: Synthetic peptide
  XENP017981 vhCDR2
LIYWDDDKRYSPSLKS

SEQ ID NO: 22668 - protein, 18 aa, Artificial Sequence
  Description of Artificial Sequence: Synthetic peptide
  XENP017981 vhCDR3
TSITEVRGAIIYYYGMDV

SEQ ID NO: 22669 - protein, 477 aa, Artificial Sequence; identical to SEQ ID NO: 21529
  Description of Artificial Sequence: Synthetic polypeptide
  XENP017981 E8D9_H0L0-ipilimumab_H0L0 scFv-Fc Heavy Chain

SEQ ID NO: 22670 - protein, 118 aa, Artificial Sequence; identical to SEQ ID NO: 22
  Description of Artificial Sequence: Synthetic polypeptide
  VH of XENP017981

SEQ ID NO: 22671 - protein, 108 aa, Artificial Sequence; identical to SEQ ID NO: 23
  Description of Artificial Sequence: Synthetic polypeptide
  VL of XENP017981

SEQ ID NO: 22672 - protein, 231 aa, Artificial Sequence; identical to SEQ ID NO: 21532
  Description of Artificial Sequence: Synthetic polypeptide
  Fc chain of XENP017981

SEQ ID NO: 22673 - protein, 5 aa, Artificial Sequence
  Description of Artificial Sequence: Synthetic peptide
  XENP017981 vhCDR1
SYTMH

SEQ ID NO: 22674 - protein, 17 aa, Artificial Sequence
  Description of Artificial Sequence: Synthetic peptide
  XENP017981 vhCDR2
FISYDGNNKYYADSVKG

SEQ ID NO: 22675 - protein, 9 aa, Artificial Sequence
  Description of Artificial Sequence: Synthetic peptide
  XENP017981 vhCDR3
TGWLGPFDY

SEQ ID NO: 22676 - protein, 12 aa, Artificial Sequence
  Description of Artificial Sequence: Synthetic peptide
  XENP017981 vlCDR1
RASQSVGSSYLA

SEQ ID NO: 22677 - protein, 7 aa, Artificial Sequence
  Description of Artificial Sequence: Synthetic peptide
  XENP017981 vlCDR2
GAFSRAT

SEQ ID NO: 22678 - protein, 9 aa, Artificial Sequence
  Description of Artificial Sequence: Synthetic peptide
  XENP017981 vlCDR3
QQYGSSPWT

SEQ ID NO: 22679 - protein, 214 aa, Artificial Sequence; identical to SEQ ID NO: 20910
  Description of Artificial Sequence: Synthetic polypeptide
  XENP017981 E8D9_H0L0-ipilimumab_H0L0 Light Chain

SEQ ID NO: 22680 - protein, 107 aa, Artificial Sequence; identical to SEQ ID NO: 20911
  Description of Artificial Sequence: Synthetic polypeptide
  VL of XENP017981

SEQ ID NO: 22681 - protein, 12 aa, Artificial Sequence
  Description of Artificial Sequence: Synthetic peptide
  XENP017981 vlCDR1
RASQSVSSSYLA

SEQ ID NO: 22682 - protein, 7 aa, Artificial Sequence
  Description of Artificial Sequence: Synthetic peptide
  XENP017981 vlCDR2
GASSRAT

SEQ ID NO: 22683 - protein, 8 aa, Artificial Sequence
  Description of Artificial Sequence: Synthetic peptide
  XENP017981 vlCDR3
QQYGHSLT

SEQ ID NO: 22684 - protein, 448 aa, Artificial Sequence; identical to SEQ ID NO: 22624
  Description of Artificial Sequence: Synthetic polypeptide
  XENP017982 4C7_H0L0-Tremelimumab_H0L0 Fab-Fc Heavy Chain

SEQ ID NO: 22685 - protein, 119 aa, Artificial Sequence; identical to SEQ ID NO: 20886
  Description of Artificial Sequence: Synthetic polypeptide
  VH of XENP017982

SEQ ID NO: 22686 - protein, 5 aa, Artificial Sequence
  Description of Artificial Sequence: Synthetic peptide
  XENP017982 vhCDR1
HYYWS

SEQ ID NO: 22687 - protein, 16 aa, Artificial Sequence
  Description of Artificial Sequence: Synthetic peptide
  XENP017982 vhCDR2
YIYYSGSTKYNPSLKS

SEQ ID NO: 22688 - protein, 11 aa, Artificial Sequence
  Description of Artificial Sequence: Synthetic peptide
  XENP017982 vhCDR3
EWPYYYYEMDV

SEQ ID NO: 22689 - protein, 483 aa, Artificial Sequence
  Description of Artificial Sequence: Synthetic polypeptide
  XENP017982 4C7_H0L0-Tremelimumab_H0L0 scFv-Fc Heavy Chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSGKPGSGKPGSGKPGSGKPGSDIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22690 - protein, 125 aa, Artificial Sequence
  Description of Artificial Sequence: Synthetic polypeptide
  VH of XENP017982
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 22691 - protein, 107 aa, Artificial Sequence
  Description of Artificial Sequence: Synthetic polypeptide
  VL of XENP017982
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 22692 - protein, 231 aa, Artificial Sequence; identical to SEQ ID NO: 21532
  Description of Artificial Sequence: Synthetic polypeptide
  Fc chain of XENP017982

SEQ ID NO: 22693 - protein, 5 aa, Artificial Sequence
  Description of Artificial Sequence: Synthetic peptide
  XENP017982 vhCDR1
SYGMH

SEQ ID NO: 22694 - protein, 17 aa, Artificial Sequence
  Description of Artificial Sequence: Synthetic peptide
  XENP017982 vhCDR2
VIWYDGSNKYYADSVKG

SEQ ID NO: 22695 - protein, 16 aa, Artificial Sequence
  Description of Artificial Sequence: Synthetic peptide
  XENP017982 vhCDR3
DPRGATLYYYYYGMDV

SEQ ID NO: 22696 - protein, 11 aa, Artificial Sequence
  Description of Artificial Sequence: Synthetic peptide
  XENP017982 vlCDR1
RASQSINSYLD

SEQ ID NO: 22697 - protein, 7 aa, Artificial Sequence
  Description of Artificial Sequence: Synthetic peptide
  XENP017982 vlCDR2
AASSLQS

SEQ ID NO: 22698 - protein, 9 aa, Artificial Sequence
  Description of Artificial Sequence: Synthetic peptide
  XENP017982 vlCDR3
QQYYSTPFT

SEQ ID NO: 22699 - protein, 215 aa, Artificial Sequence; identical to SEQ ID NO: 20890
  Description of Artificial Sequence: Synthetic polypeptide
  XENP017982 4C7_H0L0-Tremelimumab_H0L0 Light Chain

SEQ ID NO: 22700 - protein, 108 aa, Artificial Sequence; identical to SEQ ID NO: 20891
  Description of Artificial Sequence: Synthetic polypeptide
  VL of XENP017982

SEQ ID NO: 22701 - protein, 12 aa, Artificial Sequence
  Description of Artificial Sequence: Synthetic peptide
  XENP017982 vlCDR1
RASQSVSSSYLA

SEQ ID NO: 22702 - protein, 7 aa, Artificial Sequence
  Description of Artificial Sequence: Synthetic peptide
  XENP017982 vlCDR2
GASSRAT

SEQ ID NO: 22703 - protein, 9 aa, Artificial Sequence
  Description of Artificial Sequence: Synthetic peptide
  XENP017982 vlCDR3
QQYGSSFRT

SEQ ID NO: 22704 - protein, 450 aa, Artificial Sequence; identical to SEQ ID NO: 22644
  Description of Artificial Sequence: Synthetic polypeptide
  XENP017983 8D5_H0L0-Tremelimumab_H0L0 Fab-Fc Heavy Chain

SEQ ID NO: 22705 - protein, 121 aa, Artificial Sequence; identical to SEQ ID NO: 20896
  Description of Artificial Sequence: Synthetic polypeptide
  VH of XENP017983

SEQ ID NO: 22706 - protein, 5 aa, Artificial Sequence
  Description of Artificial Sequence: Synthetic peptide
  XENP017983 vhCDR1
SYDMH

SEQ ID NO: 22707 - protein, 16 aa, Artificial Sequence
  Description of Artificial Sequence: Synthetic peptide
  XENP017983 vhCDR2
VIGPAGDTYYPGSVKG

SEQ ID NO: 22708 - protein, 13 aa, Artificial Sequence
  Description of Artificial Sequence: Synthetic peptide
  XENP017983 vhCDR3
EGMAAHNYYGMDV

SEQ ID NO: 22709 - protein, 483 aa, Artificial Sequence; identical to SEQ ID NO: 22689
  Description of Artificial Sequence: Synthetic polypeptide
  XENP017983 8D5_H0L0-Tremelimumab_H0L0 scFv-Fc Heavy Chain

SEQ ID NO: 22710 - protein, 125 aa, Artificial Sequence; identical to SEQ ID NO: 22690
  Description of Artificial Sequence: Synthetic polypeptide
  VH of XENP017983

SEQ ID NO: 22711 - protein, 107 aa, Artificial Sequence; identical to SEQ ID NO: 22691
  Description of Artificial Sequence: Synthetic polypeptide
  VL of XENP017983

SEQ ID NO: 22712 - protein, 231 aa, Artificial Sequence; identical to SEQ ID NO: 21532
  Description of Artificial Sequence: Synthetic polypeptide
  Fc chain of XENP017983

SEQ ID NO: 22713 - protein, 5 aa, Artificial Sequence
  Description of Artificial Sequence: Synthetic peptide
  XENP017983 vhCDR1
SYGMH

SEQ ID NO: 22714 - protein, 17 aa, Artificial Sequence
  Description of Artificial Sequence: Synthetic peptide
  XENP017983 vhCDR2
VIWYDGSNKYYADSVKG

SEQ ID NO: 22715 - protein, 16 aa, Artificial Sequence
  Description of Artificial Sequence: Synthetic peptide
  XENP017983 vhCDR3
DPRGATLYYYYYGMDV

SEQ ID NO: 22716 - protein, 11 aa, Artificial Sequence
  Description of Artificial Sequence: Synthetic peptide
  XENP017983 vlCDR1
RASQSINSYLD

SEQ ID NO: 22717 - protein, 7 aa, Artificial Sequence
  Description of Artificial Sequence: Synthetic peptide
  XENP017983 vlCDR2
AASSLQS

SEQ ID NO: 22718 - protein, 9 aa, Artificial Sequence
  Description of Artificial Sequence: Synthetic peptide
  XENP017983 vlCDR3
QQYYSTPFT

SEQ ID NO: 22719 - protein, 215 aa, Artificial Sequence; identical to SEQ ID NO: 20900
  Description of Artificial Sequence: Synthetic polypeptide
  XENP017983 8D5_H0L0-Tremelimumab_H0L0 Light Chain

SEQ ID NO: 22720 - protein, 108 aa, Artificial Sequence; identical to SEQ ID NO: 20901
  Description of Artificial Sequence: Synthetic polypeptide
  VL of XENP017983

SEQ ID NO: 22721 - protein, 11 aa, Artificial Sequence
  Description of Artificial Sequence: Synthetic peptide
  XENP017983 vlCDR1
RASQSVSSYLA

SEQ ID NO: 22722 - protein, 7 aa, Artificial Sequence
  Description of Artificial Sequence: Synthetic peptide
  XENP017983 vlCDR2
DASNRAT

SEQ ID NO: 22723 - protein, 10 aa, Artificial Sequence
  Description of Artificial Sequence: Synthetic peptide
  XENP017983 vlCDR3
QQRSNWPPIT

SEQ ID NO: 22724 - protein, 457 aa, Artificial Sequence; identical to SEQ ID NO: 22664
  Description of Artificial Sequence: Synthetic polypeptide
  XENP017984 E8D9_H0L0-Tremelimumab_H0L0 Fab-Fc Heavy Chain

SEQ ID NO: 22725 - protein, 128 aa, Artificial Sequence; identical to SEQ ID NO: 20906
  Description of Artificial Sequence: Synthetic polypeptide
  VH of XENP017984

SEQ ID NO: 22726 - protein, 7 aa, Artificial Sequence
  Description of Artificial Sequence: Synthetic peptide
  XENP017984 vhCDR1
TSGVGVG

SEQ ID NO: 22727 - protein, 16 aa, Artificial Sequence
  Description of Artificial Sequence: Synthetic peptide
  XENP017984 vhCDR2
LIYWDDDKRYSPSLKS

SEQ ID NO: 22728 - protein, 18 aa, Artificial Sequence
  Description of Artificial Sequence: Synthetic peptide
  XENP017984 vhCDR3
TSITEVRGAIIYYYGMDV

SEQ ID NO: 22729 - protein, 483 aa, Artificial Sequence; identical to SEQ ID NO: 22689
  Description of Artificial Sequence: Synthetic polypeptide
  XENP017984 E8D9_H0L0-Tremelimumab_H0L0 scFv-Fc Heavy Chain

SEQ ID NO: 22730 - protein, 125 aa, Artificial Sequence; identical to SEQ ID NO: 22690
  Description of Artificial Sequence: Synthetic polypeptide
  VH of XENP017984

SEQ ID NO: 22731 - protein, 107 aa, Artificial Sequence; identical to SEQ ID NO: 22691
  Description of Artificial Sequence: Synthetic polypeptide
  VL of XENP017984

SEQ ID NO: 22732 - protein, 231 aa, Artificial Sequence; identical to SEQ ID NO: 21532
  Description of Artificial Sequence: Synthetic polypeptide
  Fc chain of XENP017984

SEQ ID NO: 22733 - protein, 5 aa, Artificial Sequence
  Description of Artificial Sequence: Synthetic peptide
  XENP017984 vhCDR1
SYGMH

SEQ ID NO: 22734 - protein, 17 aa, Artificial Sequence
  Description of Artificial Sequence: Synthetic peptide
  XENP017984 vhCDR2
VIWYDGSNKYYADSVKG

SEQ ID NO: 22735 - protein, 16 aa, Artificial Sequence
  Description of Artificial Sequence: Synthetic peptide
  XENP017984 vhCDR3
DPRGATLYYYYYGMDV

SEQ ID NO: 22736 - protein, 11 aa, Artificial Sequence
  Description of Artificial Sequence: Synthetic peptide
  XENP017984 vlCDR1
RASQSINSYLD

SEQ ID NO: 22737 - protein, 7 aa, Artificial Sequence
  Description of Artificial Sequence: Synthetic peptide
  XENP017984 vlCDR2
AASSLQS

SEQ ID NO: 22738 - protein, 9 aa, Artificial Sequence
  Description of Artificial Sequence: Synthetic peptide
  XENP017984 vlCDR3
QQYYSTPFT

SEQ ID NO: 22739 - protein, 214 aa, Artificial Sequence; identical to SEQ ID NO: 20910
  Description of Artificial Sequence: Synthetic polypeptide
  XENP017984 E8D9_H0L0-Tremelimumab_H0L0 Light Chain

SEQ ID NO: 22740 - protein, 107 aa, Artificial Sequence; identical to SEQ ID NO: 20911
  Description of Artificial Sequence: Synthetic polypeptide
  VL of XENP017984

SEQ ID NO: 22741 - protein, 12 aa, Artificial Sequence
  Description of Artificial Sequence: Synthetic peptide
  XENP017984 vlCDR1
RASQSVSSSYLA

SEQ ID NO: 22742 - protein, 7 aa, Artificial Sequence
  Description of Artificial Sequence: Synthetic peptide
  XENP017984 vlCDR2
GASSRAT

SEQ ID NO: 22743 - protein, 8 aa, Artificial Sequence
  Description of Artificial Sequence: Synthetic peptide
  XENP017984 vlCDR3
QQYGHSLT

SEQ ID NO: 22744 - protein, 448 aa, Artificial Sequence; identical to SEQ ID NO: 22624
  Description of Artificial Sequence: Synthetic polypeptide
  XENP017886 4C7_H0L0-nivolumab_H0.1_L0 Fab-Fc Heavy Chain

SEQ ID NO: 22745 - protein, 119 aa, Artificial Sequence; identical to SEQ ID NO: 20886
  Description of Artificial Sequence: Synthetic polypeptide
  VH of XENP017886

SEQ ID NO: 22746 - protein, 5 aa, Artificial Sequence
  Description of Artificial Sequence: Synthetic peptide
  XENP017886 vhCDR1
HYYWS

SEQ ID NO: 22747 - protein, 16 aa, Artificial Sequence
  Description of Artificial Sequence: Synthetic peptide
  XENP017886 vhCDR2
YIYYSGSTKYNPSLKS

SEQ ID NO: 22748 - protein, 11 aa, Artificial Sequence
  Description of Artificial Sequence: Synthetic peptide
  XENP017886 vhCDR3
EWPYYYYEMDV

SEQ ID NO: 22749 - protein, 471 aa, Artificial Sequence
  Description of Artificial Sequence: Synthetic polypeptide
  XENP017886 4C7_H0L0-nivolumab_H0.1_L0 scFv-Fc Heavy Chain
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22750 - protein, 113 aa, Artificial Sequence; identical to SEQ ID NO: 6210
  Description of Artificial Sequence: Synthetic polypeptide
  VH of XENP017886

SEQ ID NO: 22751 - protein, 107 aa, Artificial Sequence [sequence omitted]

SEQ ID NO: 22752 - protein, 231 aa, Artificial Sequence; identical to SEQ ID NO: 21532
  Description of Artificial Sequence: Synthetic polypeptide
  Fc chain of XENP017886

SEQ ID NO: 22753 - protein, 5 aa, Artificial Sequence
  Description of Artificial Sequence: Synthetic peptide
  XENP017886 vhCDR1
NSGMH

SEQ ID NO: 22754 - protein, 17 aa, Artificial Sequence
  Description of Artificial Sequence: Synthetic peptide
  XENP017886 vhCDR2
VIWYDGSKRYYADSVKG

SEQ ID NO: 22755 - protein, 4 aa, Artificial Sequence
  Description of Artificial Sequence: Synthetic peptide
  XENP017886 vhCDR3
NDDY

SEQ ID NO: 22756 - protein, 11 aa, Artificial Sequence
  Description of Artificial Sequence: Synthetic peptide
  XENP017886 vlCDR1
RASQSVSSYLA

SEQ ID NO: 22757 - protein, 7 aa, Artificial Sequence
  Description of Artificial Sequence: Synthetic peptide
  XENP017886 vlCDR2
DASNRAT

SEQ ID NO: 22758 - protein, 9 aa, Artificial Sequence
  Description of Artificial Sequence: Synthetic peptide
  XENP017886 vlCDR3
QQSSNWPRT

SEQ ID NO: 22759 - protein, 215 aa, Artificial Sequence; identical to SEQ ID NO: 20890
  Description of Artificial Sequence: Synthetic polypeptide
  XENP017886 4C7_H0L0-nivolumab_H0.1_L0 Light Chain

SEQ ID NO: 22760 - protein, 108 aa, Artificial Sequence; identical to SEQ ID NO: 20891
  Description of Artificial Sequence: Synthetic polypeptide
  VL of XENP017886

SEQ ID NO: 22761 - protein, 12 aa, Artificial Sequence
  Description of Artificial Sequence: Synthetic peptide
  XENP017886 vlCDR1
RASQSVSSSYLA

SEQ ID NO: 22762 - protein, 7 aa, Artificial Sequence
  Description of Artificial Sequence: Synthetic peptide
  XENP017886 vlCDR2
GASSRAT

SEQ ID NO: 22763 - protein, 9 aa, Artificial Sequence
  Description of Artificial Sequence: Synthetic peptide
  XENP017886 vlCDR3
QQYGSSFRT

SEQ ID NO: 22764 - protein, 450 aa, Artificial Sequence; identical to SEQ ID NO: 22644
  Description of Artificial Sequence: Synthetic polypeptide
  XENP017887 8D5_H0L0-nivolumab_H0.1_L0 Fab-Fc Heavy Chain

SEQ ID NO: 22765 - protein, 121 aa, Artificial Sequence; identical to SEQ ID NO: 20896
  Description of Artificial Sequence: Synthetic polypeptide
  VH of XENP017887

SEQ ID NO: 22766 - protein, 5 aa, Artificial Sequence
  Description of Artificial Sequence: Synthetic peptide
  XENP017887 vhCDR1
SYDMH

SEQ ID NO: 22767 - protein, 16 aa, Artificial Sequence
  Description of Artificial Sequence: Synthetic peptide
  XENP017887 vhCDR2
VIGPAGDTYYPGSVKG

SEQ ID NO: 22768 - protein, 13 aa, Artificial Sequence
  Description of Artificial Sequence: Synthetic peptide
  XENP017887 vhCDR3
EGMAAHNYYGMDV

SEQ ID NO: 22769 - protein, 471 aa, Artificial Sequence; identical to SEQ ID NO: 22749
  Description of Artificial Sequence: Synthetic polypeptide
  XENP017887 8D5_H0L0-nivolumab_H0.1_L0 scFv-Fc Heavy Chain

SEQ ID NO: 22770 - protein, 113 aa, Artificial Sequence; identical to SEQ ID NO: 6210
  Description of Artificial Sequence: Synthetic polypeptide
  VH of XENP017887

SEQ ID NO: 22771 - protein, 107 aa, Artificial Sequence [sequence omitted]

SEQ ID NO: 22772 - protein, 231 aa, Artificial Sequence; identical to SEQ ID NO: 21532
  Description of Artificial Sequence: Synthetic polypeptide
  Fc chain of XENP017887

SEQ ID NO: 22773 - protein, 5 aa, Artificial Sequence
  Description of Artificial Sequence: Synthetic peptide
  XENP017887 vhCDR1
NSGMH

SEQ ID NO: 22774 - protein, 17 aa, Artificial Sequence
  Description of Artificial Sequence: Synthetic peptide
  XENP017887 vhCDR2
VIWYDGSKRYYADSVKG

SEQ ID NO: 22775 - protein, 4 aa, Artificial Sequence
  Description of Artificial Sequence: Synthetic peptide
  XENP017887 vhCDR3
NDDY

SEQ ID NO: 22776 - protein, 11 aa, Artificial Sequence
  Description of Artificial Sequence: Synthetic peptide
  XENP017887 vlCDR1
RASQSVSSYLA

SEQ ID NO: 22777 - protein, 7 aa, Artificial Sequence
  Description of Artificial Sequence: Synthetic peptide
  XENP017887 vlCDR2
DASNRAT

SEQ ID NO: 22778 - protein, 9 aa, Artificial Sequence
  Description of Artificial Sequence: Synthetic peptide
  XENP017887 vlCDR3
QQSSNWPRT

SEQ ID NO: 22779 - protein, 215 aa, Artificial Sequence; identical to SEQ ID NO: 20900
  Description of Artificial Sequence: Synthetic polypeptide
  XENP017887 8D5_H0L0-nivolumab_H0.1_L0 Light Chain

SEQ ID NO: 22780 - protein, 108 aa, Artificial Sequence; identical to SEQ ID NO: 20901
  Description of Artificial Sequence: Synthetic polypeptide
  VL of XENP017887

SEQ ID NO: 22781 - protein, 11 aa, Artificial Sequence
  Description of Artificial Sequence: Synthetic peptide
  XENP017887 vlCDR1
RASQSVSSYLA

SEQ ID NO: 22782 - protein, 7 aa, Artificial Sequence
  Description of Artificial Sequence: Synthetic peptide
  XENP017887 vlCDR2
DASNRAT

SEQ ID NO: 22783 - protein, 10 aa, Artificial Sequence
  Description of Artificial Sequence: Synthetic peptide
  XENP017887 vlCDR3
QQRSNWPPIT

SEQ ID NO: 22784 - protein, 457 aa, Artificial Sequence; identical to SEQ ID NO: 22664
  Description of Artificial Sequence: Synthetic polypeptide
  XENP017888 E8D9_H0L0-nivolumab_H0.1_L0 Fab-Fc Heavy Chain

SEQ ID NO: 22785 - protein, 128 aa, Artificial Sequence; identical to SEQ ID NO: 20906
  Description of Artificial Sequence: Synthetic polypeptide
  VH of XENP017888

SEQ ID NO: 22786 - protein, 7 aa, Artificial Sequence
  Description of Artificial Sequence: Synthetic peptide
  XENP017888 vhCDR1
TSGVGVG

SEQ ID NO: 22787 - protein, 16 aa, Artificial Sequence
  Description of Artificial Sequence: Synthetic peptide
  XENP017888 vhCDR2
LIYWDDDKRYSPSLKS

SEQ ID NO: 22788 - protein, 18 aa, Artificial Sequence
  Description of Artificial Sequence: Synthetic peptide
  XENP017888 vhCDR3
TSITEVRGAIIYYYGMDV

SEQ ID NO: 22789 - protein, 471 aa, Artificial Sequence; identical to SEQ ID NO: 22749
  Description of Artificial Sequence: Synthetic polypeptide
  XENP017888 E8D9_H0L0-nivolumab_H0.1_L0 scFv-Fc Heavy Chain

SEQ ID NO: 22790 - protein, 113 aa, Artificial Sequence; identical to SEQ ID NO: 6210
  Description of Artificial Sequence: Synthetic polypeptide
  VH of XENP017888

SEQ ID NO: 22791 - protein, 107 aa, Artificial Sequence [sequence omitted]

SEQ ID NO: 22792 - protein, 231 aa, Artificial Sequence; identical to SEQ ID NO: 21532
  Description of Artificial Sequence: Synthetic polypeptide
  Fc chain of XENP017888

SEQ ID NO: 22793 - protein, 5 aa, Artificial Sequence
  Description of Artificial Sequence: Synthetic peptide
  XENP017888 vhCDR1
NSGMH

SEQ ID NO: 22794 - protein, 17 aa, Artificial Sequence
  Description of Artificial Sequence: Synthetic peptide
  XENP017888 vhCDR2
VIWYDGSKRYYADSVKG

SEQ ID NO: 22795 - protein, 4 aa, Artificial Sequence
  Description of Artificial Sequence: Synthetic peptide
  XENP017888 vhCDR3
NDDY

SEQ ID NO: 22796 - protein, 11 aa, Artificial Sequence
  Description of Artificial Sequence: Synthetic peptide
  XENP017888 vlCDR1
RASQSVSSYLA

SEQ ID NO: 22797 - protein, 7 aa, Artificial Sequence
  Description of Artificial Sequence: Synthetic peptide
  XENP017888 vlCDR2
DASNRAT

SEQ ID NO: 22798 - protein, 9 aa, Artificial Sequence
  Description of Artificial Sequence: Synthetic peptide
  XENP017888 vlCDR3
QQSSNWPRT

SEQ ID NO: 22799 - protein, 214 aa, Artificial Sequence; identical to SEQ ID NO: 20910
  Description of Artificial Sequence: Synthetic polypeptide
  XENP017888 E8D9_H0L0-nivolumab_H0.1_L0 Light Chain

SEQ ID NO: 22800 - protein, 107 aa, Artificial Sequence; identical to SEQ ID NO: 20911
  Description of Artificial Sequence: Synthetic polypeptide
  VL of XENP017888

SEQ ID NO: 22801 - protein, 12 aa, Artificial Sequence
  Description of Artificial Sequence: Synthetic peptide
  XENP017888 vlCDR1
RASQSVSSSYLA

SEQ ID NO: 22802 - protein, 7 aa, Artificial Sequence
  Description of Artificial Sequence: Synthetic peptide
  XENP017888 vlCDR2
GASSRAT

SEQ ID NO: 22803 - protein, 8 aa, Artificial Sequence
  Description of Artificial Sequence: Synthetic peptide
  XENP017888 vlCDR3
QQYGHSLT

SEQ ID NO: 22804 - protein, 449 aa, Artificial Sequence
  Description of Artificial Sequence: Synthetic polypeptide
  XENP020280 3F6_H0L0_anti-BTLA-1G6_H1.280_L1.224 Fab-Fc Heavy Chain
EVQLQESGPSLVKPSQTLSLTCSVTGDSITSGYWNWIRKFPGNKLEYMGYLSYSGSTYYNPSLKSRISITRDTSKNQYYLQLNSVTTEDTATYYCARYFYGSYYEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22805 - protein, 120 aa, Artificial Sequence; identical to SEQ ID NO: 20916
  Description of Artificial Sequence: Synthetic polypeptide
  VH of XENP020280

SEQ ID NO: 22806 - protein, 5 aa, Artificial Sequence
  Description of Artificial Sequence: Synthetic peptide
  XENP020280 vhCDR1
SGYWN

SEQ ID NO: 22807 - protein, 16 aa, Artificial Sequence
  Description of Artificial Sequence: Synthetic peptide
  XENP020280 vhCDR2
YLSYSGSTYYNPSLKS

SEQ ID NO: 22808 - protein, 12 aa, Artificial Sequence
  Description of Artificial Sequence: Synthetic peptide
  XENP020280 vhCDR3
YFYGSYYEAMDY

SEQ ID NO: 22809 - protein, 480 aa, Artificial Sequence
  Description of Artificial Sequence: Synthetic polypeptide
  XENP020280 3F6_H0L0_anti-BTLA-1G6_H1.280_L1.224 scFv-Fc Heavy Chain
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22810 - protein, 122 aa, Artificial Sequence; identical to SEQ ID NO: 10917
  Description of Artificial Sequence: Synthetic polypeptide
  VH of XENP020280

SEQ ID NO: 22811 - protein, 107 aa, Artificial Sequence
  Description of Artificial Sequence: Synthetic polypeptide
  VL of XENP020280
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 22812 - protein, 231 aa, Artificial Sequence; identical to SEQ ID NO: 21532
  Description of Artificial Sequence: Synthetic polypeptide
  Fc chain of XENP020280

SEQ ID NO: 22813 - protein, 5 aa, Artificial Sequence
  Description of Artificial Sequence: Synthetic peptide
  XENP020280 vhCDR1
NYWMN

SEQ ID NO: 22814 - protein, 19 aa, Artificial Sequence
  Description of Artificial Sequence: Synthetic peptide
  XENP020280 vhCDR2
EIRLYSNNYATHYAESVKG

SEQ ID NO: 22815 - protein, 11 aa, Artificial Sequence
  Description of Artificial Sequence: Synthetic peptide
  XENP020280 vhCDR3
YYGNYGGYFDV

SEQ ID NO: 22816 - protein, 11 aa, Artificial Sequence
  Description of Artificial Sequence: Synthetic peptide
  XENP020280 vlCDR1
RASQSVGNDVA

SEQ ID NO: 22817 - protein, 7 aa, Artificial Sequence
  Description of Artificial Sequence: Synthetic peptide
  XENP020280 vlCDR2
YASHRYT

SEQ ID NO: 22818 - protein, 9 aa, Artificial Sequence
  Description of Artificial Sequence: Synthetic peptide
  XENP020280 vlCDR3
QQDWSSPRT

SEQ ID NO: 22819 - protein, 214 aa, Artificial Sequence; identical to SEQ ID NO: 20920
  Description of Artificial Sequence: Synthetic polypeptide
  XENP020280 3F6_H0L0_anti-BTLA-1G6_H1.280_L1.224 Light Chain

SEQ ID NO: 22820 - protein, 107 aa, Artificial Sequence; identical to SEQ ID NO: 20921
  Description of Artificial Sequence: Synthetic polypeptide
  VL of XENP020280

SEQ ID NO: 22821 - protein, 11 aa, Artificial Sequence
  Description of Artificial Sequence: Synthetic peptide
  XENP020280 vlCDR1
RASKSISKYLA

SEQ ID NO: 22822 - protein, 7 aa, Artificial Sequence
  Description of Artificial Sequence: Synthetic peptide
  XENP020280 vlCDR2
SGSTLQS

SEQ ID NO: 22823 - protein, 9 aa, Artificial Sequence
  Description of Artificial Sequence: Synthetic peptide
  XENP020280 vlCDR3
QQHNEYPWT

SEQ ID NO: 22824 - protein, 448 aa, Artificial Sequence
  Description of Artificial Sequence: Synthetic polypeptide
  XENP020281 1A9_H0L0_anti-BTLA-1G6_H1.280_L1.224 Fab-Fc Heavy Chain
DVQLVESGGGLVQPGGSRKLSCAASGFTFSSFGMHWVRQAPEKGLEWVAYISSGISTIYYADTVKGRFTISRDNPKNTLFLQMTSLRSEDTAMYYCARDWLRGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22825 - protein, 119 aa, Artificial Sequence; identical to SEQ ID NO: 20926
  Description of Artificial Sequence: Synthetic polypeptide
  VH of XENP020281

SEQ ID NO: 22826 - protein, 5 aa, Artificial Sequence
  Description of Artificial Sequence: Synthetic peptide
  XENP020281 vhCDR1
SFGMH

SEQ ID NO: 22827 - protein, 17 aa, Artificial Sequence
  Description of Artificial Sequence: Synthetic peptide
  XENP020281 vhCDR2
YISSGISTIYYADTVKG

SEQ ID NO: 22828 - protein, 10 aa, Artificial Sequence
  Description of Artificial Sequence: Synthetic peptide
  XENP020281 vhCDR3
DWLRGYAMDY

SEQ ID NO: 22829 - protein, 480 aa, Artificial Sequence; identical to SEQ ID NO: 22809
  Description of Artificial Sequence: Synthetic polypeptide
  XENP020281 1A9_H0L0_anti-BTLA-1G6_H1.280_L1.224 scFv-Fc Heavy Chain

SEQ ID NO: 22830 - protein, 122 aa, Artificial Sequence; identical to SEQ ID NO: 10917
  Description of Artificial Sequence: Synthetic polypeptide
  VH of XENP020281

SEQ ID NO: 22831 - protein, 107 aa, Artificial Sequence; identical to SEQ ID NO: 22811
  Description of Artificial Sequence: Synthetic polypeptide
  VL of XENP020281

SEQ ID NO: 22832 - protein, 231 aa, Artificial Sequence; identical to SEQ ID NO: 21532
  Description of Artificial Sequence: Synthetic polypeptide
  Fc chain of XENP020281

SEQ ID NO: 22833 - protein, 5 aa, Artificial Sequence
  Description of Artificial Sequence: Synthetic peptide
  XENP020281 vhCDR1
NYWMN

SEQ ID NO: 22834 - protein, 19 aa, Artificial Sequence
  Description of Artificial Sequence: Synthetic peptide
  XENP020281 vhCDR2
EIRLYSNNYATHYAESVKG

SEQ ID NO: 22835 - protein, 11 aa, Artificial Sequence
  Description of Artificial Sequence: Synthetic peptide
  XENP020281 vhCDR3
YYGNYGGYFDV

SEQ ID NO: 22836 - protein, 11 aa, Artificial Sequence
  Description of Artificial Sequence: Synthetic peptide
  XENP020281 vlCDR1
RASQSVGNDVA

SEQ ID NO: 22837 - protein, 7 aa, Artificial Sequence
  Description of Artificial Sequence: Synthetic peptide
  XENP020281 vlCDR2
YASHRYT

SEQ ID NO: 22838 - protein, 9 aa, Artificial Sequence
  Description of Artificial Sequence: Synthetic peptide
  XENP020281 vlCDR3
QQDWSSPRT

SEQ ID NO: 22839 - protein, 218 aa, Artificial Sequence; identical to SEQ ID NO: 20930
  Description of Artificial Sequence: Synthetic polypeptide
  XENP020281 1A9_H0L0_anti-BTLA-1G6_H1.280_L1.224 Light Chain

SEQ ID NO: 22840 - protein, 111 aa, Artificial Sequence; identical to SEQ ID NO: 20931
  Description of Artificial Sequence: Synthetic polypeptide
  VL of XENP020281

SEQ ID NO: 22841 - protein, 15 aa, Artificial Sequence
  Description of Artificial Sequence: Synthetic peptide
  XENP020281 vlCDR1
KASQSIDYDGDSYMN

SEQ ID NO: 22842 - protein, 7 aa, Artificial Sequence
  Description of Artificial Sequence: Synthetic peptide
  XENP020281 vlCDR2
AASNLDF

SEQ ID NO: 22843 - protein, 9 aa, Artificial Sequence
  Description of Artificial Sequence: Synthetic peptide
  XENP020281 vlCDR3
QQSNEDPWT

SEQ ID NO: 22844 - protein, 447 aa, Artificial Sequence
  Description of Artificial Sequence: Synthetic polypeptide
  XENP020282 9C6_H0L0_anti-BTLA-1G6_H1.280_L1.224 Fab-Fc Heavy Chain
QVQLKESGPGLVAPSQSLSITCTVSGFSLTGYGVNWVRQPPGKGLEWLGMIWIDGSTDYNSALKSRLSINKDNSKSQVFLKMNSLQTDDTARYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22845 - protein, 118 aa, Artificial Sequence; identical to SEQ ID NO: 20936
  Description of Artificial Sequence: Synthetic polypeptide
  VH of XENP020282

SEQ ID NO: 22846 - protein, 5 aa, Artificial Sequence
  Description of Artificial Sequence: Synthetic peptide
  XENP020282 vhCDR1
GYGVN

SEQ ID NO: 22847 - protein, 16 aa, Artificial Sequence
  Description of Artificial Sequence: Synthetic peptide
  XENP020282 vhCDR2
MIWIDGSTDYNSALKS

SEQ ID NO: 22848 - protein, 10 aa, Artificial Sequence
  Description of Artificial Sequence: Synthetic peptide
  XENP020282 vhCDR3
DRPDGRAMDY

SEQ ID NO: 22849 - protein, 480 aa, Artificial Sequence; identical to SEQ ID NO: 22809
  Description of Artificial Sequence: Synthetic polypeptide
  XENP020282 9C6_H0L0_anti-BTLA-1G6_H1.280_L1.224 scFv-Fc Heavy Chain

SEQ ID NO: 22850 - protein, 122 aa, Artificial Sequence; identical to SEQ ID NO: 10917
  Description of Artificial Sequence: Synthetic polypeptide
  VH of XENP020282

SEQ ID NO: 22851 - protein, 107 aa, Artificial Sequence; identical to SEQ ID NO: 22811
  Description of Artificial Sequence: Synthetic polypeptide
  VL of XENP020282

SEQ ID NO: 22852 - protein, 231 aa, Artificial Sequence; identical to SEQ ID NO: 21532
  Description of Artificial Sequence: Synthetic polypeptide
  Fc chain of XENP020282

SEQ ID NO: 22853 - protein, 5 aa, Artificial Sequence
  Description of Artificial Sequence: Synthetic peptide
  XENP020282 vhCDR1
NYWMN

SEQ ID NO: 22854 - protein, 19 aa, Artificial Sequence
  Description of Artificial Sequence: Synthetic peptide
  XENP020282 vhCDR2
EIRLYSNNYATHYAESVKG

SEQ ID NO: 22855 - protein, 11 aa, Artificial Sequence
  Description of Artificial Sequence: Synthetic peptide
  XENP020282 vhCDR3
YYGNYGGYFDV

SEQ ID NO: 22856 - protein, 11 aa, Artificial Sequence
  Description of Artificial Sequence: Synthetic peptide
  XENP020282 vlCDR1
RASQSVGNDVA

SEQ ID NO: 22857 - protein, 7 aa, Artificial Sequence
  Description of Artificial Sequence: Synthetic peptide
  XENP020282 vlCDR2
YASHRYT

SEQ ID NO: 22858 - protein, 9 aa, Artificial Sequence
  Description of Artificial Sequence: Synthetic peptide
  XENP020282 vlCDR3
QQDWSSPRT

SEQ ID NO: 22859 - protein, 213 aa, Artificial Sequence; identical to SEQ ID NO: 20940
  Description of Artificial Sequence: Synthetic polypeptide
  XENP020282 9C6_H0L0_anti-BTLA-1G6_H1.280_L1.224 Light Chain

SEQ ID NO: 22860 - protein, 106 aa, Artificial Sequence; identical to SEQ ID NO: 20941
  Description of Artificial Sequence: Synthetic polypeptide
  VL of XENP020282

SEQ ID NO: 22861 - protein, 11 aa, Artificial Sequence
  Description of Artificial Sequence: Synthetic peptide
  XENP020282 vlCDR1
KASQSVSNDVA

SEQ ID NO: 22862 - protein, 7 aa, Artificial Sequence
  Description of Artificial Sequence: Synthetic peptide
  XENP020282 vlCDR2
YASNRYT

SEQ ID NO: 22863 - protein, 8 aa, Artificial Sequence
  Description of Artificial Sequence: Synthetic peptide
  XENP020282 vlCDR3
QQDYSSPT

SEQ ID NO: 22864 - protein, 447 aa, Artificial Sequence; identical to SEQ ID NO: 22844
  Description of Artificial Sequence: Synthetic polypeptide
  XENP020283 7H2_H0L0_anti-BTLA-1G6_H1.280_L1.224 Fab-Fc Heavy Chain

SEQ ID NO: 22865 - protein, 118 aa, Artificial Sequence; identical to SEQ ID NO: 20936
  Description of Artificial Sequence: Synthetic polypeptide
  VH of XENP020283

SEQ ID NO: 22866 - protein, 5 aa, Artificial Sequence
  Description of Artificial Sequence: Synthetic peptide
  XENP020283 vhCDR1
GYGVN

SEQ ID NO: 22867 - protein, 16 aa, Artificial Sequence
  Description of Artificial Sequence: Synthetic peptide
  XENP020283 vhCDR2
MIWIDGSTDYNSALKS

SEQ ID NO: 22868 - protein, 10 aa, Artificial Sequence
  Description of Artificial Sequence: Synthetic peptide
  XENP020283 vhCDR3
DRPDGRAMDY

SEQ ID NO: 22869 - protein, 480 aa, Artificial Sequence; identical to SEQ ID NO: 22809
  Description of Artificial Sequence: Synthetic polypeptide
  XENP020283 7H2_H0L0_anti-BTLA-1G6_H1.280_L1.224 scFv-Fc Heavy Chain

SEQ ID NO: 22870 - protein, 122 aa, Artificial Sequence; identical to SEQ ID NO: 10917
  Description of Artificial Sequence: Synthetic polypeptide
  VH of XENP020283

SEQ ID NO: 22871 - protein, 107 aa, Artificial Sequence; identical to SEQ ID NO: 22811
  Description of Artificial Sequence: Synthetic polypeptide
  VL of XENP020283

SEQ ID NO: 22872 - protein, 231 aa, Artificial Sequence; identical to SEQ ID NO: 21532
  Description of Artificial Sequence: Synthetic polypeptide
  Fc chain of XENP020283

SEQ ID NO: 22873 - protein, 5 aa, Artificial Sequence
  Description of Artificial Sequence: Synthetic peptide
  XENP020283 vhCDR1
NYWMN

SEQ ID NO: 22874 - protein, 19 aa, Artificial Sequence
  Description of Artificial Sequence: Synthetic peptide
  XENP020283 vhCDR2
EIRLYSNNYATHYAESVKG

SEQ ID NO: 22875 - protein, 11 aa, Artificial Sequence
  Description of Artificial Sequence: Synthetic peptide
  XENP020283 vhCDR3
YYGNYGGYFDV

SEQ ID NO: 22876 - protein, 11 aa, Artificial Sequence
  Description of Artificial Sequence: Synthetic peptide
  XENP020283 vlCDR1
RASQSVGNDVA

SEQ ID NO: 22877 - protein, 7 aa, Artificial Sequence
  Description of Artificial Sequence: Synthetic peptide
  XENP020283 vlCDR2
YASHRYT

SEQ ID NO: 22878 - protein, 9 aa, Artificial Sequence
  Description of Artificial Sequence: Synthetic peptide
  XENP020283 vlCDR3
QQDWSSPRT

SEQ ID NO: 22879 - protein, 213 aa, Artificial Sequence; identical to SEQ ID NO: 20950
  Description of Artificial Sequence: Synthetic polypeptide
  XENP020283 7H2_H0L0_anti-BTLA-1G6_H1.280_L1.224 Light Chain

SEQ ID NO: 22880 - protein, 106 aa, Artificial Sequence; identical to SEQ ID NO: 20951
  Description of Artificial Sequence: Synthetic polypeptide
  VL of XENP020283

SEQ ID NO: 22881 - protein, 11 aa, Artificial Sequence
  Description of Artificial Sequence: Synthetic peptide
  XENP020283 vlCDR1
KASQSVSNDVA

SEQ ID NO: 22882 - protein, 7 aa, Artificial Sequence
  Description of Artificial Sequence: Synthetic peptide
  XENP020283 vlCDR2
YASNRYT

SEQ ID NO: 22883 - protein, 8 aa, Artificial Sequence
  Description of Artificial Sequence: Synthetic peptide
  XENP020283 vlCDR3
QQDYNSPT

SEQ ID NO: 22884 - protein, 447 aa, Artificial Sequence
  Description of Artificial Sequence: Synthetic polypeptide
  XENP020284 6C3_H0L0_anti-BTLA-1G6_H1.280_L1.224 Fab-Fc Heavy Chain
EVQLQQSGAELVRSGASVKLSCTASGFNIKDYYMHWVKQRPEQGLEWIGWLDPENGDTVYVPKFQGKATMTADTSSNTAYLQLTSLTSEDSAVYYCNAGDYGSSFNYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22885 - protein, 118 aa, Artificial Sequence; identical to SEQ ID NO: 20956
  Description of Artificial Sequence: Synthetic polypeptide
  VH of XENP020284

SEQ ID NO: 22886 - protein, 5 aa, Artificial Sequence
  Description of Artificial Sequence: Synthetic peptide
  XENP020284 vhCDR1
DYYMH

SEQ ID NO: 22887 - protein, 17 aa, Artificial Sequence
  Description of Artificial Sequence: Synthetic peptide
  XENP020284 vhCDR2
WLDPENGDTVYVPKFQG

SEQ ID NO: 22888 - protein, 9 aa, Artificial Sequence
  Description of Artificial Sequence: Synthetic peptide
  XENP020284 vhCDR3
GDYGSSFNY

SEQ ID NO: 22889 - protein, 480 aa, Artificial Sequence; identical to SEQ ID NO: 22809
  Description of Artificial Sequence: Synthetic polypeptide
  XENP020284 6C3_H0L0_anti-BTLA-1G6_H1.280_L1.224 scFv-Fc Heavy Chain

SEQ ID NO: 22890 - protein, 122 aa, Artificial Sequence; identical to SEQ ID NO: 10917
  Description of Artificial Sequence: Synthetic polypeptide
  VH of XENP020284

SEQ ID NO: 22891 - protein, 107 aa, Artificial Sequence; identical to SEQ ID NO: 22811
  Description of Artificial Sequence: Synthetic polypeptide
  VL of XENP020284

SEQ ID NO: 22892 - protein, 231 aa, Artificial Sequence; identical to SEQ ID NO: 21532
  Description of Artificial Sequence: Synthetic polypeptide
  Fc chain of XENP020284

SEQ ID NO: 22893 - protein, 5 aa, Artificial Sequence
  Description of Artificial Sequence: Synthetic peptide
  XENP020284 vhCDR1
NYWMN

SEQ ID NO: 22894 - protein, 19 aa, Artificial Sequence
  Description of Artificial Sequence: Synthetic peptide
  XENP020284 vhCDR2
EIRLYSNNYATHYAESVKG

SEQ ID NO: 22895 - protein, 11 aa, Artificial Sequence
  Description of Artificial Sequence: Synthetic peptide
  XENP020284 vhCDR3
YYGNYGGYFDV

SEQ ID NO: 22896 - protein, 11 aa, Artificial Sequence
  Description of Artificial Sequence: Synthetic peptide
  XENP020284 vlCDR1
RASQSVGNDVA

SEQ ID NO: 22897 - protein, 7 aa, Artificial Sequence
  Description of Artificial Sequence: Synthetic peptide
  XENP020284 vlCDR2
YASHRYT

SEQ ID NO: 22898 - protein, 9 aa, Artificial Sequence
  Description of Artificial Sequence: Synthetic peptide
  XENP020284 vlCDR3
QQDWSSPRT

SEQ ID NO: 22899 - protein, 219 aa, Artificial Sequence; identical to SEQ ID NO: 20960
  Description of Artificial Sequence: Synthetic polypeptide
  XENP020284 6C3_H0L0_anti-BTLA-1G6_H1.280_L1.224 Light Chain

SEQ ID NO: 22900 - protein, 112 aa, Artificial Sequence; identical to SEQ ID NO: 20961
  Description of Artificial Sequence: Synthetic polypeptide
  VL of XENP020284

SEQ ID NO: 22901 - protein, 17 aa, Artificial Sequence
  Description of Artificial Sequence: Synthetic peptide
  XENP020284 vlCDR1
KSSQSLLYSGNQKNYLA

SEQ ID NO: 22902 - protein, 7 aa, Artificial Sequence
  Description of Artificial Sequence: Synthetic peptide
  XENP020284 vlCDR2
WASTRES

SEQ ID NO: 22903 - protein, 8 aa, Artificial Sequence
  Description of Artificial Sequence: Synthetic peptide
  XENP020284 vlCDR3
QQYYTYHT

SEQ ID NO: 22904 - protein, 449 aa, Artificial Sequence
  Description of Artificial Sequence: Synthetic polypeptide
  XENP020285 9C10_H0L0_anti-BTLA-1G6_H1.280_L1.224 Fab-Fc Heavy Chain
EVQLQESGPSLVKPSQTLSLTCSVTGDSITSGYWNWIRKFPGNKLEYMGYISYSGSTYYNPSLKSRISITRDTSKNQYYLQLNSVTTEDTATYYCARYYYGSYYEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22905 - protein, 120 aa, Artificial Sequence; identical to SEQ ID NO: 20966
  Description of Artificial Sequence: Synthetic polypeptide
  VH of XENP020285

SEQ ID NO: 22906 - protein, 5 aa, Artificial Sequence
  Description of Artificial Sequence: Synthetic peptide
  XENP020285 vhCDR1
SGYWN

SEQ ID NO: 22907 - protein, 16 aa, Artificial Sequence
  Description of Artificial Sequence: Synthetic peptide
  XENP020285 vhCDR2
YISYSGSTYYNPSLKS

SEQ ID NO: 22908 - protein, 12 aa, Artificial Sequence
  Description of Artificial Sequence: Synthetic peptide
  XENP020285 vhCDR3
YYYGSYYEAMDY

SEQ ID NO: 22909 - protein, 480 aa, Artificial Sequence; identical to SEQ ID NO: 22809
  Description of Artificial Sequence: Synthetic polypeptide
  XENP020285 9C10_H0L0_anti-BTLA-1G6_H1.280_L1.224 scFv-Fc Heavy Chain

SEQ ID NO: 22910 - protein, 122 aa, Artificial Sequence; identical to SEQ ID NO: 10917
  Description of Artificial Sequence: Synthetic polypeptide
  VH of XENP020285

SEQ ID NO: 22911 - protein, 107 aa, Artificial Sequence; identical to SEQ ID NO: 22811
  Description of Artificial Sequence: Synthetic polypeptide
  VL of XENP020285

SEQ ID NO: 22912 - protein, 231 aa, Artificial Sequence; identical to SEQ ID NO: 21532
  Description of Artificial Sequence: Synthetic polypeptide
  Fc chain of XENP020285

SEQ ID NO: 22913 - protein, 5 aa, Artificial Sequence
  Description of Artificial Sequence: Synthetic peptide
  XENP020285 vhCDR1
NYWMN

SEQ ID NO: 22914 - protein, 19 aa, Artificial Sequence
  Description of Artificial Sequence: Synthetic peptide
  XENP020285 vhCDR2
EIRLYSNNYATHYAESVKG

SEQ ID NO: 22915 - protein, 11 aa, Artificial Sequence
  Description of Artificial Sequence: Synthetic peptide
  XENP020285 vhCDR3
YYGNYGGYFDV

SEQ ID NO: 22916 - protein, 11 aa, Artificial Sequence
  Description of Artificial Sequence: Synthetic peptide
  XENP020285 vlCDR1
RASQSVGNDVA

SEQ ID NO: 22917 - protein, 7 aa, Artificial Sequence
  Description of Artificial Sequence: Synthetic peptide
  XENP020285 vlCDR2
YASHRYT

SEQ ID NO: 22918 - protein, 9 aa, Artificial Sequence
  Description of Artificial Sequence: Synthetic peptide
  XENP020285 vlCDR3
QQDWSSPRT

SEQ ID NO: 22919 - protein, 214 aa, Artificial Sequence; identical to SEQ ID NO: 20970
  Description of Artificial Sequence: Synthetic polypeptide
  XENP020285 9C10_H0L0_anti-BTLA-1G6_H1.280_L1.224 Light Chain

SEQ ID NO: 22920 - protein, 107 aa, Artificial Sequence; identical to SEQ ID NO: 20971
  Description of Artificial Sequence: Synthetic polypeptide
  VL of XENP020285

SEQ ID NO: 22921 - protein, 11 aa, Artificial Sequence
  Description of Artificial Sequence: Synthetic peptide
  XENP020285 vlCDR1
RASKSISKYLA

SEQ ID NO: 22922 - protein, 7 aa, Artificial Sequence
  Description of Artificial Sequence: Synthetic peptide
  XENP020285 vlCDR2
SGSTLQS

SEQ ID NO: 22923 - protein, 9 aa, Artificial Sequence
  Description of Artificial Sequence: Synthetic peptide
  XENP020285 vlCDR3
QQHNEYPWT

SEQ ID NO: 22924 - protein, 443 aa, Artificial Sequence
  Description of Artificial Sequence: Synthetic polypeptide
  XENP020286 12E6_H0L0_anti-BTLA-1G6_H1.280_L1.224 Fab-Fc Heavy Chain
QVQLQQSGAELMKPGASVKISCKATGYTFSNYWIEWVKQRPGHGLEWIGEILPGSGGTNYNEKFKGKATFTADTSSNTAYMQLSGLTSEDSAVYYCASPRYDLWGQGTSVTASSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22925 - protein, 114 aa, Artificial Sequence; identical to SEQ ID NO: 20976
  Description of Artificial Sequence: Synthetic polypeptide
  VH of XENP020286

SEQ ID NO: 22926 - protein, 5 aa, Artificial Sequence
  Description of Artificial Sequence: Synthetic peptide
  XENP020286 vhCDR1
NYWIE

SEQ ID NO: 22927 - protein, 17 aa, Artificial Sequence
  Description of Artificial Sequence: Synthetic peptide
  XENP020286 vhCDR2
EILPGSGGTNYNEKFKG

SEQ ID NO: 22928 - protein, 5 aa, Artificial Sequence
  Description of Artificial Sequence: Synthetic peptide
  XENP020286 vhCDR3
PRYDL

SEQ ID NO: 22929 - protein, 480 aa, Artificial Sequence; identical to SEQ ID NO: 22809
  Description of Artificial Sequence: Synthetic polypeptide
  XENP020286 12E6_H0L0_anti-BTLA-1G6_H1.280_L1.224 scFv-Fc Heavy Chain

SEQ ID NO: 22930 - protein, 122 aa, Artificial Sequence; identical to SEQ ID NO: 10917
  Description of Artificial Sequence: Synthetic polypeptide
  VH of XENP020286

SEQ ID NO: 22931 - protein, 107 aa, Artificial Sequence; identical to SEQ ID NO: 22811
  Description of Artificial Sequence: Synthetic polypeptide
  VL of XENP020286

SEQ ID NO: 22932 - protein, 231 aa, Artificial Sequence; identical to SEQ ID NO: 21532
  Description of Artificial Sequence: Synthetic polypeptide
  Fc chain of XENP020286

SEQ ID NO: 22933 - protein, 5 aa, Artificial Sequence
  Description of Artificial Sequence: Synthetic peptide
  XENP020286 vhCDR1
NYWMN

SEQ ID NO: 22934 - protein, 19 aa, Artificial Sequence
  Description of Artificial Sequence: Synthetic peptide
  XENP020286 vhCDR2
EIRLYSNNYATHYAESVKG

SEQ ID NO: 22935 - protein, 11 aa, Artificial Sequence
  Description of Artificial Sequence: Synthetic peptide
  XENP020286 vhCDR3
YYGNYGGYFDV

SEQ ID NO: 22936 - protein, 11 aa, Artificial Sequence
  Description of Artificial Sequence: Synthetic peptide
  XENP020286 vlCDR1
RASQSVGNDVA

SEQ ID NO: 22937 - protein, 7 aa, Artificial Sequence
  Description of Artificial Sequence: Synthetic peptide
  XENP020286 vlCDR2
YASHRYT

SEQ ID NO: 22938 - protein, 9 aa, Artificial Sequence
  Description of Artificial Sequence: Synthetic peptide
  XENP020286 vlCDR3
QQDWSSPRT

SEQ ID NO: 22939 - protein, 219 aa, Artificial Sequence; identical to SEQ ID NO: 20980
  Description of Artificial Sequence: Synthetic polypeptide
  XENP020286 12E6_H0L0_anti-BTLA-1G6_H1.280_L1.224 Light Chain

SEQ ID NO: 22940 - protein, 112 aa, Artificial Sequence; identical to SEQ ID NO: 20981
  Description of Artificial Sequence: Synthetic polypeptide
  VL of XENP020286

SEQ ID NO: 22941 - protein, 16 aa, Artificial Sequence
  Description of Artificial Sequence: Synthetic peptide
  XENP020286 vlCDR1
KSSQSLLHSDGETYLN

SEQ ID NO: 22942 - protein, 7 aa, Artificial Sequence
  Description of Artificial Sequence: Synthetic peptide
  XENP020286 vlCDR2
LVSKRDS

SEQ ID NO: 22943 - protein, 9 aa, Artificial Sequence
  Description of Artificial Sequence: Synthetic peptide
  XENP020286 vlCDR3
WQGIHFPQT

SEQ ID NO: 22944 - protein, 442 aa, Artificial Sequence
  Description of Artificial Sequence: Synthetic polypeptide
  XENP020287 4C11A_H0L0_anti-BTLA-1G6_H1.280_L1.224 Fab-Fc Heavy Chain
QVQLQQSGAELVKPGASVKLSCKASGYTFTSYYMDWVKQRPGQGLEWIGEINPSNGDTKFNEKFKSKATLTVDKSSTTAYMQLSSLTSEDSAVYYCTRDYGYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 22945 - protein, 113 aa, Artificial Sequence; identical to SEQ ID NO: 20986
  Description of Artificial Sequence: Synthetic polypeptide
  VH of XENP020287

SEQ ID NO: 22946 - protein, 5 aa, Artificial Sequence
  Description of Artificial Sequence: Synthetic peptide
  XENP020287 vhCDR1
SYYMD

SEQ ID NO: 22947 - protein, 17 aa, Artificial Sequence
  Description of Artificial Sequence: Synthetic peptide
  XENP020287 vhCDR2
EINPSNGDTKFNEKFKS

SEQ ID NO: 22948 - protein, 4 aa, Artificial Sequence
  Description of Artificial Sequence: Synthetic peptide
  XENP020287 vhCDR3
DYGY

SEQ ID NO: 22949 - protein, 480 aa, Artificial Sequence; identical to SEQ ID NO: 22809
  Description of Artificial Sequence: Synthetic polypeptide
  XENP020287 4C11A_H0L0_anti-BTLA-1G6_H1.280_L1.224 scFv-Fc Heavy Chain

SEQ ID NO: 22950 - protein, 122 aa, Artificial Sequence; identical to SEQ ID NO: 10917
  Description of Artificial Sequence: Synthetic polypeptide
  VH of XENP020287

SEQ ID NO: 22951 - protein, 107 aa, Artificial Sequence; identical to SEQ ID NO: 22811
  Description of Artificial Sequence: Synthetic polypeptide
  VL of XENP020287

SEQ ID NO: 22952 - protein, 231 aa, Artificial Sequence; identical to SEQ ID NO: 21532
  Description of Artificial Sequence: Synthetic polypeptide
  Fc chain of XENP020287

SEQ ID NO: 22953 - protein, 5 aa, Artificial Sequence
  Description of Artificial Sequence: Synthetic peptide
  XENP020287 vhCDR1
NYWMN

SEQ ID NO: 22954 - protein, 19 aa, Artificial Sequence
  Description of Artificial Sequence: Synthetic peptide
  XENP020287 vhCDR2
EIRLYSNNYATHYAESVKG

SEQ ID NO: 22955 - protein, 11 aa, Artificial Sequence
  Description of Artificial Sequence: Synthetic peptide
  XENP020287 vhCDR3
YYGNYGGYFDV

SEQ ID NO: 22956 - protein, 11 aa, Artificial Sequence
  Description of Artificial Sequence: Synthetic peptide
  XENP020287 vlCDR1
RASQSVGNDVA

SEQ ID NO: 22957 - protein, 7 aa, Artificial Sequence
  Description of Artificial Sequence: Synthetic peptide
  XENP020287 vlCDR2
YASHRYT

SEQ ID NO: 22958 - protein, 9 aa, Artificial Sequence
  Description of Artificial Sequence: Synthetic peptide
  XENP020287 vlCDR3
QQDWSSPRT

SEQ ID NO: 22959 - protein, 214 aa, Artificial Sequence; identical to SEQ ID NO: 20990
  Description of Artificial Sequence: Synthetic polypeptide
  XENP020287 4C11A_H0L0_anti-BTLA-1G6_H1.280_L1.224 Light Chain

SEQ ID NO: 22960 - protein, 107 aa, Artificial Sequence; identical to SEQ ID NO: 20991
  Description of Artificial Sequence: Synthetic polypeptide
  VL of XENP020287

SEQ ID NO: 22961 - protein, 11 aa, Artificial Sequence
  Description of Artificial Sequence: Synthetic peptide
  XENP020287 vlCDR1
RASQSISDYLH

SEQ ID NO: 22962 - protein, 7 aa, Artificial Sequence
  Description of Artificial Sequence: Synthetic peptide
  XENP020287 vlCDR2
YASQSIS

SEQ ID NO: 22963 - protein, 9 aa, Artificial Sequence
  Description of Artificial Sequence: Synthetic peptide
  XENP020287 vlCDR3
QNGHSFPPT

SEQ ID NO: 22964 - protein, 442 aa, Artificial Sequence; identical to SEQ ID NO: 22944
  Description of Artificial Sequence: Synthetic polypeptide
  XENP020288 4C11B_H0L0_anti-BTLA-1G6_H1.280_L1.224 Fab-Fc Heavy Chain

SEQ ID NO: 22965 - protein, 113 aa, Artificial Sequence; identical to SEQ ID NO: 20986
  Description of Artificial Sequence: Synthetic polypeptide
  VH of XENP020288

SEQ ID NO: 22966 - protein, 5 aa, Artificial Sequence
  Description of Artificial Sequence: Synthetic peptide
  XENP020288 vhCDR1
SYYMD

SEQ ID NO: 22967 - protein, 17 aa, Artificial Sequence
  Description of Artificial Sequence: Synthetic peptide
  XENP020288 vhCDR2
EINPSNGDTKFNEKFKS

SEQ ID NO: 22968 - protein, 4 aa, Artificial Sequence
  Description of Artificial Sequence: Synthetic peptide
  XENP020288 vhCDR3
DYGY

SEQ ID NO: 22969 - protein, 480 aa, Artificial Sequence; identical to SEQ ID NO: 22809
  Description of Artificial Sequence: Synthetic polypeptide
  XENP020288 4C11B_H0L0_anti-BTLA-1G6_H1.280_L1.224 scFv-Fc Heavy Chain

SEQ ID NO: 22970 - protein, 122 aa, Artificial Sequence; identical to SEQ ID NO: 10917
  Description of Artificial Sequence: Synthetic polypeptide
  VH of XENP020288

SEQ ID NO: 22971 - protein, 107 aa, Artificial Sequence; identical to SEQ ID NO: 22811
  Description of Artificial Sequence: Synthetic polypeptide
  VL of XENP020288

SEQ ID NO: 22972 - protein, 231 aa, Artificial Sequence; identical to SEQ ID NO: 21532
  Description of Artificial Sequence: Synthetic polypeptide
  Fc chain of XENP020288

SEQ ID NO: 22973 - protein, 5 aa, Artificial Sequence
  Description of Artificial Sequence: Synthetic peptide
  XENP020288 vhCDR1
NYWMN

SEQ ID NO: 22974 - protein, 19 aa, Artificial Sequence
  Description of Artificial Sequence: Synthetic peptide
  XENP020288 vhCDR2
EIRLYSNNYATHYAESVKG

SEQ ID NO: 22975 - protein, 11 aa, Artificial Sequence
  Description of Artificial Sequence: Synthetic peptide
  XENP020288 vhCDR3
YYGNYGGYFDV

SEQ ID NO: 22976 - protein, 11 aa, Artificial Sequence
  Description of Artificial Sequence: Synthetic peptide
  XENP020288 vlCDR1
RASQSVGNDVA

SEQ ID NO: 22977 - protein, 7 aa, Artificial Sequence
  Description of Artificial Sequence: Synthetic peptide
  XENP020288 vlCDR2
YASHRYT

SEQ ID NO: 22978 - protein, 9 aa, Artificial Sequence
  Description of Artificial Sequence: Synthetic peptide
  XENP020288 vlCDR3
QQDWSSPRT

SEQ ID NO: 22979 - protein, 213 aa, Artificial Sequence; identical to SEQ ID NO: 20940
  Description of Artificial Sequence: Synthetic polypeptide
  XENP020288 4C11B_H0L0_anti-BTLA-1G6_H1.280_L1.224 Light Chain

SEQ ID NO: 22980 - protein, 106 aa, Artificial Sequence; identical to SEQ ID NO: 20941
  Description of Artificial Sequence: Synthetic polypeptide
  VL of XENP020288

SEQ ID NO: 22981 - protein, 11 aa, Artificial Sequence
  Description of Artificial Sequence: Synthetic peptide
  XENP020288 vlCDR1
KASQSVSNDVA

SEQ ID NO: 22982 - protein, 7 aa, Artificial Sequence
  Description of Artificial Sequence: Synthetic peptide
  XENP020288 vlCDR2
YASNRYT

SEQ ID NO: 22983 - protein, 8 aa, Artificial Sequence
  Description of Artificial Sequence: Synthetic peptide
  XENP020288 vlCDR3
QQDYSSPT

SEQ ID NO: 22984 - protein, 449 aa, Artificial Sequence
  Description of Artificial Sequence: Synthetic polypeptide
  XENP020289 7B10_H0L0_anti-BTLA-1G6_H1.280_L1.224 Fab-Fc Heavy Chain
QVTLKESGPGILQPSQTLSLTCSFSGFSLSTFGMGVNWIRQPSGKGLEWLAHIYWDDDKHYNPSLKSRLTISKDTSNNQVFLKITTVDTADTATYYCARYYRYDVPYIMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSP

SEQ ID NO: 22985 - protein, 122 aa, Artificial Sequence; identical to SEQ ID NO: 21006
  Description of Artificial Sequence: Synthetic polypeptide
  VH of XENP020289

SEQ ID NO: 22986 - protein, 7 aa, Artificial Sequence
  Description of Artificial Sequence: Synthetic peptide
  XENP020289 vhCDR1
TFGMGVN

SEQ ID NO: 22987 - protein, 16 aa, Artificial Sequence
  Description of Artificial Sequence: Synthetic peptide
  XENP020289 vhCDR2
HIYWDDDKHYNPSLKS

SEQ ID NO: 22988 - protein, 12 aa, Artificial Sequence
  Description of Artificial Sequence: Synthetic peptide
  XENP020289 vhCDR3
YYRYDVPYIMDY

SEQ ID NO: 22989 - protein, 480 aa, Artificial Sequence; identical to SEQ ID NO: 22809
  Description of Artificial Sequence: Synthetic polypeptide
  XENP020289 7B10_H0L0_anti-BTLA-1G6_H1.280_L1.224 scFv-Fc Heavy Chain

SEQ ID NO: 22990 - protein, 122 aa, Artificial Sequence; identical to SEQ ID NO: 10917
  Description of Artificial Sequence: Synthetic polypeptide
  VH of XENP020289

SEQ ID NO: 22991 - protein, 107 aa, Artificial Sequence; identical to SEQ ID NO: 22811
  Description of Artificial Sequence: Synthetic polypeptide
  VL of XENP020289

SEQ ID NO: 22992 - protein, 231 aa, Artificial Sequence; identical to SEQ ID NO: 21532
  Description of Artificial Sequence: Synthetic polypeptide
  Fc chain of XENP020289

SEQ ID NO: 22993 - protein, 5 aa, Artificial Sequence
  Description of Artificial Sequence: Synthetic peptide
  XENP020289 vhCDR1
NYWMN

SEQ ID NO: 22994 - protein, 19 aa, Artificial Sequence
  Description of Artificial Sequence: Synthetic peptide
  XENP020289 vhCDR2
EIRLYSNNYATHYAESVKG

SEQ ID NO: 22995 - protein, 11 aa, Artificial Sequence
  Description of Artificial Sequence: Synthetic peptide
  XENP020289 vhCDR3
YYGNYGGYFDV

SEQ ID NO: 22996 - protein, 11 aa, Artificial Sequence
  Description of Artificial Sequence: Synthetic peptide
  XENP020289 vlCDR1
RASQSVGNDVA

SEQ ID NO: 22997 - protein, 7 aa, Artificial Sequence
  Description of Artificial Sequence: Synthetic peptide
  XENP020289 vlCDR2
YASHRYT

SEQ ID NO: 22998 - protein, 9 aa, Artificial Sequence
  Description of Artificial Sequence: Synthetic peptide
  XENP020289 vlCDR3
QQDWSSPRT

SEQ ID NO: 22999 - protein, 219 aa, Artificial Sequence; identical to SEQ ID NO: 21010
  Description of Artificial Sequence: Synthetic polypeptide
  XENP020289 7B10_H0L0_anti-BTLA-1G6_H1.280_L1.224 Light Chain

SEQ ID NO: 23000 - protein, 112 aa, Artificial Sequence; identical to SEQ ID NO: 21011
  Description of Artificial Sequence: Synthetic polypeptide
  VL of XENP020289

SEQ ID NO: 23001 - protein, 17 aa, Artificial Sequence
  Description of Artificial Sequence: Synthetic peptide
  XENP020289 vlCDR1
KSSQSLLYSSNQKNYLA

SEQ ID NO: 23002 - protein, 7 aa, Artificial Sequence
  Description of Artificial Sequence: Synthetic peptide
  XENP020289 vlCDR2
WASTRES

SEQ ID NO: 23003 - protein, 8 aa, Artificial Sequence
  Description of Artificial Sequence: Synthetic peptide
  XENP020289 vlCDR3
HQYYSYYT

SEQ ID NO: 23004 - protein, 449 aa, Artificial Sequence
  Description of Artificial Sequence: Synthetic polypeptide
  XENP020290 8C1A_H0L0_anti-BTLA-1G6_H1.280_L1.224 Fab-Fc Heavy Chain
EVQLQESGPSLVKPSQTLSLTCSVTGDSVTSGYWNWIRKFPGNKLEYMGYINYSGSTYYNPSLKSRISITRDTSKNQYYLQLNSVTTEDTATYYCARSFIATVGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23005 - protein, 120 aa, Artificial Sequence; identical to SEQ ID NO: 21016
  Description of Artificial Sequence: Synthetic polypeptide
  VH of XENP020290

SEQ ID NO: 23006 - protein, 5 aa, Artificial Sequence
  Description of Artificial Sequence: Synthetic peptide
  XENP020290 vhCDR1
SGYWN

SEQ ID NO: 23007 - protein, 16 aa, Artificial Sequence
  Description of Artificial Sequence: Synthetic peptide
  XENP020290 vhCDR2
YINYSGSTYYNPSLKS

SEQ ID NO: 23008 - protein, 12 aa, Artificial Sequence
  Description of Artificial Sequence: Synthetic peptide
  XENP020290 vhCDR3
SFIATVGYAMDY

SEQ ID NO: 23009 - protein, 480 aa, Artificial Sequence; identical to SEQ ID NO: 22809
  Description of Artificial Sequence: Synthetic polypeptide
  XENP020290 8C1A_H0L0_anti-BTLA-1G6_H1.280_L1.224 scFv-Fc Heavy Chain

SEQ ID NO: 23010 - protein, 122 aa, Artificial Sequence; identical to SEQ ID NO: 10917
  Description of Artificial Sequence: Synthetic polypeptide
  VH of XENP020290

SEQ ID NO: 23011 - protein, 107 aa, Artificial Sequence; identical to SEQ ID NO: 22811
  Description of Artificial Sequence: Synthetic polypeptide
  VL of XENP020290

SEQ ID NO: 23012 - protein, 231 aa, Artificial Sequence; identical to SEQ ID NO: 21532
  Description of Artificial Sequence: Synthetic polypeptide
  Fc chain of XENP020290

SEQ ID NO: 23013 - protein, 5 aa, Artificial Sequence
  Description of Artificial Sequence: Synthetic peptide
  XENP020290 vhCDR1
NYWMN

SEQ ID NO: 23014 - protein, 19 aa, Artificial Sequence
  Description of Artificial Sequence: Synthetic peptide
  XENP020290 vhCDR2
EIRLYSNNYATHYAESVKG

SEQ ID NO: 23015 - protein, 11 aa, Artificial Sequence
  Description of Artificial Sequence: Synthetic peptide
  XENP020290 vhCDR3
YYGNYGGYFDV

SEQ ID NO: 23016 - protein, 11 aa, Artificial Sequence
  Description of Artificial Sequence: Synthetic peptide
  XENP020290 vlCDR1
RASQSVGNDVA

SEQ ID NO: 23017 - protein, 7 aa, Artificial Sequence
  Description of Artificial Sequence: Synthetic peptide
  XENP020290 vlCDR2
YASHRYT

SEQ ID NO: 23018 - protein, 9 aa, Artificial Sequence
  Description of Artificial Sequence: Synthetic peptide
  XENP020290 vlCDR3
QQDWSSPRT

SEQ ID NO: 23019 - protein, 214 aa, Artificial Sequence; identical to SEQ ID NO: 21020
  Description of Artificial Sequence: Synthetic polypeptide
  XENP020290 8C1A_H0L0_anti-BTLA-1G6_H1.280_L1.224 Light Chain

SEQ ID NO: 23020 - protein, 107 aa, Artificial Sequence; identical to SEQ ID NO: 21021
  Description of Artificial Sequence: Synthetic polypeptide
  VL of XENP020290

SEQ ID NO: 23021 - protein, 11 aa, Artificial Sequence
  Description of Artificial Sequence: Synthetic peptide
  XENP020290 vlCDR1
KASQSVNNDVS

SEQ ID NO: 23022 - protein, 7 aa, Artificial Sequence
  Description of Artificial Sequence: Synthetic peptide
  XENP020290 vlCDR2
SASNRYT

SEQ ID NO: 23023 - protein, 9 aa, Artificial Sequence
  Description of Artificial Sequence: Synthetic peptide
  XENP020290 vlCDR3
QQDYSSPWT

SEQ ID NO: 23024 - protein, 441 aa, Artificial Sequence
  Description of Artificial Sequence: Synthetic polypeptide
  XENP020291 8C1B_H0L0_anti-BTLA-1G6_H1.280_L1.224 Fab-Fc Heavy Chain
QVQLQQPGAELVRPGASVRLSCKASGYTFTSYWIHWVKQRPGQGLEWIGNIYSSDSYTNYNQKFKDKATLTVDKSSSTAYIHLSSPTSEDSAVYYCTRVDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23025 - protein, 112 aa, Artificial Sequence; identical to SEQ ID NO: 21026
  Description of Artificial Sequence: Synthetic polypeptide
  VH of XENP020291

SEQ ID NO: 23026 - protein, 5 aa, Artificial Sequence
  Description of Artificial Sequence: Synthetic peptide
  XENP020291 vhCDR1
SYWIH

SEQ ID NO: 23027 - protein, 17 aa, Artificial Sequence
  Description of Artificial Sequence: Synthetic peptide
  XENP020291 vhCDR2
NIYSSDSYTNYNQKFKD

SEQ ID NO: 23028 - protein, 3 aa, Artificial Sequence
  Description of Artificial Sequence: Synthetic peptide
  XENP020291 vhCDR3
VDY

SEQ ID NO: 23029 - protein, 480 aa, Artificial Sequence; identical to SEQ ID NO: 22809
  Description of Artificial Sequence: Synthetic polypeptide
  XENP020291 8C1B_H0L0_anti-BTLA-1G6_H1.280_L1.224 scFv-Fc Heavy Chain

SEQ ID NO: 23030 - protein, 122 aa, Artificial Sequence; identical to SEQ ID NO: 10917
  Description of Artificial Sequence: Synthetic polypeptide
  VH of XENP020291

SEQ ID NO: 23031 - protein, 107 aa, Artificial Sequence; identical to SEQ ID NO: 22811
  Description of Artificial Sequence: Synthetic polypeptide
  VL of XENP020291

SEQ ID NO: 23032 - protein, 231 aa, Artificial Sequence; identical to SEQ ID NO: 21532
  Description of Artificial Sequence: Synthetic polypeptide
  Fc chain of XENP020291

SEQ ID NO: 23033 - protein, 5 aa, Artificial Sequence
  Description of Artificial Sequence: Synthetic peptide
  XENP020291 vhCDR1
NYWMN

SEQ ID NO: 23034 - protein, 19 aa, Artificial Sequence
  Description of Artificial Sequence: Synthetic peptide
  XENP020291 vhCDR2
EIRLYSNNYATHYAESVKG

SEQ ID NO: 23035 - protein, 11 aa, Artificial Sequence
  Description of Artificial Sequence: Synthetic peptide
  XENP020291 vhCDR3
YYGNYGGYFDV

SEQ ID NO: 23036 - protein, 11 aa, Artificial Sequence
  Description of Artificial Sequence: Synthetic peptide
  XENP020291 vlCDR1
RASQSVGNDVA

SEQ ID NO: 23037 - protein, 7 aa, Artificial Sequence
  Description of Artificial Sequence: Synthetic peptide
  XENP020291 vlCDR2
YASHRYT

SEQ ID NO: 23038 - protein, 9 aa, Artificial Sequence
  Description of Artificial Sequence: Synthetic peptide
  XENP020291 vlCDR3
QQDWSSPRT

SEQ ID NO: 23039 - protein, 214 aa, Artificial Sequence; identical to SEQ ID NO: 21020
  Description of Artificial Sequence: Synthetic polypeptide
  XENP020291 8C1B_H0L0_anti-BTLA-1G6_H1.280_L1.224 Light Chain

SEQ ID NO: 23040 - protein, 107 aa, Artificial Sequence; identical to SEQ ID NO: 21021
  Description of Artificial Sequence: Synthetic polypeptide
  VL of XENP020291

SEQ ID NO: 23041 - protein, 11 aa, Artificial Sequence
  Description of Artificial Sequence: Synthetic peptide
  XENP020291 vlCDR1
KASQSVNNDVS

SEQ ID NO: 23042 - protein, 7 aa, Artificial Sequence
  Description of Artificial Sequence: Synthetic peptide
  XENP020291 vlCDR2
SASNRYT

SEQ ID NO: 23043 - protein, 9 aa, Artificial Sequence
  Description of Artificial Sequence: Synthetic peptide
  XENP020291 vlCDR3
QQDYSSPWT

SEQ ID NO: 23044 - protein, 447 aa, Artificial Sequence
  Description of Artificial Sequence: Synthetic polypeptide
  XENP020292 10B6_H0L0_anti-BTLA-1G6_H1.280_L1.224 Fab-Fc Heavy Chain
QVQLKESGPGLVAPSQSLSITCTVSGFSLTGYGVNWVRQPPGKGLEWLGMIWIDGSTDYNSALKSRLSISKDNSKSQVFLKMNSLQTDDTARYYCARDRPDGRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23045 - protein, 118 aa, Artificial Sequence; identical to SEQ ID NO: 21036
  Description of Artificial Sequence: Synthetic polypeptide
  VH of XENP020292

SEQ ID NO: 23046 - protein, 5 aa, Artificial Sequence
  Description of Artificial Sequence: Synthetic peptide
  XENP020292 vhCDR1
GYGVN

SEQ ID NO: 23047 - protein, 16 aa, Artificial Sequence
  Description of Artificial Sequence: Synthetic peptide
  XENP020292 vhCDR2
MIWIDGSTDYNSALKS

SEQ ID NO: 23048 - protein, 10 aa, Artificial Sequence
  Description of Artificial Sequence: Synthetic peptide
  XENP020292 vhCDR3
DRPDGRAMDY

SEQ ID NO: 23049 - protein, 480 aa, Artificial Sequence; identical to SEQ ID NO: 22809
  Description of Artificial Sequence: Synthetic polypeptide
  XENP020292 10B6_H0L0_anti-BTLA-1G6_H1.280_L1.224 scFv-Fc Heavy Chain

SEQ ID NO: 23050 - protein, 122 aa, Artificial Sequence; identical to SEQ ID NO: 10917
  Description of Artificial Sequence: Synthetic polypeptide
  VH of XENP020292

SEQ ID NO: 23051 - protein, 107 aa, Artificial Sequence; identical to SEQ ID NO: 22811
  Description of Artificial Sequence: Synthetic polypeptide
  VL of XENP020292

SEQ ID NO: 23052 - protein, 231 aa, Artificial Sequence; identical to SEQ ID NO: 21532
  Description of Artificial Sequence: Synthetic polypeptide
  Fc chain of XENP020292

SEQ ID NO: 23053 - protein, 5 aa, Artificial Sequence
  Description of Artificial Sequence: Synthetic peptide
  XENP020292 vhCDR1
NYWMN

SEQ ID NO: 23054 - protein, 19 aa, Artificial Sequence
  Description of Artificial Sequence: Synthetic peptide
  XENP020292 vhCDR2
EIRLYSNNYATHYAESVKG

SEQ ID NO: 23055 - protein, 11 aa, Artificial Sequence
  Description of Artificial Sequence: Synthetic peptide
  XENP020292 vhCDR3
YYGNYGGYFDV

SEQ ID NO: 23056 - protein, 11 aa, Artificial Sequence
  Description of Artificial Sequence: Synthetic peptide
  XENP020292 vlCDR1
RASQSVGNDVA

SEQ ID NO: 23057 - protein, 7 aa, Artificial Sequence
  Description of Artificial Sequence: Synthetic peptide
  XENP020292 vlCDR2
YASHRYT

SEQ ID NO: 23058 - protein, 9 aa, Artificial Sequence
  Description of Artificial Sequence: Synthetic peptide
  XENP020292 vlCDR3
QQDWSSPRT

SEQ ID NO: 23059 - protein, 213 aa, Artificial Sequence; identical to SEQ ID NO: 21040
  Description of Artificial Sequence: Synthetic polypeptide
  XENP020292 10B6_H0L0_anti-BTLA-1G6_H1.280_L1.224 Light Chain

SEQ ID NO: 23060 - protein, 106 aa, Artificial Sequence; identical to SEQ ID NO: 21041
  Description of Artificial Sequence: Synthetic polypeptide
  VL of XENP020292

SEQ ID NO: 23061 - protein, 11 aa, Artificial Sequence
  Description of Artificial Sequence: Synthetic peptide
  XENP020292 vlCDR1
KASQTVSNDVT

SEQ ID NO: 23062 - protein, 7 aa, Artificial Sequence
  Description of Artificial Sequence: Synthetic peptide
  XENP020292 vlCDR2
YASNRYT

SEQ ID NO: 23063 - protein, 8 aa, Artificial Sequence
  Description of Artificial Sequence: Synthetic peptide
  XENP020292 vlCDR3
QQDYSSPT

SEQ ID NO: 23064 - protein, 448 aa, Artificial Sequence; identical to SEQ ID NO: 22624
  Description of Artificial Sequence: Synthetic polypeptide
  XENP017886 4C7_H0L0-nivolumab_H0.1_L0 Fab-Fc Heavy Chain

SEQ ID NO: 23065 - protein, 119 aa, Artificial Sequence; identical to SEQ ID NO: 20886
  Description of Artificial Sequence: Synthetic polypeptide
  VH of XENP017886

SEQ ID NO: 23066 - protein, 5 aa, Artificial Sequence
  Description of Artificial Sequence: Synthetic peptide
  XENP017886 vhCDR1
HYYWS

SEQ ID NO: 23067 - protein, 16 aa, Artificial Sequence
  Description of Artificial Sequence: Synthetic peptide
  XENP017886 vhCDR2
YIYYSGSTKYNPSLKS

SEQ ID NO: 23068 - protein, 11 aa, Artificial Sequence
  Description of Artificial Sequence: Synthetic peptide
  XENP017886 vhCDR3
EWPYYYYEMDV

SEQ ID NO: 23069 - protein, 471 aa, Artificial Sequence; identical to SEQ ID NO: 22749
  Description of Artificial Sequence: Synthetic polypeptide
  XENP017886 4C7_H0L0-nivolumab_H0.1_L0 scFv-Fc Heavy Chain

SEQ ID NO: 23070 - protein, 113 aa, Artificial Sequence; identical to SEQ ID NO: 6210
  Description of Artificial Sequence: Synthetic polypeptide
  VH of XENP017886

SEQ ID NO: 23071 - protein, 107 aa, Artificial Sequence [sequence omitted]

SEQ ID NO: 23072 - protein, 231 aa, Artificial Sequence; identical to SEQ ID NO: 21532
  Description of Artificial Sequence: Synthetic polypeptide
  Fc chain of XENP017886

SEQ ID NO: 23073 - protein, 5 aa, Artificial Sequence
  Description of Artificial Sequence: Synthetic peptide
  XENP017886 vhCDR1
NSGMH

SEQ ID NO: 23074 - protein, 17 aa, Artificial Sequence
  Description of Artificial Sequence: Synthetic peptide
  XENP017886 vhCDR2
VIWYDGSKRYYADSVKG

SEQ ID NO: 23075 - protein, 4 aa, Artificial Sequence
  Description of Artificial Sequence: Synthetic peptide
  XENP017886 vhCDR3
NDDY

SEQ ID NO: 23076 - protein, 11 aa, Artificial Sequence
  Description of Artificial Sequence: Synthetic peptide
  XENP017886 vlCDR1
RASQSVSSYLA

SEQ ID NO: 23077 - protein, 7 aa, Artificial Sequence
  Description of Artificial Sequence: Synthetic peptide
  XENP017886 vlCDR2
DASNRAT

SEQ ID NO: 23078 - protein, 9 aa, Artificial Sequence
  Description of Artificial Sequence: Synthetic peptide
  XENP017886 vlCDR3
QQSSNWPRT

SEQ ID NO: 23079 - protein, 215 aa, Artificial Sequence; identical to SEQ ID NO: 20890
  Description of Artificial Sequence: Synthetic polypeptide
  XENP017886 4C7_H0L0-nivolumab_H0.1_L0 Light Chain

SEQ ID NO: 23080 - protein, 108 aa, Artificial Sequence; identical to SEQ ID NO: 20891
  Description of Artificial Sequence: Synthetic polypeptide
  VL of XENP017886

SEQ ID NO: 23081 - protein, 12 aa, Artificial Sequence
  Description of Artificial Sequence: Synthetic peptide
  XENP017886 vlCDR1
RASQSVSSSYLA

SEQ ID NO: 23082 - protein, 7 aa, Artificial Sequence
  Description of Artificial Sequence: Synthetic peptide
  XENP017886 vlCDR2
GASSRAT

SEQ ID NO: 23083 - protein, 9 aa, Artificial Sequence
  Description of Artificial Sequence: Synthetic peptide
  XENP017886 vlCDR3
QQYGSSFRT

SEQ ID NO: 23084 - protein, 450 aa, Artificial Sequence; identical to SEQ ID NO: 22644
  Description of Artificial Sequence: Synthetic polypeptide
  XENP017887 8D5_H0L0-nivolumab_H0.1_L0 Fab-Fc Heavy Chain

SEQ ID NO: 23085 - protein, 121 aa, Artificial Sequence; identical to SEQ ID NO: 20896
  Description of Artificial Sequence: Synthetic polypeptide
  VH of XENP017887

SEQ ID NO: 23086 - protein, 5 aa, Artificial Sequence
  Description of Artificial Sequence: Synthetic peptide
  XENP017887 vhCDR1
SYDMH

SEQ ID NO: 23087 - protein, 16 aa, Artificial Sequence
  Description of Artificial Sequence: Synthetic peptide
  XENP017887 vhCDR2
VIGPAGDTYYPGSVKG

SEQ ID NO: 23088 - protein, 13 aa, Artificial Sequence
  Description of Artificial Sequence: Synthetic peptide
  XENP017887 vhCDR3
EGMAAHNYYGMDV

SEQ ID NO: 23089 - protein, 471 aa, Artificial Sequence; identical to SEQ ID NO: 22749
  Description of Artificial Sequence: Synthetic polypeptide
  XENP017887 8D5_H0L0-nivolumab_H0.1_L0 scFv-Fc Heavy Chain

SEQ ID NO: 23090 - protein, 113 aa, Artificial Sequence; identical to SEQ ID NO: 6210
  Description of Artificial Sequence: Synthetic polypeptide
  VH of XENP017887

SEQ ID NO: 23091 - protein, 107 aa, Artificial Sequence [sequence omitted]

SEQ ID NO: 23092 - protein, 231 aa, Artificial Sequence; identical to SEQ ID NO: 21532
  Description of Artificial Sequence: Synthetic polypeptide
  Fc chain of XENP017887

SEQ ID NO: 23093 - protein, 5 aa, Artificial Sequence
  Description of Artificial Sequence: Synthetic peptide
  XENP017887 vhCDR1
NSGMH

SEQ ID NO: 23094 - protein, 17 aa, Artificial Sequence
  Description of Artificial Sequence: Synthetic peptide
  XENP017887 vhCDR2
VIWYDGSKRYYADSVKG

SEQ ID NO: 23095 - protein, 4 aa, Artificial Sequence
  Description of Artificial Sequence: Synthetic peptide
  XENP017887 vhCDR3
NDDY

SEQ ID NO: 23096 - protein, 11 aa, Artificial Sequence
  Description of Artificial Sequence: Synthetic peptide
  XENP017887 vlCDR1
RASQSVSSYLA

SEQ ID NO: 23097 - protein, 7 aa, Artificial Sequence
  Description of Artificial Sequence: Synthetic peptide
  XENP017887 vlCDR2
DASNRAT

SEQ ID NO: 23098 - protein, 9 aa, Artificial Sequence
  Description of Artificial Sequence: Synthetic peptide
  XENP017887 vlCDR3
QQSSNWPRT

SEQ ID NO: 23099 - protein, 215 aa, Artificial Sequence; identical to SEQ ID NO: 20900
  Description of Artificial Sequence: Synthetic polypeptide
  XENP017887 8D5_H0L0-nivolumab_H0.1_L0 Light Chain

SEQ ID NO: 23100 - protein, 108 aa, Artificial Sequence; identical to SEQ ID NO: 20901
  Description of Artificial Sequence: Synthetic polypeptide
  VL of XENP017887

SEQ ID NO: 23101 - protein, 11 aa, Artificial Sequence
  Description of Artificial Sequence: Synthetic peptide
  XENP017887 vlCDR1
RASQSVSSYLA

SEQ ID NO: 23102 - protein, 7 aa, Artificial Sequence
  Description of Artificial Sequence: Synthetic peptide
  XENP017887 vlCDR2
DASNRAT

SEQ ID NO: 23103 - protein, 10 aa, Artificial Sequence
  Description of Artificial Sequence: Synthetic peptide
  XENP017887 vlCDR3
QQRSNWPPIT

SEQ ID NO: 23104 - protein, 457 aa, Artificial Sequence; identical to SEQ ID NO: 22664
  Description of Artificial Sequence: Synthetic polypeptide
  XENP017888 E8D9_H0L0-nivolumab_H0.1_L0 Fab-Fc Heavy Chain

SEQ ID NO: 23105 - protein, 128 aa, Artificial Sequence; identical to SEQ ID NO: 20906
  Description of Artificial Sequence: Synthetic polypeptide
  VH of XENP017888

SEQ ID NO: 23106 - protein, 7 aa, Artificial Sequence
  Description of Artificial Sequence: Synthetic peptide
  XENP017888 vhCDR1
TSGVGVG

SEQ ID NO: 23107 - protein, 16 aa, Artificial Sequence
  Description of Artificial Sequence: Synthetic peptide
  XENP017888 vhCDR2
LIYWDDDKRYSPSLKS

SEQ ID NO: 23108 - protein, 18 aa, Artificial Sequence
  Description of Artificial Sequence: Synthetic peptide
  XENP017888 vhCDR3
TSITEVRGAIIYYYGMDV

SEQ ID NO: 23109 - protein, 471 aa, Artificial Sequence; identical to SEQ ID NO: 22749
  Description of Artificial Sequence: Synthetic polypeptide
  XENP017888 E8D9_H0L0-nivolumab_H0.1_L0 scFv-Fc Heavy Chain

SEQ ID NO: 23110 - protein, 113 aa, Artificial Sequence; identical to SEQ ID NO: 6210
  Description of Artificial Sequence: Synthetic polypeptide
  VH of XENP017888

SEQ ID NO: 23111 - protein, 107 aa, Artificial Sequence [sequence omitted]

SEQ ID NO: 23112 - protein, 231 aa, Artificial Sequence; identical to SEQ ID NO: 21532
  Description of Artificial Sequence: Synthetic polypeptide
  Fc chain of XENP017888

SEQ ID NO: 23113 - protein, 5 aa, Artificial Sequence
  Description of Artificial Sequence: Synthetic peptide
  XENP017888 vhCDR1
NSGMH

SEQ ID NO: 23114 - protein, 17 aa, Artificial Sequence
  Description of Artificial Sequence: Synthetic peptide
  XENP017888 vhCDR2
VIWYDGSKRYYADSVKG

SEQ ID NO: 23115 - protein, 4 aa, Artificial Sequence
  Description of Artificial Sequence: Synthetic peptide
  XENP017888 vhCDR3
NDDY

SEQ ID NO: 23116 - protein, 11 aa, Artificial Sequence
  Description of Artificial Sequence: Synthetic peptide
  XENP017888 vlCDR1
RASQSVSSYLA

SEQ ID NO: 23117 - protein, 7 aa, Artificial Sequence
  Description of Artificial Sequence: Synthetic peptide
  XENP017888 vlCDR2
DASNRAT

SEQ ID NO: 23118 - protein, 9 aa, Artificial Sequence
  Description of Artificial Sequence: Synthetic peptide
  XENP017888 vlCDR3
QQSSNWPRT

SEQ ID NO: 23119 - protein, 214 aa, Artificial Sequence; identical to SEQ ID NO: 20910
  Description of Artificial Sequence: Synthetic polypeptide
  XENP017888 E8D9_H0L0-nivolumab_H0.1_L0 Light Chain

SEQ ID NO: 23120 - protein, 107 aa, Artificial Sequence; identical to SEQ ID NO: 20911
  Description of Artificial Sequence: Synthetic polypeptide
  VL of XENP017888

SEQ ID NO: 23121 - protein, 12 aa, Artificial Sequence
  Description of Artificial Sequence: Synthetic peptide
  XENP017888 vlCDR1
RASQSVSSSYLA

SEQ ID NO: 23122 - protein, 7 aa, Artificial Sequence
  Description of Artificial Sequence: Synthetic peptide
  XENP017888 vlCDR2
GASSRAT

SEQ ID NO: 23123 - protein, 8 aa, Artificial Sequence
  Description of Artificial Sequence: Synthetic peptide
  XENP017888 vlCDR3
QQYGHSLT

SEQ ID NO: 23124 - protein, 448 aa, Artificial Sequence; identical to SEQ ID NO: 22624
  Description of Artificial Sequence: Synthetic polypeptide
  XENP017889 4C7_H0L0-one-arm Fab-Fc Heavy Chain

SEQ ID NO: 23125 - protein, 119 aa, Artificial Sequence; identical to SEQ ID NO: 20886
  Description of Artificial Sequence: Synthetic polypeptide
  VH of XENP017889

SEQ ID NO: 23126 - protein, 5 aa, Artificial Sequence
  Description of Artificial Sequence: Synthetic peptide
  XENP017889 vhCDR1
HYYWS

SEQ ID NO: 23127 - protein, 16 aa, Artificial Sequence
  Description of Artificial Sequence: Synthetic peptide
  XENP017889 vhCDR2
YIYYSGSTKYNPSLKS

SEQ ID NO: 23128 - protein, 11 aa, Artificial Sequence
  Description of Artificial Sequence: Synthetic peptide
  XENP017889 vhCDR3
EWPYYYYEMDV

SEQ ID NO: 23129 - protein, 231 aa, Artificial Sequence; identical to SEQ ID NO: 21532
  Description of Artificial Sequence: Synthetic polypeptide
  XENP017889 4C7_H0L0-one-arm Fab-Fc only Heavy Chain

SEQ ID NO: 23130 - protein, 215 aa, Artificial Sequence; identical to SEQ ID NO: 20890
  Description of Artificial Sequence: Synthetic polypeptide
  XENP017889 4C7_H0L0-one-arm Light Chain

SEQ ID NO: 23131 - protein, 108 aa, Artificial Sequence; identical to SEQ ID NO: 20891
  Description of Artificial Sequence: Synthetic polypeptide
  VL of XENP017889

SEQ ID NO: 23132 - protein, 12 aa, Artificial Sequence
  Description of Artificial Sequence: Synthetic peptide
  XENP017889 vlCDR1
RASQSVSSSYLA

SEQ ID NO: 23133 - protein, 7 aa, Artificial Sequence
  Description of Artificial Sequence: Synthetic peptide
  XENP017889 vlCDR2
GASSRAT

SEQ ID NO: 23134 - protein, 9 aa, Artificial Sequence
  Description of Artificial Sequence: Synthetic peptide
  XENP017889 vlCDR3
QQYGSSFRT

SEQ ID NO: 23135 - protein, 450 aa, Artificial Sequence; identical to SEQ ID NO: 22644
  Description of Artificial Sequence: Synthetic polypeptide
  XENP017890 8D5_H0L0-one-arm Fab-Fc Heavy Chain

SEQ ID NO: 23136 - protein, 121 aa, Artificial Sequence; identical to SEQ ID NO: 20896
  Description of Artificial Sequence: Synthetic polypeptide
  VH of XENP017890

SEQ ID NO: 23137 - protein, 5 aa, Artificial Sequence
  Description of Artificial Sequence: Synthetic peptide
  XENP017890 vhCDR1
SYDMH

SEQ ID NO: 23138 - protein, 16 aa, Artificial Sequence
  Description of Artificial Sequence: Synthetic peptide
  XENP017890 vhCDR2
VIGPAGDTYYPGSVKG

SEQ ID NO: 23139 - protein, 13 aa, Artificial Sequence
  Description of Artificial Sequence: Synthetic peptide
  XENP017890 vhCDR3
EGMAAHNYYGMDV

SEQ ID NO: 23140 - protein, 231 aa, Artificial Sequence; identical to SEQ ID NO: 21532
  Description of Artificial Sequence: Synthetic polypeptide
  XENP017890 8D5_H0L0-one-arm Fab-Fc only Heavy Chain

SEQ ID NO: 23141 - protein, 215 aa, Artificial Sequence; identical to SEQ ID NO: 20900
  Description of Artificial Sequence: Synthetic polypeptide
  XENP017890 8D5_H0L0-one-arm Light Chain

SEQ ID NO: 23142 - protein, 108 aa, Artificial Sequence; identical to SEQ ID NO: 20901
  Description of Artificial Sequence: Synthetic polypeptide
  VL of XENP017890

SEQ ID NO: 23143 - protein, 11 aa, Artificial Sequence
  Description of Artificial Sequence: Synthetic peptide
  XENP017890 vlCDR1
RASQSVSSYLA

SEQ ID NO: 23144 - protein, 7 aa, Artificial Sequence
  Description of Artificial Sequence: Synthetic peptide
  XENP017890 vlCDR2
DASNRAT

SEQ ID NO: 23145 - protein, 10 aa, Artificial Sequence
  Description of Artificial Sequence: Synthetic peptide
  XENP017890 vlCDR3
QQRSNWPPIT

SEQ ID NO: 23146 - protein, 457 aa, Artificial Sequence; identical to SEQ ID NO: 22664
  Description of Artificial Sequence: Synthetic polypeptide
  XENP017891 E8D9_H0L0-one-arm Fab-Fc Heavy Chain

SEQ ID NO: 23147 - protein, 128 aa, Artificial Sequence; identical to SEQ ID NO: 20906
  Description of Artificial Sequence: Synthetic polypeptide
  VH of XENP017891

SEQ ID NO: 23148 - protein, 7 aa, Artificial Sequence
  Description of Artificial Sequence: Synthetic peptide
  XENP017891 vhCDR1
TSGVGVG

SEQ ID NO: 23149 - protein, 16 aa, Artificial Sequence
  Description of Artificial Sequence: Synthetic peptide
  XENP017891 vhCDR2
LIYWDDDKRYSPSLKS

SEQ ID NO: 23150 - protein, 18 aa, Artificial Sequence
  Description of Artificial Sequence: Synthetic peptide
  XENP017891 vhCDR3
TSITEVRGAIIYYYGMDV

SEQ ID NO: 23151 - protein, 231 aa, Artificial Sequence; identical to SEQ ID NO: 21532
  Description of Artificial Sequence: Synthetic polypeptide
  XENP017891 E8D9_H0L0-one-arm Fab-Fc only Heavy Chain

SEQ ID NO: 23152 - protein, 214 aa, Artificial Sequence; identical to SEQ ID NO: 20910
  Description of Artificial Sequence: Synthetic polypeptide
  XENP017891 E8D9-one-arm_H0L0 Light Chain

SEQ ID NO: 23153 - protein, 107 aa, Artificial Sequence; identical to SEQ ID NO: 20911
  Description of Artificial Sequence: Synthetic polypeptide
  VL of XENP017891

SEQ ID NO: 23154 - protein, 12 aa, Artificial Sequence
  Description of Artificial Sequence: Synthetic peptide
  XENP017891 vlCDR1
RASQSVSSSYLA

SEQ ID NO: 23155 - protein, 7 aa, Artificial Sequence
  Description of Artificial Sequence: Synthetic peptide
  XENP017891 vlCDR2
GASSRAT

SEQ ID NO: 23156 - protein, 8 aa, Artificial Sequence
  Description of Artificial Sequence: Synthetic peptide
  XENP017891 vlCDR3
QQYGHSLT

SEQ ID NO: 23157 - protein, 447 aa, Artificial Sequence; identical to SEQ ID NO: 22844
  Description of Artificial Sequence: Synthetic polypeptide
  XENP020282 9C6_H0L0-1G6_H1.280_L1.224 Fab-Fc Heavy Chain

SEQ ID NO: 23158 - protein, 118 aa, Artificial Sequence; identical to SEQ ID NO: 20936
  Description of Artificial Sequence: Synthetic polypeptide
  VH of XENP020282

SEQ ID NO: 23159 - protein, 5 aa, Artificial Sequence
  Description of Artificial Sequence: Synthetic peptide
  XENP020282 vhCDR1
GYGVN

SEQ ID NO: 23160 - protein, 16 aa, Artificial Sequence
  Description of Artificial Sequence: Synthetic peptide
  XENP020282 vhCDR2
MIWIDGSTDYNSALKS

SEQ ID NO: 23161 - protein, 10 aa, Artificial Sequence
  Description of Artificial Sequence: Synthetic peptide
  XENP020282 vhCDR3
DRPDGRAMDY

SEQ ID NO: 23162 - protein, 480 aa, Artificial Sequence; identical to SEQ ID NO: 22809
  Description of Artificial Sequence: Synthetic polypeptide
  XENP020282 9C6_H0L0-1G6_H1.280_L1.224 scFv-Fc Heavy Chain

SEQ ID NO: 23163 - protein, 122 aa, Artificial Sequence; identical to SEQ ID NO: 10917
  Description of Artificial Sequence: Synthetic polypeptide
  VH of XENP020282

SEQ ID NO: 23164 - protein, 107 aa, Artificial Sequence; identical to SEQ ID NO: 22811
  Description of Artificial Sequence: Synthetic polypeptide
  VL of XENP020282

SEQ ID NO: 23165 - protein, 231 aa, Artificial Sequence; identical to SEQ ID NO: 21532
  Description of Artificial Sequence: Synthetic polypeptide
  Fc chain of XENP020282

SEQ ID NO: 23166 - protein, 5 aa, Artificial Sequence
  Description of Artificial Sequence: Synthetic peptide
  XENP020282 vhCDR1
NYWMN

SEQ ID NO: 23167 - protein, 19 aa, Artificial Sequence
  Description of Artificial Sequence: Synthetic peptide
  XENP020282 vhCDR2
EIRLYSNNYATHYAESVKG

SEQ ID NO: 23168 - protein, 11 aa, Artificial Sequence
  Description of Artificial Sequence: Synthetic peptide
  XENP020282 vhCDR3
YYGNYGGYFDV

SEQ ID NO: 23169 - protein, 11 aa, Artificial Sequence
  Description of Artificial Sequence: Synthetic peptide
  XENP020282 vlCDR1
RASQSVGNDVA

SEQ ID NO: 23170 - protein, 7 aa, Artificial Sequence
  Description of Artificial Sequence: Synthetic peptide
  XENP020282 vlCDR2
YASHRYT

SEQ ID NO: 23171 - protein, 9 aa, Artificial Sequence
  Description of Artificial Sequence: Synthetic peptide
  XENP020282 vlCDR3
QQDWSSPRT

SEQ ID NO: 23172 - protein, 213 aa, Artificial Sequence; identical to SEQ ID NO: 20940
  Description of Artificial Sequence: Synthetic polypeptide
  XENP020282 9C6_H0L0-1G6_H1.280_L1.224 Light Chain

SEQ ID NO: 23173 - protein, 106 aa, Artificial Sequence; identical to SEQ ID NO: 20941
  Description of Artificial Sequence: Synthetic polypeptide
  VL of XENP020282

SEQ ID NO: 23174 - protein, 11 aa, Artificial Sequence
  Description of Artificial Sequence: Synthetic peptide
  XENP020282 vlCDR1
KASQSVSNDVA

SEQ ID NO: 23175 - protein, 7 aa, Artificial Sequence
  Description of Artificial Sequence: Synthetic peptide
  XENP020282 vlCDR2
YASNRYT

SEQ ID NO: 23176 - protein, 8 aa, Artificial Sequence
  Description of Artificial Sequence: Synthetic peptide
  XENP020282 vlCDR3
QQDYSSPT

SEQ ID NO: 23177 - protein, 447 aa, Artificial Sequence
  Description of Artificial Sequence: Synthetic polypeptide
  XENP020808 9C6_H1L1-1G6_H1.280_L1.224 Fab-Fc Heavy Chain
QVQLVQSGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23178 - protein, 118 aa, Artificial Sequence; identical to SEQ ID NO: 21066
  Description of Artificial Sequence: Synthetic polypeptide
  VH of XENP020808

SEQ ID NO: 23179 - protein, 5 aa, Artificial Sequence
  Description of Artificial Sequence: Synthetic peptide
  XENP020808 vhCDR1
GYGVN

SEQ ID NO: 23180 - protein, 16 aa, Artificial Sequence
  Description of Artificial Sequence: Synthetic peptide
  XENP020808 vhCDR2
MIWIDGSTDYNSKFQG

SEQ ID NO: 23181 - protein, 10 aa, Artificial Sequence
  Description of Artificial Sequence: Synthetic peptide
  XENP020808 vhCDR3
DRPDGRAMDY

SEQ ID NO: 23182 - protein, 480 aa, Artificial Sequence; identical to SEQ ID NO: 22809
  Description of Artificial Sequence: Synthetic polypeptide
  XENP020808 9C6_H1L1-1G6_H1.280_L1.224 scFv-Fc Heavy Chain

SEQ ID NO: 23183 - protein, 122 aa, Artificial Sequence; identical to SEQ ID NO: 10917
  Description of Artificial Sequence: Synthetic polypeptide
  VH of XENP020808

SEQ ID NO: 23184 - protein, 107 aa, Artificial Sequence; identical to SEQ ID NO: 22811
  Description of Artificial Sequence: Synthetic polypeptide
  VL of XENP020808

SEQ ID NO: 23185 - protein, 231 aa, Artificial Sequence; identical to SEQ ID NO: 21532
  Description of Artificial Sequence: Synthetic polypeptide
  Fc chain of XENP020808

SEQ ID NO: 23186 - protein, 5 aa, Artificial Sequence
  Description of Artificial Sequence: Synthetic peptide
  XENP020808 vhCDR1
NYWMN

SEQ ID NO: 23187 - protein, 19 aa, Artificial Sequence
  Description of Artificial Sequence: Synthetic peptide
  XENP020808 vhCDR2
EIRLYSNNYATHYAESVKG

SEQ ID NO: 23188 - protein, 11 aa, Artificial Sequence
  Description of Artificial Sequence: Synthetic peptide
  XENP020808 vhCDR3
YYGNYGGYFDV

SEQ ID NO: 23189 - protein, 11 aa, Artificial Sequence
  Description of Artificial Sequence: Synthetic peptide
  XENP020808 vlCDR1
RASQSVGNDVA

SEQ ID NO: 23190 - protein, 7 aa, Artificial Sequence
  Description of Artificial Sequence: Synthetic peptide
  XENP020808 vlCDR2
YASHRYT

SEQ ID NO: 23191 - protein, 9 aa, Artificial Sequence
  Description of Artificial Sequence: Synthetic peptide
  XENP020808 vlCDR3
QQDWSSPRT

SEQ ID NO: 23192 - protein, 213 aa, Artificial Sequence; identical to SEQ ID NO: 21050
  Description of Artificial Sequence: Synthetic polypeptide
  XENP020808 9C6_H1L1-1G6_H1.280_L1.224 Light Chain

SEQ ID NO: 23193 - protein, 11 aa, Artificial Sequence
  Description of Artificial Sequence: Synthetic peptide
  XENP020808 vlCDR1
KASQSVSNDVA

SEQ ID NO: 23194 - protein, 7 aa, Artificial Sequence
  Description of Artificial Sequence: Synthetic peptide
  XENP020808 vlCDR2
YASNRYT

SEQ ID NO: 23195 - protein, 8 aa, Artificial Sequence
  Description of Artificial Sequence: Synthetic peptide
  XENP020808 vlCDR3
QQDYSSPT

SEQ ID NO: 23196 - protein, 447 aa, Artificial Sequence; identical to SEQ ID NO: 23177
  Description of Artificial Sequence: Synthetic polypeptide
  XENP020809 9C6_H1L2-1G6_H1.280_L1.224 Fab-Fc Heavy Chain

SEQ ID NO: 23197 - protein, 118 aa, Artificial Sequence; identical to SEQ ID NO: 21066
  Description of Artificial Sequence: Synthetic polypeptide
  VH of XENP020809

SEQ ID NO: 23198 - protein, 5 aa, Artificial Sequence
  Description of Artificial Sequence: Synthetic peptide
  XENP020809 vhCDR1
GYGVN

SEQ ID NO: 23199 - protein, 16 aa, Artificial Sequence
  Description of Artificial Sequence: Synthetic peptide
  XENP020809 vhCDR2
MIWIDGSTDYNSKFQG

SEQ ID NO: 23200 - protein, 10 aa, Artificial Sequence
  Description of Artificial Sequence: Synthetic peptide
  XENP020809 vhCDR3
DRPDGRAMDY

SEQ ID NO: 23201 - protein, 480 aa, Artificial Sequence; identical to SEQ ID NO: 22809
  Description of Artificial Sequence: Synthetic polypeptide
  XENP020809 9C6_H1L2-1G6_H1.280_L1.224 scFv-Fc Heavy Chain

SEQ ID NO: 23202 - protein, 122 aa, Artificial Sequence; identical to SEQ ID NO: 10917
  Description of Artificial Sequence: Synthetic polypeptide
  VH of XENP020809

SEQ ID NO: 23203 - protein, 107 aa, Artificial Sequence; identical to SEQ ID NO: 22811
  Description of Artificial Sequence: Synthetic polypeptide
  VL of XENP020809

SEQ ID NO: 23204 - protein, 231 aa, Artificial Sequence; identical to SEQ ID NO: 21532
  Description of Artificial Sequence: Synthetic polypeptide
  Fc chain of XENP020809

SEQ ID NO: 23205 - protein, 5 aa, Artificial Sequence
  Description of Artificial Sequence: Synthetic peptide
  XENP020809 vhCDR1
NYWMN

SEQ ID NO: 23206 - protein, 19 aa, Artificial Sequence
  Description of Artificial Sequence: Synthetic peptide
  XENP020809 vhCDR2
EIRLYSNNYATHYAESVKG

SEQ ID NO: 23207 - protein, 11 aa, Artificial Sequence
  Description of Artificial Sequence: Synthetic peptide
  XENP020809 vhCDR3
YYGNYGGYFDV

SEQ ID NO: 23208 - protein, 11 aa, Artificial Sequence
  Description of Artificial Sequence: Synthetic peptide
  XENP020809 vlCDR1
RASQSVGNDVA

SEQ ID NO: 23209 - protein, 7 aa, Artificial Sequence
  Description of Artificial Sequence: Synthetic peptide
  XENP020809 vlCDR2
YASHRYT

SEQ ID NO: 23210 - protein, 9 aa, Artificial Sequence
  Description of Artificial Sequence: Synthetic peptide
  XENP020809 vlCDR3
QQDWSSPRT

SEQ ID NO: 23211 - protein, 213 aa, Artificial Sequence; identical to SEQ ID NO: 21060
  Description of Artificial Sequence: Synthetic polypeptide
  XENP020809 9C6_H1L2-1G6_H1.280_L1.224 Light Chain

SEQ ID NO: 23212 - protein, 106 aa, Artificial Sequence; identical to SEQ ID NO: 21061
  Description of Artificial Sequence: Synthetic polypeptide
  VL of XENP020809

SEQ ID NO: 23213 - protein, 11 aa, Artificial Sequence
  Description of Artificial Sequence: Synthetic peptide
  XENP020809 vlCDR1
RASQSVSNDVA

SEQ ID NO: 23214 - protein, 7 aa, Artificial Sequence
  Description of Artificial Sequence: Synthetic peptide
  XENP020809 vlCDR2
YASNRYT

SEQ ID NO: 23215 - protein, 8 aa, Artificial Sequence
  Description of Artificial Sequence: Synthetic peptide
  XENP020809 vlCDR3
QQDYSSPT

SEQ ID NO: 23216 - protein, 447 aa, Artificial Sequence; identical to SEQ ID NO: 22844
  Description of Artificial Sequence: Synthetic polypeptide
  XENP020895 9C6_H0L0-1G6_L1.194_H1.279 Fab-Fc Heavy Chain

SEQ ID NO: 23217 - protein, 118 aa, Artificial Sequence; identical to SEQ ID NO: 20936
  Description of Artificial Sequence: Synthetic polypeptide
  VH of XENP020895

SEQ ID NO: 23218 - protein, 5 aa, Artificial Sequence
  Description of Artificial Sequence: Synthetic peptide
  XENP020895 vhCDR1
GYGVN

SEQ ID NO: 23219 - protein, 16 aa, Artificial Sequence
  Description of Artificial Sequence: Synthetic peptide
  XENP020895 vhCDR2
MIWIDGSTDYNSALKS

SEQ ID NO: 23220 - protein, 10 aa, Artificial Sequence
  Description of Artificial Sequence: Synthetic peptide
  XENP020895 vhCDR3
DRPDGRAMDY

SEQ ID NO: 23221 - protein, 480 aa, Artificial Sequence
  Description of Artificial Sequence: Synthetic polypeptide
  XENP020895 9C6_H0L0-1G6_L1.194_H1.279 scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23222 - protein, 107 aa, Artificial Sequence; identical to SEQ ID NO: 10999
  Description of Artificial Sequence: Synthetic polypeptide
  VH of XENP020895

SEQ ID NO: 23223 - protein, 122 aa, Artificial Sequence; identical to SEQ ID NO: 10908
  Description of Artificial Sequence: Synthetic polypeptide
  VL of XENP020895

SEQ ID NO: 23224 - protein, 231 aa, Artificial Sequence; identical to SEQ ID NO: 21532
  Description of Artificial Sequence: Synthetic polypeptide
  Fc chain of XENP020895

SEQ ID NO: 23225 - protein, 11 aa, Artificial Sequence
  Description of Artificial Sequence: Synthetic peptide
  XENP020895 vhCDR1
RASQSVGNDVA

SEQ ID NO: 23226 - protein, 7 aa, Artificial Sequence
  Description of Artificial Sequence: Synthetic peptide
  XENP020895 vhCDR2
YASHRYT

SEQ ID NO: 23227 - protein, 9 aa, Artificial Sequence
  Description of Artificial Sequence: Synthetic peptide
  XENP020895 vhCDR3
QQDFSSPRT

SEQ ID NO: 23228 - protein, 5 aa, Artificial Sequence
  Description of Artificial Sequence: Synthetic peptide
  XENP020895 vlCDR1
NYWMN

SEQ ID NO: 23229 - protein, 19 aa, Artificial Sequence
  Description of Artificial Sequence: Synthetic peptide
  XENP020895 vlCDR2
EIRLYSNNYATHYAESVKG

SEQ ID NO: 23230 - protein, 11 aa, Artificial Sequence
  Description of Artificial Sequence: Synthetic peptide
  XENP020895 vlCDR3
YYGNYGGYFDV

SEQ ID NO: 23231 - protein, 213 aa, Artificial Sequence; identical to SEQ ID NO: 20940
  Description of Artificial Sequence: Synthetic polypeptide
  XENP020895 9C6_H0L0-1G6_L1.194_H1.279 Light Chain

SEQ ID NO: 23232 - protein, 106 aa, Artificial Sequence; identical to SEQ ID NO: 20941
  Description of Artificial Sequence: Synthetic polypeptide
  VL of XENP020895

SEQ ID NO: 23233 - protein, 11 aa, Artificial Sequence
  Description of Artificial Sequence: Synthetic peptide
  XENP020895 vlCDR1
KASQSVSNDVA

SEQ ID NO: 23234 - protein, 7 aa, Artificial Sequence
  Description of Artificial Sequence: Synthetic peptide
  XENP020895 vlCDR2
YASNRYT

SEQ ID NO: 23235 - protein, 8 aa, Artificial Sequence
  Description of Artificial Sequence: Synthetic peptide
  XENP020895 vlCDR3
QQDYSSPT

SEQ ID NO: 23236 - protein, 447 aa, Artificial Sequence
  Description of Artificial Sequence: Synthetic polypeptide
  XENP021218 9C6_H1.1_L1-1G6_H1.280_L1.224 Fab-Fc Heavy Chain
QVQLKESGAEVKKPGASVKVSCKVSGFSLTGYGVNWVRQAPGQGLEWMGMIWIDGSTDYNSKFQGRVTMTKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23237 - protein, 118 aa, Artificial Sequence; identical to SEQ ID NO: 21205
  Description of Artificial Sequence: Synthetic polypeptide
  VH of XENP021218

SEQ ID NO: 23238 - protein, 5 aa, Artificial Sequence
  Description of Artificial Sequence: Synthetic peptide
  XENP021218 vhCDR1
GYGVN

SEQ ID NO: 23239 - protein, 16 aa, Artificial Sequence
  Description of Artificial Sequence: Synthetic peptide
  XENP021218 vhCDR2
MIWIDGSTDYNSKFQG

SEQ ID NO: 23240 - protein, 10 aa, Artificial Sequence
  Description of Artificial Sequence: Synthetic peptide
  XENP021218 vhCDR3
DRPDGRAMDY

SEQ ID NO: 23241 - protein, 480 aa, Artificial Sequence; identical to SEQ ID NO: 22809
  Description of Artificial Sequence: Synthetic polypeptide
  XENP021218 9C6_H1.1_L1-1G6_H1.280_L1.224 scFv-Fc Heavy Chain

SEQ ID NO: 23242 - protein, 122 aa, Artificial Sequence; identical to SEQ ID NO: 10917
  Description of Artificial Sequence: Synthetic polypeptide
  VH of XENP021218

SEQ ID NO: 23243 - protein, 107 aa, Artificial Sequence; identical to SEQ ID NO: 22811
  Description of Artificial Sequence: Synthetic polypeptide
  VL of XENP021218

SEQ ID NO: 23244 - protein, 231 aa, Artificial Sequence; identical to SEQ ID NO: 21532
  Description of Artificial Sequence: Synthetic polypeptide
  Fc chain of XENP021218

SEQ ID NO: 23245 - protein, 5 aa, Artificial Sequence
  Description of Artificial Sequence: Synthetic peptide
  XENP021218 vhCDR1
NYWMN

SEQ ID NO: 23246 - protein, 19 aa, Artificial Sequence
  Description of Artificial Sequence: Synthetic peptide
  XENP021218 vhCDR2
EIRLYSNNYATHYAESVKG

SEQ ID NO: 23247 - protein, 11 aa, Artificial Sequence
  Description of Artificial Sequence: Synthetic peptide
  XENP021218 vhCDR3
YYGNYGGYFDV

SEQ ID NO: 23248 - protein, 11 aa, Artificial Sequence
  Description of Artificial Sequence: Synthetic peptide
  XENP021218 vlCDR1
RASQSVGNDVA

SEQ ID NO: 23249 - protein, 7 aa, Artificial Sequence
  Description of Artificial Sequence: Synthetic peptide
  XENP021218 vlCDR2
YASHRYT

SEQ ID NO: 23250 - protein, 9 aa, Artificial Sequence
  Description of Artificial Sequence: Synthetic peptide
  XENP021218 vlCDR3
QQDWSSPRT

SEQ ID NO: 23251 - protein, 213 aa, Artificial Sequence; identical to SEQ ID NO: 21050
  Description of Artificial Sequence: Synthetic polypeptide
  XENP021218 9C6_H1.1_L1-1G6_H1.280_L1.224 Light Chain

SEQ ID NO: 23252 - protein, 106 aa, Artificial Sequence; identical to SEQ ID NO: 21051
  Description of Artificial Sequence: Synthetic polypeptide
  VL of XENP021218

SEQ ID NO: 23253 - protein, 11 aa, Artificial Sequence
  Description of Artificial Sequence: Synthetic peptide
  XENP021218 vlCDR1
KASQSVSNDVA

SEQ ID NO: 23254 - protein, 7 aa, Artificial Sequence
  Description of Artificial Sequence: Synthetic peptide
  XENP021218 vlCDR2
YASNRYT

SEQ ID NO: 23255 - protein, 8 aa, Artificial Sequence
  Description of Artificial Sequence: Synthetic peptide
  XENP021218 vlCDR3
QQDYSSPT

SEQ ID NO: 23256 - protein, 447 aa, Artificial Sequence
  Description of Artificial Sequence: Synthetic polypeptide
  XENP021219 9C6_H1.11_L1-1G6_H1.280_L1.224 Fab-Fc Heavy Chain
QVQLVQSGAEVKKPGASVKVSCKVSGFSLTGYGVNWVRQAPGQGLEWMGMIWIDGSTDYNSKFQGRLSINKDNSKSTVYMELSSLRSEDTAVYYCARDRPDGRAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23257 - protein, 118 aa, Artificial Sequence; identical to SEQ ID NO: 21305
  Description of Artificial Sequence: Synthetic polypeptide
  VH of XENP021219

SEQ ID NO: 23258 - protein, 5 aa, Artificial Sequence
  Description of Artificial Sequence: Synthetic peptide
  XENP021219 vhCDR1
GYGVN

SEQ ID NO: 23259 - protein, 16 aa, Artificial Sequence
  Description of Artificial Sequence: Synthetic peptide
  XENP021219 vhCDR2
MIWIDGSTDYNSKFQG

SEQ ID NO: 23260 - protein, 10 aa, Artificial Sequence
  Description of Artificial Sequence: Synthetic peptide
  XENP021219 vhCDR3
DRPDGRAMDY

SEQ ID NO: 23261 - protein, 480 aa, Artificial Sequence; identical to SEQ ID NO: 22809
  Description of Artificial Sequence: Synthetic polypeptide
  XENP021219 9C6_H1.11_L1-1G6_H1.280_L1.224 scFv-Fc Heavy Chain

SEQ ID NO: 23262 - protein, 122 aa, Artificial Sequence; identical to SEQ ID NO: 10917
  Description of Artificial Sequence: Synthetic polypeptide
  VH of XENP021219

SEQ ID NO: 23263 - protein, 107 aa, Artificial Sequence; identical to SEQ ID NO: 22811
  Description of Artificial Sequence: Synthetic polypeptide
  VL of XENP021219

SEQ ID NO: 23264 - protein, 231 aa, Artificial Sequence; identical to SEQ ID NO: 21532
  Description of Artificial Sequence: Synthetic polypeptide
  Fc chain of XENP021219

SEQ ID NO: 23265 - protein, 5 aa, Artificial Sequence
  Description of Artificial Sequence: Synthetic peptide
  XENP021219 vhCDR1
NYWMN

SEQ ID NO: 23266 - protein, 19 aa, Artificial Sequence
  Description of Artificial Sequence: Synthetic peptide
  XENP021219 vhCDR2
EIRLYSNNYATHYAESVKG

SEQ ID NO: 23267 - protein, 11 aa, Artificial Sequence
  Description of Artificial Sequence: Synthetic peptide
  XENP021219 vhCDR3
YYGNYGGYFDV

SEQ ID NO: 23268 - protein, 11 aa, Artificial Sequence
  Description of Artificial Sequence: Synthetic peptide
  XENP021219 vlCDR1
RASQSVGNDVA

SEQ ID NO: 23269 - protein, 7 aa, Artificial Sequence
  Description of Artificial Sequence: Synthetic peptide
  XENP021219 vlCDR2
YASHRYT

SEQ ID NO: 23270 - protein, 9 aa, Artificial Sequence
  Description of Artificial Sequence: Synthetic peptide
  XENP021219 vlCDR3
QQDWSSPRT

SEQ ID NO: 23271 - protein, 213 aa, Artificial Sequence; identical to SEQ ID NO: 21050
  Description of Artificial Sequence: Synthetic polypeptide
  XENP021219 9C6_H1.11_L1-1G6_H1.280_L1.224 Light Chain

SEQ ID NO: 23272 - protein, 106 aa, Artificial Sequence; identical to SEQ ID NO: 21051
  Description of Artificial Sequence: Synthetic polypeptide
  VL of XENP021219

SEQ ID NO: 23273 - protein, 11 aa, Artificial Sequence
  Description of Artificial Sequence: Synthetic peptide
  XENP021219 vlCDR1
KASQSVSNDVA

SEQ ID NO: 23274 - protein, 7 aa, Artificial Sequence
  Description of Artificial Sequence: Synthetic peptide
  XENP021219 vlCDR2
YASNRYT

SEQ ID NO: 23275 - protein, 8 aa, Artificial Sequence
  Description of Artificial Sequence: Synthetic peptide
  XENP021219 vlCDR3
QQDYSSPT

SEQ ID NO: 23276 - protein, 447 aa, Artificial Sequence; identical to SEQ ID NO: 23236
  Description of Artificial Sequence: Synthetic polypeptide
  XENP021220 9C6_H1.1_L1-1G6_L1.194_H1.279 Fab-Fc Heavy Chain

SEQ ID NO: 23277 - protein, 118 aa, Artificial Sequence; identical to SEQ ID NO: 21205
  Description of Artificial Sequence: Synthetic polypeptide
  VH of XENP021220

SEQ ID NO: 23278 - protein, 5 aa, Artificial Sequence
  Description of Artificial Sequence: Synthetic peptide
  XENP021220 vhCDR1
GYGVN

SEQ ID NO: 23279 - protein, 16 aa, Artificial Sequence
  Description of Artificial Sequence: Synthetic peptide
  XENP021220 vhCDR2
MIWIDGSTDYNSKFQG

SEQ ID NO: 23280 - protein, 10 aa, Artificial Sequence
  Description of Artificial Sequence: Synthetic peptide
  XENP021220 vhCDR3
DRPDGRAMDY

SEQ ID NO: 23281 - protein, 480 aa, Artificial Sequence; identical to SEQ ID NO: 23221
  Description of Artificial Sequence: Synthetic polypeptide
  XENP021220 9C6_H1.1_L1-1G6_L1.194_H1.279 scFv-Fc Heavy Chain

SEQ ID NO: 23282 - protein, 107 aa, Artificial Sequence; identical to SEQ ID NO: 10999
  Description of Artificial Sequence: Synthetic polypeptide
  VH of XENP021220

SEQ ID NO: 23283 - protein, 122 aa, Artificial Sequence; identical to SEQ ID NO: 10908
  Description of Artificial Sequence: Synthetic polypeptide
  VL of XENP021220

SEQ ID NO: 23284 - protein, 231 aa, Artificial Sequence; identical to SEQ ID NO: 21532
  Description of Artificial Sequence: Synthetic polypeptide
  Fc chain of XENP021220

SEQ ID NO: 23285 - protein, 11 aa, Artificial Sequence
  Description of Artificial Sequence: Synthetic peptide
  XENP021220 vhCDR1
RASQSVGNDVA

SEQ ID NO: 23286 - protein, 7 aa, Artificial Sequence
  Description of Artificial Sequence: Synthetic peptide
  XENP021220 vhCDR2
YASHRYT

SEQ ID NO: 23287 - protein, 9 aa, Artificial Sequence
  Description of Artificial Sequence: Synthetic peptide
  XENP021220 vhCDR3
QQDFSSPRT

SEQ ID NO: 23288 - protein, 5 aa, Artificial Sequence
  Description of Artificial Sequence: Synthetic peptide
  XENP021220 vlCDR1
NYWMN

SEQ ID NO: 23289 - protein, 19 aa, Artificial Sequence
  Description of Artificial Sequence: Synthetic peptide
  XENP021220 vlCDR2
EIRLYSNNYATHYAESVKG

SEQ ID NO: 23290 - protein, 11 aa, Artificial Sequence
  Description of Artificial Sequence: Synthetic peptide
  XENP021220 vlCDR3
YYGNYGGYFDV

SEQ ID NO: 23291 - protein, 213 aa, Artificial Sequence; identical to SEQ ID NO: 21050
  Description of Artificial Sequence: Synthetic polypeptide
  XENP021220 9C6_H1.1_L1-1G6_L1.194_H1.279 Light Chain

SEQ ID NO: 23292 - protein, 106 aa, Artificial Sequence; identical to SEQ ID NO: 21051
  Description of Artificial Sequence: Synthetic polypeptide
  VL of XENP021220

SEQ ID NO: 23293 - protein, 11 aa, Artificial Sequence
  Description of Artificial Sequence: Synthetic peptide
  XENP021220 vlCDR1
KASQSVSNDVA

SEQ ID NO: 23294 - protein, 7 aa, Artificial Sequence
  Description of Artificial Sequence: Synthetic peptide
  XENP021220 vlCDR2
YASNRYT

SEQ ID NO: 23295 - protein, 8 aa, Artificial Sequence
  Description of Artificial Sequence: Synthetic peptide
  XENP021220 vlCDR3
QQDYSSPT

SEQ ID NO: 23296 - protein, 447 aa, Artificial Sequence; identical to SEQ ID NO: 23256
  Description of Artificial Sequence: Synthetic polypeptide
  XENP021221 9C6_H1.11_L1-1G6_L1.194_H1.279 Fab-Fc Heavy Chain

SEQ ID NO: 23297 - protein, 118 aa, Artificial Sequence; identical to SEQ ID NO: 21305
  Description of Artificial Sequence: Synthetic polypeptide
  VH of XENP021221

SEQ ID NO: 23298 - protein, 5 aa, Artificial Sequence
  Description of Artificial Sequence: Synthetic peptide
  XENP021221 vhCDR1
GYGVN

SEQ ID NO: 23299 - protein, 16 aa, Artificial Sequence
  Description of Artificial Sequence: Synthetic peptide
  XENP021221 vhCDR2
MIWIDGSTDYNSKFQG

SEQ ID NO: 23300 - protein, 10 aa, Artificial Sequence
  Description of Artificial Sequence: Synthetic peptide
  XENP021221 vhCDR3
DRPDGRAMDY

SEQ ID NO: 23301 - protein, 480 aa, Artificial Sequence; identical to SEQ ID NO: 23221
  Description of Artificial Sequence: Synthetic polypeptide
  XENP021221 9C6_H1.11_L1-1G6_L1.194_H1.279 scFv-Fc Heavy Chain

SEQ ID NO: 23302 - protein, 107 aa, Artificial Sequence; identical to SEQ ID NO: 10999
  Description of Artificial Sequence: Synthetic polypeptide
  VH of XENP021221

SEQ ID NO: 23303 - protein, 122 aa, Artificial Sequence; identical to SEQ ID NO: 10908
  Description of Artificial Sequence: Synthetic polypeptide
  VL of XENP021221

SEQ ID NO: 23304 - protein, 231 aa, Artificial Sequence; identical to SEQ ID NO: 21532
  Description of Artificial Sequence: Synthetic polypeptide
  Fc chain of XENP021221

SEQ ID NO: 23305 - protein, 11 aa, Artificial Sequence
  Description of Artificial Sequence: Synthetic peptide
  XENP021221 vhCDR1
RASQSVGNDVA

SEQ ID NO: 23306 - protein, 7 aa, Artificial Sequence
  Description of Artificial Sequence: Synthetic peptide
  XENP021221 vhCDR2
YASHRYT

SEQ ID NO: 23307 - protein, 9 aa, Artificial Sequence
  Description of Artificial Sequence: Synthetic peptide
  XENP021221 vhCDR3
QQDFSSPRT

SEQ ID NO: 23308 - protein, 5 aa, Artificial Sequence
  Description of Artificial Sequence: Synthetic peptide
  XENP021221 vlCDR1
NYWMN

SEQ ID NO: 23309 - protein, 19 aa, Artificial Sequence
  Description of Artificial Sequence: Synthetic peptide
  XENP021221 vlCDR2
EIRLYSNNYATHYAESVKG

SEQ ID NO: 23310 - protein, 11 aa, Artificial Sequence
  Description of Artificial Sequence: Synthetic peptide
  XENP021221 vlCDR3
YYGNYGGYFDV

SEQ ID NO: 23311 - protein, 213 aa, Artificial Sequence; identical to SEQ ID NO: 21050
  Description of Artificial Sequence: Synthetic polypeptide
  XENP021221 9C6_H1.11_L1-1G6_L1.194_H1.279 Light Chain

SEQ ID NO: 23312 - protein, 106 aa, Artificial Sequence; identical to SEQ ID NO: 21051
  Description of Artificial Sequence: Synthetic polypeptide
  VL of XENP021221

SEQ ID NO: 23313 - protein, 11 aa, Artificial Sequence
  Description of Artificial Sequence: Synthetic peptide
  XENP021221 vlCDR1
KASQSVSNDVA

SEQ ID NO: 23314 - protein, 7 aa, Artificial Sequence
  Description of Artificial Sequence: Synthetic peptide
  XENP021221 vlCDR2
YASNRYT

SEQ ID NO: 23315 - protein, 8 aa, Artificial Sequence
  Description of Artificial Sequence: Synthetic peptide
  XENP021221 vlCDR3
QQDYSSPT

SEQ ID NO: 23316 - protein, 447 aa, Artificial Sequence
  Description of Artificial Sequence: Synthetic polypeptide
  XENP016004 ipilimumab_H0L0-nivolumab_H0.1_L0 Fab-Fc Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23317 - protein, 118 aa, Artificial Sequence; identical to SEQ ID NO: 22
  Description of Artificial Sequence: Synthetic polypeptide
  VH of XENP016004

SEQ ID NO: 23318 - protein, 5 aa, Artificial Sequence
  Description of Artificial Sequence: Synthetic peptide
  XENP016004 vhCDR1
SYTMH

SEQ ID NO: 23319 - protein, 17 aa, Artificial Sequence
  Description of Artificial Sequence: Synthetic peptide
  XENP016004 vhCDR2
FISYDGNNKYYADSVKG

SEQ ID NO: 23320 - protein, 9 aa, Artificial Sequence
  Description of Artificial Sequence: Synthetic peptide
  XENP016004 vhCDR3
TGWLGPFDY

SEQ ID NO: 23321 - protein, 471 aa, Artificial Sequence; identical to SEQ ID NO: 22749
  Description of Artificial Sequence: Synthetic polypeptide
  XENP016004 ipilimumab_H0L0-nivolumab_H0.1_L0 scFv-Fc Heavy Chain

SEQ ID NO: 23322 - protein, 113 aa, Artificial Sequence; identical to SEQ ID NO: 6210
  Description of Artificial Sequence: Synthetic polypeptide
  VH of XENP016004

SEQ ID NO: 23323 - protein, 107 aa, Artificial Sequence [sequence omitted]

SEQ ID NO: 23324 - protein, 231 aa, Artificial Sequence; identical to SEQ ID NO: 21532
  Description of Artificial Sequence: Synthetic polypeptide
  Fc chain of XENP016004

SEQ ID NO: 23325 - protein, 5 aa, Artificial Sequence
  Description of Artificial Sequence: Synthetic peptide
  XENP016004 vhCDR1
NSGMH

SEQ ID NO: 23326 - protein, 17 aa, Artificial Sequence
  Description of Artificial Sequence: Synthetic peptide
  XENP016004 vhCDR2
VIWYDGSKRYYADSVKG

SEQ ID NO: 23327 - protein, 4 aa, Artificial Sequence
  Description of Artificial Sequence: Synthetic peptide
  XENP016004 vhCDR3
NDDY

SEQ ID NO: 23328 - protein, 11 aa, Artificial Sequence
  Description of Artificial Sequence: Synthetic peptide
  XENP016004 vlCDR1
RASQSVSSYLA

SEQ ID NO: 23329 - protein, 7 aa, Artificial Sequence
  Description of Artificial Sequence: Synthetic peptide
  XENP016004 vlCDR2
DASNRAT

SEQ ID NO: 23330 - protein, 9 aa, Artificial Sequence
  Description of Artificial Sequence: Synthetic peptide
  XENP016004 vlCDR3
QQSSNWPRT

SEQ ID NO: 23331 - protein, 215 aa, Artificial Sequence; identical to SEQ ID NO: 2924
  Description of Artificial Sequence: Synthetic polypeptide
  XENP016004 ipilimumab_H0L0-nivolumab_H0.1_L0 Light Chain

SEQ ID NO: 23332 - protein, 108 aa, Artificial Sequence; identical to SEQ ID NO: 23
  Description of Artificial Sequence: Synthetic polypeptide
  VL of XENP016004

SEQ ID NO: 23333 - protein, 12 aa, Artificial Sequence
  Description of Artificial Sequence: Synthetic peptide
  XENP016004 vlCDR1
RASQSVGSSYLA

SEQ ID NO: 23334 - protein, 7 aa, Artificial Sequence
  Description of Artificial Sequence: Synthetic peptide
  XENP016004 vlCDR2
GAFSRAT

SEQ ID NO: 23335 - protein, 9 aa, Artificial Sequence
  Description of Artificial Sequence: Synthetic peptide
  XENP016004 vlCDR3
QQYGSSPWT

SEQ ID NO: 23336 - protein, 447 aa, Artificial Sequence; identical to SEQ ID NO: 23316
  Description of Artificial Sequence: Synthetic polypeptide
  XENP018067 Ipilimumab_H0L0-1G6_H1L1 Fab-Fc Heavy Chain

SEQ ID NO: 23337 - protein, 118 aa, Artificial Sequence; identical to SEQ ID NO: 22
  Description of Artificial Sequence: Synthetic polypeptide
  VH of XENP018067

SEQ ID NO: 23338 - protein, 5 aa, Artificial Sequence
  Description of Artificial Sequence: Synthetic peptide
  XENP018067 vhCDR1
SYTMH

SEQ ID NO: 23339 - protein, 17 aa, Artificial Sequence
  Description of Artificial Sequence: Synthetic peptide
  XENP018067 vhCDR2
FISYDGNNKYYADSVKG

SEQ ID NO: 23340 - protein, 9 aa, Artificial Sequence
  Description of Artificial Sequence: Synthetic peptide
  XENP018067 vhCDR3
TGWLGPFDY

SEQ ID NO: 23341 - protein, 480 aa, Artificial Sequence
  Description of Artificial Sequence: Synthetic polypeptide
  XENP018067 Ipilimumab_H0L0-1G6_H1L1 scFv-Fc Heavy Chain
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23342 - protein, 122 aa, Artificial Sequence; identical to SEQ ID NO: 6246
  Description of Artificial Sequence: Synthetic polypeptide
  VH of XENP018067

SEQ ID NO: 23343 - protein, 107 aa, Artificial Sequence; identical to SEQ ID NO: 6247
  Description of Artificial Sequence: Synthetic polypeptide
  VL of XENP018067

SEQ ID NO: 23344 - protein, 231 aa, Artificial Sequence; identical to SEQ ID NO: 21532
  Description of Artificial Sequence: Synthetic polypeptide
  Fc chain of XENP018067

SEQ ID NO: 23345 - protein, 5 aa, Artificial Sequence
  Description of Artificial Sequence: Synthetic peptide
  XENP018067 vhCDR1
NYWMN

SEQ ID NO: 23346 - protein, 19 aa, Artificial Sequence
  Description of Artificial Sequence: Synthetic peptide
  XENP018067 vhCDR2
EIRLKSNNYATHYAEPVKG

SEQ ID NO: 23347 - protein, 11 aa, Artificial Sequence
  Description of Artificial Sequence: Synthetic peptide
  XENP018067 vhCDR3
YYGNYGGYFDV

SEQ ID NO: 23348 - protein, 11 aa, Artificial Sequence
  Description of Artificial Sequence: Synthetic peptide
  XENP018067 vlCDR1
RASQSVSNDVA

SEQ ID NO: 23349 - protein, 7 aa, Artificial Sequence
  Description of Artificial Sequence: Synthetic peptide
  XENP018067 vlCDR2
YASHRYT

SEQ ID NO: 23350 - protein, 9 aa, Artificial Sequence
  Description of Artificial Sequence: Synthetic peptide
  XENP018067 vlCDR3
QQDYSSPRT

SEQ ID NO: 23351 - protein, 215 aa, Artificial Sequence; identical to SEQ ID NO: 2924
  Description of Artificial Sequence: Synthetic polypeptide
  XENP018067 Ipilimumab_H0L0-1G6_H1L1 Light Chain

SEQ ID NO: 23352 - protein, 108 aa, Artificial Sequence; identical to SEQ ID NO: 23
  Description of Artificial Sequence: Synthetic polypeptide
  VL of XENP018067

SEQ ID NO: 23353 - protein, 12 aa, Artificial Sequence
  Description of Artificial Sequence: Synthetic peptide
  XENP018067 vlCDR1
RASQSVGSSYLA

SEQ ID NO: 23354 - protein, 7 aa, Artificial Sequence
  Description of Artificial Sequence: Synthetic peptide
  XENP018067 vlCDR2
GAFSRAT

SEQ ID NO: 23355 - protein, 9 aa, Artificial Sequence
  Description of Artificial Sequence: Synthetic peptide
  XENP018067 vlCDR3
QQYGSSPWT

SEQ ID NO: 23356 - protein, 447 aa, Artificial Sequence
  Description of Artificial Sequence: Synthetic polypeptide
  XENP019734 ipilimumab_H3L0-nivolumab_H0.1_L0 Fab-Fc Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23357 - protein, 118 aa, Artificial Sequence; identical to SEQ ID NO: 139
  Description of Artificial Sequence: Synthetic polypeptide
  VH of XENP019734

SEQ ID NO: 23358 - protein, 5 aa, Artificial Sequence
  Description of Artificial Sequence: Synthetic peptide
  XENP019734 vhCDR1
SYTMH

SEQ ID NO: 23359 - protein, 17 aa, Artificial Sequence
  Description of Artificial Sequence: Synthetic peptide
  XENP019734 vhCDR2
FISYDGNNKYYADSVKG

SEQ ID NO: 23360 - protein, 9 aa, Artificial Sequence
  Description of Artificial Sequence: Synthetic peptide
  XENP019734 vhCDR3
TGWLGPFDY

SEQ ID NO: 23361 - protein, 471 aa, Artificial Sequence; identical to SEQ ID NO: 22749
  Description of Artificial Sequence: Synthetic polypeptide
  XENP019734 ipilimumab_H3L0-nivolumab_H0.1_L0 scFv-Fc Heavy Chain

SEQ ID NO: 23362 - protein, 113 aa, Artificial Sequence; identical to SEQ ID NO: 6210
  Description of Artificial Sequence: Synthetic polypeptide
  VH of XENP019734

SEQ ID NO: 23363 - protein, 107 aa, Artificial Sequence [sequence omitted]

SEQ ID NO: 23364 - protein, 231 aa, Artificial Sequence; identical to SEQ ID NO: 21532
  Description of Artificial Sequence: Synthetic polypeptide
  Fc chain of XENP019734

SEQ ID NO: 23365 - protein, 5 aa, Artificial Sequence
  Description of Artificial Sequence: Synthetic peptide
  XENP019734 vhCDR1
NSGMH

SEQ ID NO: 23366 - protein, 17 aa, Artificial Sequence
  Description of Artificial Sequence: Synthetic peptide
  XENP019734 vhCDR2
VIWYDGSKRYYADSVKG

SEQ ID NO: 23367 - protein, 4 aa, Artificial Sequence
  Description of Artificial Sequence: Synthetic peptide
  XENP019734 vhCDR3
NDDY

SEQ ID NO: 23368 - protein, 11 aa, Artificial Sequence
  Description of Artificial Sequence: Synthetic peptide
  XENP019734 vlCDR1
RASQSVSSYLA

SEQ ID NO: 23369 - protein, 7 aa, Artificial Sequence
  Description of Artificial Sequence: Synthetic peptide
  XENP019734 vlCDR2
DASNRAT

SEQ ID NO: 23370 - protein, 9 aa, Artificial Sequence
  Description of Artificial Sequence: Synthetic peptide
  XENP019734 vlCDR3
QQSSNWPRT

SEQ ID NO: 23371 - protein, 215 aa, Artificial Sequence; identical to SEQ ID NO: 2924
  Description of Artificial Sequence: Synthetic polypeptide
  XENP019734 ipilimumab_H3L0-nivolumab_H0.1_L0 Light Chain

SEQ ID NO: 23372 - protein, 108 aa, Artificial Sequence; identical to SEQ ID NO: 23
  Description of Artificial Sequence: Synthetic polypeptide
  VL of XENP019734

SEQ ID NO: 23373 - protein, 12 aa, Artificial Sequence
  Description of Artificial Sequence: Synthetic peptide
  XENP019734 vlCDR1
RASQSVGSSYLA

SEQ ID NO: 23374 - protein, 7 aa, Artificial Sequence
  Description of Artificial Sequence: Synthetic peptide
  XENP019734 vlCDR2
GAFSRAT

SEQ ID NO: 23375 - protein, 9 aa, Artificial Sequence
  Description of Artificial Sequence: Synthetic peptide
  XENP019734 vlCDR3
QQYGSSPWT

SEQ ID NO: 23376 - protein, 447 aa, Artificial Sequence; identical to SEQ ID NO: 23356
  Description of Artificial Sequence: Synthetic polypeptide
  XENP019738 ipilimumab_H3L0-1G6_L1.210_H1.288 Fab-Fc Heavy Chain

SEQ ID NO: 23377 - protein, 118 aa, Artificial Sequence; identical to SEQ ID NO: 139
  Description of Artificial Sequence: Synthetic polypeptide
  VH of XENP019738

SEQ ID NO: 23378 - protein, 5 aa, Artificial Sequence
  Description of Artificial Sequence: Synthetic peptide
  XENP019738 vhCDR1
SYTMH

SEQ ID NO: 23379 - protein, 17 aa, Artificial Sequence
  Description of Artificial Sequence: Synthetic peptide
  XENP019738 vhCDR2
FISYDGNNKYYADSVKG

SEQ ID NO: 23380 - protein, 9 aa, Artificial Sequence
  Description of Artificial Sequence: Synthetic peptide
  XENP019738 vhCDR3
TGWLGPFDY

SEQ ID NO: 23381 - protein, 480 aa, Artificial Sequence
  Description of Artificial Sequence: Synthetic polypeptide
  XENP019738 ipilimumab_H3L0-1G6_L1.210_H1.288 scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23382 - protein, 107 aa, Artificial Sequence; identical to SEQ ID NO: 11359
  Description of Artificial Sequence: Synthetic polypeptide
  VH of XENP019738

SEQ ID NO: 23383 - protein, 122 aa, Artificial Sequence; identical to SEQ ID NO: 11358
  Description of Artificial Sequence: Synthetic polypeptide
  VL of XENP019738

SEQ ID NO: 23384 - protein, 231 aa, Artificial Sequence; identical to SEQ ID NO: 21532
  Description of Artificial Sequence: Synthetic polypeptide
  Fc chain of XENP019738

SEQ ID NO: 23385 - protein, 11 aa, Artificial Sequence
  Description of Artificial Sequence: Synthetic peptide
  XENP019738 vhCDR1
RASQSVGNDVA

SEQ ID NO: 23386 - protein, 7 aa, Artificial Sequence
  Description of Artificial Sequence: Synthetic peptide
  XENP019738 vhCDR2
YASHRYT

SEQ ID NO: 23387 - protein, 9 aa, Artificial Sequence
  Description of Artificial Sequence: Synthetic peptide
  XENP019738 vhCDR3
QQDFSSPRT

SEQ ID NO: 23388 - protein, 5 aa, Artificial Sequence
  Description of Artificial Sequence: Synthetic peptide
  XENP019738 vlCDR1
NYWMN

SEQ ID NO: 23389 - protein, 19 aa, Artificial Sequence
  Description of Artificial Sequence: Synthetic peptide
  XENP019738 vlCDR2
EIRLYSNNYATHYAESVKG

SEQ ID NO: 23390 - protein, 11 aa, Artificial Sequence
  Description of Artificial Sequence: Synthetic peptide
  XENP019738 vlCDR3
YYGNYGGYFDV

SEQ ID NO: 23391 - protein, 215 aa, Artificial Sequence; identical to SEQ ID NO: 2924
  Description of Artificial Sequence: Synthetic polypeptide
  XENP019738 ipilimumab_H3L0-1G6_L1.210_H1.288 Light Chain

SEQ ID NO: 23392 - protein, 108 aa, Artificial Sequence; identical to SEQ ID NO: 23
  Description of Artificial Sequence: Synthetic polypeptide
  VL of XENP019738

SEQ ID NO: 23393 - protein, 12 aa, Artificial Sequence
  Description of Artificial Sequence: Synthetic peptide
  XENP019738 vlCDR1
RASQSVGSSYLA

SEQ ID NO: 23394 - protein, 7 aa, Artificial Sequence
  Description of Artificial Sequence: Synthetic peptide
  XENP019738 vlCDR2
GAFSRAT

SEQ ID NO: 23395 - protein, 9 aa, Artificial Sequence
  Description of Artificial Sequence: Synthetic peptide
  XENP019738 vlCDR3
QQYGSSPWT

SEQ ID NO: 23396 - protein, 447 aa, Artificial Sequence; identical to SEQ ID NO: 23356
  Description of Artificial Sequence: Synthetic polypeptide
  XENP019739 ipilimumab_H3L0-1G6_H1.279_L1.194 Fab-Fc Heavy Chain

SEQ ID NO: 23397 - protein, 118 aa, Artificial Sequence; identical to SEQ ID NO: 139
  Description of Artificial Sequence: Synthetic polypeptide
  VH of XENP019739

SEQ ID NO: 23398 - protein, 5 aa, Artificial Sequence
  Description of Artificial Sequence: Synthetic peptide
  XENP019739 vhCDR1
SYTMH

SEQ ID NO: 23399 - protein, 17 aa, Artificial Sequence
  Description of Artificial Sequence: Synthetic peptide
  XENP019739 vhCDR2
FISYDGNNKYYADSVKG

SEQ ID NO: 23400 - protein, 9 aa, Artificial Sequence
  Description of Artificial Sequence: Synthetic peptide
  XENP019739 vhCDR3
TGWLGPFDY

SEQ ID NO: 23401 - protein, 480 aa, Artificial Sequence
  Description of Artificial Sequence: Synthetic polypeptide
  XENP019739 ipilimumab_H3L0-1G6_H1.279_L1.194 scFv-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23402 - protein, 122 aa, Artificial Sequence; identical to SEQ ID NO: 10908
  Description of Artificial Sequence: Synthetic polypeptide
  VH of XENP019739

SEQ ID NO: 23403 - protein, 107 aa, Artificial Sequence; identical to SEQ ID NO: 10999
  Description of Artificial Sequence: Synthetic polypeptide
  VL of XENP019739

SEQ ID NO: 23404 - protein, 231 aa, Artificial Sequence; identical to SEQ ID NO: 21532
  Description of Artificial Sequence: Synthetic polypeptide
  Fc chain of XENP019739

SEQ ID NO: 23405 - protein, 5 aa, Artificial Sequence
  Description of Artificial Sequence: Synthetic peptide
  XENP019739 vhCDR1
NYWMN

SEQ ID NO: 23406 - protein, 19 aa, Artificial Sequence
  Description of Artificial Sequence: Synthetic peptide
  XENP019739 vhCDR2
EIRLYSNNYATHYAESVKG

SEQ ID NO: 23407 - protein, 11 aa, Artificial Sequence
  Description of Artificial Sequence: Synthetic peptide
  XENP019739 vhCDR3
YYGNYGGYFDV

SEQ ID NO: 23408 - protein, 11 aa, Artificial Sequence
  Description of Artificial Sequence: Synthetic peptide
  XENP019739 vlCDR1
RASQSVGNDVA

SEQ ID NO: 23409 - protein, 7 aa, Artificial Sequence
  Description of Artificial Sequence: Synthetic peptide
  XENP019739 vlCDR2
YASHRYT

SEQ ID NO: 23410 - protein, 9 aa, Artificial Sequence
  Description of Artificial Sequence: Synthetic peptide
  XENP019739 vlCDR3
QQDFSSPRT

SEQ ID NO: 23411 - protein, 215 aa, Artificial Sequence; identical to SEQ ID NO: 2924
  Description of Artificial Sequence: Synthetic polypeptide
  XENP019739 ipilimumab_H3L0-1G6_H1.279_L1.194 Light Chain

SEQ ID NO: 23412 - protein, 108 aa, Artificial Sequence; identical to SEQ ID NO: 23
  Description of Artificial Sequence: Synthetic polypeptide
  VL of XENP019739

SEQ ID NO: 23413 - protein, 12 aa, Artificial Sequence
  Description of Artificial Sequence: Synthetic peptide
  XENP019739 vlCDR1
RASQSVGSSYLA

SEQ ID NO: 23414 - protein, 7 aa, Artificial Sequence
  Description of Artificial Sequence: Synthetic peptide
  XENP019739 vlCDR2
GAFSRAT

SEQ ID NO: 23415 - protein, 9 aa, Artificial Sequence
  Description of Artificial Sequence: Synthetic peptide
  XENP019739 vlCDR3
QQYGSSPWT

SEQ ID NO: 23416 - protein, 447 aa, Artificial Sequence; identical to SEQ ID NO: 23356
  Description of Artificial Sequence: Synthetic polypeptide
  XENP019741 ipilimumab_H3L0-1G6_L1.194_H1.279 Fab-Fc Heavy Chain

SEQ ID NO: 23417 - protein, 118 aa, Artificial Sequence; identical to SEQ ID NO: 139
  Description of Artificial Sequence: Synthetic polypeptide
  VH of XENP019741

SEQ ID NO: 23418 - protein, 5 aa, Artificial Sequence
  Description of Artificial Sequence: Synthetic peptide
  XENP019741 vhCDR1
SYTMH

SEQ ID NO: 23419 - protein, 17 aa, Artificial Sequence
  Description of Artificial Sequence: Synthetic peptide
  XENP019741 vhCDR2
FISYDGNNKYYADSVKG

SEQ ID NO: 23420 - protein, 9 aa, Artificial Sequence
  Description of Artificial Sequence: Synthetic peptide
  XENP019741 vhCDR3
TGWLGPFDY

SEQ ID NO: 23421 - protein, 480 aa, Artificial Sequence; identical to SEQ ID NO: 23221
  Description of Artificial Sequence: Synthetic polypeptide
  XENP019741 ipilimumab_H3L0-1G6_L1.194_H1.279 scFv-Fc Heavy Chain

SEQ ID NO: 23422 - protein, 107 aa, Artificial Sequence; identical to SEQ ID NO: 10999
  Description of Artificial Sequence: Synthetic polypeptide
  VH of XENP019741

SEQ ID NO: 23423 - protein, 122 aa, Artificial Sequence; identical to SEQ ID NO: 10908
  Description of Artificial Sequence: Synthetic polypeptide
  VL of XENP019741

SEQ ID NO: 23424 - protein, 231 aa, Artificial Sequence; identical to SEQ ID NO: 21532
  Description of Artificial Sequence: Synthetic polypeptide
  Fc chain of XENP019741

SEQ ID NO: 23425 - protein, 11 aa, Artificial Sequence
  Description of Artificial Sequence: Synthetic peptide
  XENP019741 vhCDR1
RASQSVGNDVA

SEQ ID NO: 23426 - protein, 7 aa, Artificial Sequence
  Description of Artificial Sequence: Synthetic peptide
  XENP019741 vhCDR2
YASHRYT

SEQ ID NO: 23427 - protein, 9 aa, Artificial Sequence
  Description of Artificial Sequence: Synthetic peptide
  XENP019741 vhCDR3
QQDFSSPRT

SEQ ID NO: 23428 - protein, 5 aa, Artificial Sequence
  Description of Artificial Sequence: Synthetic peptide
  XENP019741 vlCDR1
NYWMN

SEQ ID NO: 23429 - protein, 19 aa, Artificial Sequence
  Description of Artificial Sequence: Synthetic peptide
  XENP019741 vlCDR2
EIRLYSNNYATHYAESVKG

SEQ ID NO: 23430 - protein, 11 aa, Artificial Sequence
  Description of Artificial Sequence: Synthetic peptide
  XENP019741 vlCDR3
YYGNYGGYFDV

SEQ ID NO: 23431 - protein, 215 aa, Artificial Sequence; identical to SEQ ID NO: 2924
  Description of Artificial Sequence: Synthetic polypeptide
  XENP019741 ipilimumab_H3L0-1G6_L1.194_H1.279 Light Chain

SEQ ID NO: 23432 - protein, 108 aa, Artificial Sequence; identical to SEQ ID NO: 23
  Description of Artificial Sequence: Synthetic polypeptide
  VL of XENP019741

SEQ ID NO: 23433 - protein, 12 aa, Artificial Sequence
  Description of Artificial Sequence: Synthetic peptide
  XENP019741 vlCDR1
RASQSVGSSYLA

SEQ ID NO: 23434 - protein, 7 aa, Artificial Sequence
  Description of Artificial Sequence: Synthetic peptide
  XENP019741 vlCDR2
GAFSRAT

SEQ ID NO: 23435 - protein, 9 aa, Artificial Sequence
  Description of Artificial Sequence: Synthetic peptide
  XENP019741 vlCDR3
QQYGSSPWT

SEQ ID NO: 23436 - protein, 447 aa, Artificial Sequence; identical to SEQ ID NO: 23356
  Description of Artificial Sequence: Synthetic polypeptide
  XENP020053 ipilimumab_H3L0.22-1G6_L1.194_H1.279 Fab-Fc Heavy Chain

SEQ ID NO: 23437 - protein, 118 aa, Artificial Sequence; identical to SEQ ID NO: 139
  Description of Artificial Sequence: Synthetic polypeptide
  VH of XENP020053

SEQ ID NO: 23438 - protein, 5 aa, Artificial Sequence
  Description of Artificial Sequence: Synthetic peptide
  XENP020053 vhCDR1
SYTMH

SEQ ID NO: 23439 - protein, 17 aa, Artificial Sequence
  Description of Artificial Sequence: Synthetic peptide
  XENP020053 vhCDR2
FISYDGNNKYYADSVKG

SEQ ID NO: 23440 - protein, 9 aa, Artificial Sequence
  Description of Artificial Sequence: Synthetic peptide
  XENP020053 vhCDR3
TGWLGPFDY

SEQ ID NO: 23441 - protein, 480 aa, Artificial Sequence; identical to SEQ ID NO: 23221
  Description of Artificial Sequence: Synthetic polypeptide
  XENP020053 ipilimumab_H3L0.22-1G6_L1.194_H1.279 scFv-Fc Heavy Chain

SEQ ID NO: 23442 - protein, 107 aa, Artificial Sequence; identical to SEQ ID NO: 10999
  Description of Artificial Sequence: Synthetic polypeptide
  VH of XENP020053

SEQ ID NO: 23443 - protein, 122 aa, Artificial Sequence; identical to SEQ ID NO: 10908
  Description of Artificial Sequence: Synthetic polypeptide
  VL of XENP020053

SEQ ID NO: 23444 - protein, 231 aa, Artificial Sequence; identical to SEQ ID NO: 21532
  Description of Artificial Sequence: Synthetic polypeptide
  Fc chain of XENP020053

SEQ ID NO: 23445 - protein, 11 aa, Artificial Sequence
  Description of Artificial Sequence: Synthetic peptide
  XENP020053 vhCDR1
RASQSVGNDVA

SEQ ID NO: 23446 - protein, 7 aa, Artificial Sequence
  Description of Artificial Sequence: Synthetic peptide
  XENP020053 vhCDR2
YASHRYT

SEQ ID NO: 23447 - protein, 9 aa, Artificial Sequence
  Description of Artificial Sequence: Synthetic peptide
  XENP020053 vhCDR3
QQDFSSPRT

SEQ ID NO: 23448 - protein, 5 aa, Artificial Sequence
  Description of Artificial Sequence: Synthetic peptide
  XENP020053 vlCDR1
NYWMN

SEQ ID NO: 23449 - protein, 19 aa, Artificial Sequence
  Description of Artificial Sequence: Synthetic peptide
  XENP020053 vlCDR2
EIRLYSNNYATHYAESVKG

SEQ ID NO: 23450 - protein, 11 aa, Artificial Sequence
  Description of Artificial Sequence: Synthetic peptide
  XENP020053 vlCDR3
YYGNYGGYFDV

SEQ ID NO: 23451 - protein, 215 aa, Artificial Sequence; identical to SEQ ID NO: 4504
  Description of Artificial Sequence: Synthetic polypeptide
  XENP020053 ipilimumab_H3L0.22-1G6_L1.194_H1.279 Light Chain

SEQ ID NO: 23452 - protein, 108 aa, Artificial Sequence; identical to SEQ ID NO: 1607
  Description of Artificial Sequence: Synthetic polypeptide
  VL of XENP020053

SEQ ID NO: 23453 - protein, 12 aa, Artificial Sequence
  Description of Artificial Sequence: Synthetic peptide
  XENP020053 vlCDR1
RASQSVSSSYLA

SEQ ID NO: 23454 - protein, 7 aa, Artificial Sequence
  Description of Artificial Sequence: Synthetic peptide
  XENP020053 vlCDR2
GAFSRAT

SEQ ID NO: 23455 - protein, 9 aa, Artificial Sequence
  Description of Artificial Sequence: Synthetic peptide
  XENP020053 vlCDR3
QQYGSSPWT

SEQ ID NO: 23456 - protein, 447 aa, Artificial Sequence; identical to SEQ ID NO: 23356
  Description of Artificial Sequence: Synthetic polypeptide
  XENP020066 ipilimumab_H3_L0.22-1G6_H1.279_L1.194 Fab-Fc Heavy Chain

SEQ ID NO: 23457 - protein, 118 aa, Artificial Sequence; identical to SEQ ID NO: 139
  Description of Artificial Sequence: Synthetic polypeptide
  VH of XENP020066

SEQ ID NO: 23458 - protein, 5 aa, Artificial Sequence
  Description of Artificial Sequence: Synthetic peptide
  XENP020066 vhCDR1
SYTMH

SEQ ID NO: 23459 - protein, 17 aa, Artificial Sequence
  Description of Artificial Sequence: Synthetic peptide
  XENP020066 vhCDR2
FISYDGNNKYYADSVKG

SEQ ID NO: 23460 - protein, 9 aa, Artificial Sequence
  Description of Artificial Sequence: Synthetic peptide
  XENP020066 vhCDR3
TGWLGPFDY

SEQ ID NO: 23461 - protein, 480 aa, Artificial Sequence; identical to SEQ ID NO: 23401
  Description of Artificial Sequence: Synthetic polypeptide
  XENP020066 ipilimumab_H3_L0.22-1G6_H1.279_L1.194 scFv-Fc Heavy Chain

SEQ ID NO: 23462 - protein, 122 aa, Artificial Sequence; identical to SEQ ID NO: 10908
  Description of Artificial Sequence: Synthetic polypeptide
  VH of XENP020066

SEQ ID NO: 23463 - protein, 107 aa, Artificial Sequence; identical to SEQ ID NO: 10999
  Description of Artificial Sequence: Synthetic polypeptide
  VL of XENP020066

SEQ ID NO: 23464 - protein, 231 aa, Artificial Sequence; identical to SEQ ID NO: 21532
  Description of Artificial Sequence: Synthetic polypeptide
  Fc chain of XENP020066

SEQ ID NO: 23465 - protein, 5 aa, Artificial Sequence
  Description of Artificial Sequence: Synthetic peptide
  XENP020066 vhCDR1
NYWMN

SEQ ID NO: 23466 - protein, 19 aa, Artificial Sequence
  Description of Artificial Sequence: Synthetic peptide
  XENP020066 vhCDR2
EIRLYSNNYATHYAESVKG

SEQ ID NO: 23467 - protein, 11 aa, Artificial Sequence
  Description of Artificial Sequence: Synthetic peptide
  XENP020066 vhCDR3
YYGNYGGYFDV

SEQ ID NO: 23468 - protein, 11 aa, Artificial Sequence
  Description of Artificial Sequence: Synthetic peptide
  XENP020066 vlCDR1
RASQSVGNDVA

SEQ ID NO: 23469 - protein, 7 aa, Artificial Sequence
  Description of Artificial Sequence: Synthetic peptide
  XENP020066 vlCDR2
YASHRYT

SEQ ID NO: 23470 - protein, 9 aa, Artificial Sequence
  Description of Artificial Sequence: Synthetic peptide
  XENP020066 vlCDR3
QQDFSSPRT

SEQ ID NO: 23471 - protein, 215 aa, Artificial Sequence; identical to SEQ ID NO: 4504
  Description of Artificial Sequence: Synthetic polypeptide
  XENP020066 ipilimumab_H3_L0.22-1G6_H1.279_L1.194 Light Chain

SEQ ID NO: 23472 - protein, 108 aa, Artificial Sequence; identical to SEQ ID NO: 1607
  Description of Artificial Sequence: Synthetic polypeptide
  VL of XENP020066

SEQ ID NO: 23473 - protein, 12 aa, Artificial Sequence
  Description of Artificial Sequence: Synthetic peptide
  XENP020066 vlCDR1
RASQSVSSSYLA

SEQ ID NO: 23474 - protein, 7 aa, Artificial Sequence
  Description of Artificial Sequence: Synthetic peptide
  XENP020066 vlCDR2
GAFSRAT

SEQ ID NO: 23475 - protein, 9 aa, Artificial Sequence
  Description of Artificial Sequence: Synthetic peptide
  XENP020066 vlCDR3
QQYGSSPWT

SEQ ID NO: 23476 - protein, 447 aa, Artificial Sequence; identical to SEQ ID NO: 23356
  Description of Artificial Sequence: Synthetic polypeptide
  XENP020130 ipilimumab_H3_L0.22-1G6_L1.210_H1.288 Fab-Fc Heavy Chain

SEQ ID NO: 23477 - protein, 118 aa, Artificial Sequence; identical to SEQ ID NO: 139
  Description of Artificial Sequence: Synthetic polypeptide
  VH of XENP020130

SEQ ID NO: 23478 - protein, 5 aa, Artificial Sequence
  Description of Artificial Sequence: Synthetic peptide
  XENP020130 vhCDR1
SYTMH

SEQ ID NO: 23479 - protein, 17 aa, Artificial Sequence
  Description of Artificial Sequence: Synthetic peptide
  XENP020130 vhCDR2
FISYDGNNKYYADSVKG

SEQ ID NO: 23480 - protein, 9 aa, Artificial Sequence
  Description of Artificial Sequence: Synthetic peptide
  XENP020130 vhCDR3
TGWLGPFDY

SEQ ID NO: 23481 - protein, 480 aa, Artificial Sequence; identical to SEQ ID NO: 23381
  Description of Artificial Sequence: Synthetic polypeptide
  XENP020130 ipilimumab_H3_L0.22-1G6_L1.210_H1.288 scFv-Fc Heavy Chain

SEQ ID NO: 23482 - protein, 107 aa, Artificial Sequence; identical to SEQ ID NO: 11359
  Description of Artificial Sequence: Synthetic polypeptide
  VH of XENP020130

SEQ ID NO: 23483 - protein, 122 aa, Artificial Sequence; identical to SEQ ID NO: 11358
  Description of Artificial Sequence: Synthetic polypeptide
  VL of XENP020130

SEQ ID NO: 23484 - protein, 231 aa, Artificial Sequence; identical to SEQ ID NO: 21532
  Description of Artificial Sequence: Synthetic polypeptide
  Fc chain of XENP020130

SEQ ID NO: 23485 - protein, 11 aa, Artificial Sequence
  Description of Artificial Sequence: Synthetic peptide
  XENP020130 vhCDR1
RASQSVGNDVA

SEQ ID NO: 23486 - protein, 7 aa, Artificial Sequence
  Description of Artificial Sequence: Synthetic peptide
  XENP020130 vhCDR2
YASHRYT

SEQ ID NO: 23487 - protein, 9 aa, Artificial Sequence
  Description of Artificial Sequence: Synthetic peptide
  XENP020130 vhCDR3
QQDFSSPRT

SEQ ID NO: 23488 - protein, 5 aa, Artificial Sequence
  Description of Artificial Sequence: Synthetic peptide
  XENP020130 vlCDR1
NYWMN

SEQ ID NO: 23489 - protein, 19 aa, Artificial Sequence
  Description of Artificial Sequence: Synthetic peptide
  XENP020130 vlCDR2
EIRLYSNNYATHYAESVKG

SEQ ID NO: 23490 - protein, 11 aa, Artificial Sequence
  Description of Artificial Sequence: Synthetic peptide
  XENP020130 vlCDR3
YYGNYGGYFDV

SEQ ID NO: 23491 - protein, 215 aa, Artificial Sequence; identical to SEQ ID NO: 4504
  Description of Artificial Sequence: Synthetic polypeptide
  XENP020130 ipilimumab_H3_L0.22-1G6_L1.210_H1.288 Light Chain

SEQ ID NO: 23492 - protein, 108 aa, Artificial Sequence; identical to SEQ ID NO: 1607
  Description of Artificial Sequence: Synthetic polypeptide
  VL of XENP020130

SEQ ID NO: 23493 - protein, 12 aa, Artificial Sequence
  Description of Artificial Sequence: Synthetic peptide
  XENP020130 vlCDR1
RASQSVSSSYLA

SEQ ID NO: 23494 - protein, 7 aa, Artificial Sequence
  Description of Artificial Sequence: Synthetic peptide
  XENP020130 vlCDR2
GAFSRAT

SEQ ID NO: 23495 - protein, 9 aa, Artificial Sequence
  Description of Artificial Sequence: Synthetic peptide
  XENP020130 vlCDR3
QQYGSSPWT

SEQ ID NO: 23496 - protein, 447 aa, Artificial Sequence; identical to SEQ ID NO: 23356
  Description of Artificial Sequence: Synthetic polypeptide
  XENP020146 ipilimumab_H3_L0.22-1G6_H1.280_L1.224 Fab-Fc Heavy Chain

SEQ ID NO: 23497 - protein, 118 aa, Artificial Sequence; identical to SEQ ID NO: 139
  Description of Artificial Sequence: Synthetic polypeptide
  VH of XENP020146

SEQ ID NO: 23498 - protein, 5 aa, Artificial Sequence
  Description of Artificial Sequence: Synthetic peptide
  XENP020146 vhCDR1
SYTMH

SEQ ID NO: 23499 - protein, 17 aa, Artificial Sequence
  Description of Artificial Sequence: Synthetic peptide
  XENP020146 vhCDR2
FISYDGNNKYYADSVKG

SEQ ID NO: 23500 - protein, 9 aa, Artificial Sequence
  Description of Artificial Sequence: Synthetic peptide
  XENP020146 vhCDR3
TGWLGPFDY

SEQ ID NO: 23501 - protein, 480 aa, Artificial Sequence; identical to SEQ ID NO: 22809
  Description of Artificial Sequence: Synthetic polypeptide
  XENP020146 ipilimumab_H3_L0.22-1G6_H1.280_L1.224 scFv-Fc Heavy Chain

SEQ ID NO: 23502 - protein, 122 aa, Artificial Sequence; identical to SEQ ID NO: 10917
  Description of Artificial Sequence: Synthetic polypeptide
  VH of XENP020146

SEQ ID NO: 23503 - protein, 107 aa, Artificial Sequence; identical to SEQ ID NO: 22811
  Description of Artificial Sequence: Synthetic polypeptide
  VL of XENP020146

SEQ ID NO: 23504 - protein, 231 aa, Artificial Sequence; identical to SEQ ID NO: 21532
  Description of Artificial Sequence: Synthetic polypeptide
  Fc chain of XENP020146

SEQ ID NO: 23505 - protein, 5 aa, Artificial Sequence
  Description of Artificial Sequence: Synthetic peptide
  XENP020146 vhCDR1
NYWMN

SEQ ID NO: 23506 - protein, 19 aa, Artificial Sequence
  Description of Artificial Sequence: Synthetic peptide
  XENP020146 vhCDR2
EIRLYSNNYATHYAESVKG

SEQ ID NO: 23507 - protein, 11 aa, Artificial Sequence
  Description of Artificial Sequence: Synthetic peptide
  XENP020146 vhCDR3
YYGNYGGYFDV

SEQ ID NO: 23508 - protein, 11 aa, Artificial Sequence
  Description of Artificial Sequence: Synthetic peptide
  XENP020146 vlCDR1
RASQSVGNDVA

SEQ ID NO: 23509 - protein, 7 aa, Artificial Sequence
  Description of Artificial Sequence: Synthetic peptide
  XENP020146 vlCDR2
YASHRYT

SEQ ID NO: 23510 - protein, 9 aa, Artificial Sequence
  Description of Artificial Sequence: Synthetic peptide
  XENP020146 vlCDR3
QQDWSSPRT

SEQ ID NO: 23511 - protein, 215 aa, Artificial Sequence; identical to SEQ ID NO: 4504
  Description of Artificial Sequence: Synthetic polypeptide
  XENP020146 ipilimumab_H3_L0.22-1G6_H1.280_L1.224 Light Chain

SEQ ID NO: 23512 - protein, 108 aa, Artificial Sequence; identical to SEQ ID NO: 1607
  Description of Artificial Sequence: Synthetic polypeptide
  VL of XENP020146

SEQ ID NO: 23513 - protein, 12 aa, Artificial Sequence
  Description of Artificial Sequence: Synthetic peptide
  XENP020146 vlCDR1
RASQSVSSSYLA

SEQ ID NO: 23514 - protein, 7 aa, Artificial Sequence
  Description of Artificial Sequence: Synthetic peptide
  XENP020146 vlCDR2
GAFSRAT

SEQ ID NO: 23515 - protein, 9 aa, Artificial Sequence
  Description of Artificial Sequence: Synthetic peptide
  XENP020146 vlCDR3
QQYGSSPWT

SEQ ID NO: 23516 - protein, 451 aa, Artificial Sequence
  Description of Artificial Sequence: Synthetic polypeptide
  XENP020155 1G6_H1.278_L1.188-ipilimumab_H3.4_L0.12 Fab-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23517 - protein, 122 aa, Artificial Sequence; identical to SEQ ID NO: 10845
  Description of Artificial Sequence: Synthetic polypeptide
  VH of XENP020155

SEQ ID NO: 23518 - protein, 5 aa, Artificial Sequence
  Description of Artificial Sequence: Synthetic peptide
  XENP020155 vhCDR1
NYWMN

SEQ ID NO: 23519 - protein, 19 aa, Artificial Sequence
  Description of Artificial Sequence: Synthetic peptide
  XENP020155 vhCDR2
EIRLYSNNYATHYAESVKG

SEQ ID NO: 23520 - protein, 11 aa, Artificial Sequence
  Description of Artificial Sequence: Synthetic peptide
  XENP020155 vhCDR3
YYGNYGGYFDV

SEQ ID NO: 23521 - protein, 477 aa, Artificial Sequence; identical to SEQ ID NO: 21549
  Description of Artificial Sequence: Synthetic polypeptide
  XENP020155 1G6_H1.278_L1.188-ipilimumab_H3.4_L0.12 scFv-Fc Heavy Chain

SEQ ID NO: 23522 - protein, 118 aa, Artificial Sequence; identical to SEQ ID NO: 2461
  Description of Artificial Sequence: Synthetic polypeptide
  VH of XENP020155

SEQ ID NO: 23523 - protein, 108 aa, Artificial Sequence; identical to SEQ ID NO: 1517
  Description of Artificial Sequence: Synthetic polypeptide
  VL of XENP020155

SEQ ID NO: 23524 - protein, 231 aa, Artificial Sequence; identical to SEQ ID NO: 21532
  Description of Artificial Sequence: Synthetic polypeptide
  Fc chain of XENP020155

SEQ ID NO: 23525 - protein, 5 aa, Artificial Sequence
  Description of Artificial Sequence: Synthetic peptide
  XENP020155 vhCDR1
SYTMH

SEQ ID NO: 23526 - protein, 17 aa, Artificial Sequence
  Description of Artificial Sequence: Synthetic peptide
  XENP020155 vhCDR2
FISYDGNHKYYADSVKG

SEQ ID NO: 23527 - protein, 9 aa, Artificial Sequence
  Description of Artificial Sequence: Synthetic peptide
  XENP020155 vhCDR3
TGHLGPFDL

SEQ ID NO: 23528 - protein, 12 aa, Artificial Sequence
  Description of Artificial Sequence: Synthetic peptide
  XENP020155 vlCDR1
RASQSVGSSYLA

SEQ ID NO: 23529 - protein, 7 aa, Artificial Sequence
  Description of Artificial Sequence: Synthetic peptide
  XENP020155 vlCDR2
GAFSRAT

SEQ ID NO: 23530 - protein, 9 aa, Artificial Sequence
  Description of Artificial Sequence: Synthetic peptide
  XENP020155 vlCDR3
QQYGSSPWT

SEQ ID NO: 23531 - protein, 214 aa, Artificial Sequence; identical to SEQ ID NO: 16660
  Description of Artificial Sequence: Synthetic polypeptide
  XENP020155 1G6_H1.278_L1.188-ipilimumab_H3.4_L0.12 Light Chain

SEQ ID NO: 23532 - protein, 107 aa, Artificial Sequence; identical to SEQ ID NO: 10855
  Description of Artificial Sequence: Synthetic polypeptide
  VL of XENP020155

SEQ ID NO: 23533 - protein, 11 aa, Artificial Sequence
  Description of Artificial Sequence: Synthetic peptide
  XENP020155 vlCDR1
RASQSVGNDVA

SEQ ID NO: 23534 - protein, 7 aa, Artificial Sequence
  Description of Artificial Sequence: Synthetic peptide
  XENP020155 vlCDR2
YASHRYT

SEQ ID NO: 23535 - protein, 9 aa, Artificial Sequence
  Description of Artificial Sequence: Synthetic peptide
  XENP020155 vlCDR3
QQDFSSPRT

SEQ ID NO: 23536 - protein, 447 aa, Artificial Sequence; identical to SEQ ID NO: 23356
  Description of Artificial Sequence: Synthetic polypeptide
  XENP020264 ipilimumab_H3_L0-1G6_H1.280_L1.224 Fab-Fc Heavy Chain

SEQ ID NO: 23537 - protein, 118 aa, Artificial Sequence; identical to SEQ ID NO: 139
  Description of Artificial Sequence: Synthetic polypeptide
  VH of XENP020264

SEQ ID NO: 23538 - protein, 5 aa, Artificial Sequence
  Description of Artificial Sequence: Synthetic peptide
  XENP020264 vhCDR1
SYTMH

SEQ ID NO: 23539 - protein, 17 aa, Artificial Sequence
  Description of Artificial Sequence: Synthetic peptide
  XENP020264 vhCDR2
FISYDGNNKYYADSVKG

SEQ ID NO: 23540 - protein, 9 aa, Artificial Sequence
  Description of Artificial Sequence: Synthetic peptide
  XENP020264 vhCDR3
TGWLGPFDY

SEQ ID NO: 23541 - protein, 480 aa, Artificial Sequence; identical to SEQ ID NO: 22809
  Description of Artificial Sequence: Synthetic polypeptide
  XENP020264 ipilimumab_H3_L0-1G6_H1.280_L1.224 scFv-Fc Heavy Chain

SEQ ID NO: 23542 - protein, 122 aa, Artificial Sequence; identical to SEQ ID NO: 10917
  Description of Artificial Sequence: Synthetic polypeptide
  VH of XENP020264

SEQ ID NO: 23543 - protein, 107 aa, Artificial Sequence; identical to SEQ ID NO: 22811
  Description of Artificial Sequence: Synthetic polypeptide
  VL of XENP020264

SEQ ID NO: 23544 - protein, 231 aa, Artificial Sequence; identical to SEQ ID NO: 21532
  Description of Artificial Sequence: Synthetic polypeptide
  Fc chain of XENP020264

SEQ ID NO: 23545 - protein, 5 aa, Artificial Sequence
  Description of Artificial Sequence: Synthetic peptide
  XENP020264 vhCDR1
NYWMN

SEQ ID NO: 23546 - protein, 19 aa, Artificial Sequence
  Description of Artificial Sequence: Synthetic peptide
  XENP020264 vhCDR2
EIRLYSNNYATHYAESVKG

SEQ ID NO: 23547 - protein, 11 aa, Artificial Sequence
  Description of Artificial Sequence: Synthetic peptide
  XENP020264 vhCDR3
YYGNYGGYFDV

SEQ ID NO: 23548 - protein, 11 aa, Artificial Sequence
  Description of Artificial Sequence: Synthetic peptide
  XENP020264 vlCDR1
RASQSVGNDVA

SEQ ID NO: 23549 - protein, 7 aa, Artificial Sequence
  Description of Artificial Sequence: Synthetic peptide
  XENP020264 vlCDR2
YASHRYT

SEQ ID NO: 23550 - protein, 9 aa, Artificial Sequence
  Description of Artificial Sequence: Synthetic peptide
  XENP020264 vlCDR3
QQDWSSPRT

SEQ ID NO: 23551 - protein, 215 aa, Artificial Sequence; identical to SEQ ID NO: 2924
  Description of Artificial Sequence: Synthetic polypeptide
  XENP020264 ipilimumab_H3_L0-1G6_H1.280_L1.224 Light Chain

SEQ ID NO: 23552 - protein, 108 aa, Artificial Sequence; identical to SEQ ID NO: 23
  Description of Artificial Sequence: Synthetic polypeptide
  VL of XENP020264

SEQ ID NO: 23553 - protein, 12 aa, Artificial Sequence
  Description of Artificial Sequence: Synthetic peptide
  XENP020264 vlCDR1
RASQSVGSSYLA

SEQ ID NO: 23554 - protein, 7 aa, Artificial Sequence
  Description of Artificial Sequence: Synthetic peptide
  XENP020264 vlCDR2
GAFSRAT

SEQ ID NO: 23555 - protein, 9 aa, Artificial Sequence
  Description of Artificial Sequence: Synthetic peptide
  XENP020264 vlCDR3
QQYGSSPWT

SEQ ID NO: 23556 - protein, 447 aa, Artificial Sequence
  Description of Artificial Sequence: Synthetic polypeptide
  XENP020716 ipilimumab_H3_L0.22-1G6_L1.210_H1.288 M428L/N434S Fab-Fc Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 23557 - protein, 118 aa, Artificial Sequence; identical to SEQ ID NO: 139
  Description of Artificial Sequence: Synthetic polypeptide
  VH of XENP020716

SEQ ID NO: 23558 - protein, 5 aa, Artificial Sequence
  Description of Artificial Sequence: Synthetic peptide
  XENP020716 vhCDR1
SYTMH

SEQ ID NO: 23559 - protein, 17 aa, Artificial Sequence
  Description of Artificial Sequence: Synthetic peptide
  XENP020716 vhCDR2
FISYDGNNKYYADSVKG

SEQ ID NO: 23560 - protein, 9 aa, Artificial Sequence
  Description of Artificial Sequence: Synthetic peptide
  XENP020716 vhCDR3
TGWLGPFDY

SEQ ID NO: 23561 - protein, 480 aa, Artificial Sequence
  Description of Artificial Sequence: Synthetic polypeptide
  XENP020716 ipilimumab_H3_L0.22-1G6_L1.210_H1.288 M428L/N434S scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKGKPGSGKPGSGKPGSGKPGSEVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23562 - protein, 107 aa, Artificial Sequence; identical to SEQ ID NO: 11359
  Description of Artificial Sequence: Synthetic polypeptide
  VH of XENP020716

SEQ ID NO: 23563 - protein, 122 aa, Artificial Sequence; identical to SEQ ID NO: 11358
  Description of Artificial Sequence: Synthetic polypeptide
  VL of XENP020716

SEQ ID NO: 23564 - protein, 231 aa, Artificial Sequence; identical to SEQ ID NO: 21572
  Description of Artificial Sequence: Synthetic polypeptide
  Fc chain of XENP020716

SEQ ID NO: 23565 - protein, 11 aa, Artificial Sequence
  Description of Artificial Sequence: Synthetic peptide
  XENP020716 vhCDR1
RASQSVGNDVA

SEQ ID NO: 23566 - protein, 7 aa, Artificial Sequence
  Description of Artificial Sequence: Synthetic peptide
  XENP020716 vhCDR2
YASHRYT

SEQ ID NO: 23567 - protein, 9 aa, Artificial Sequence
  Description of Artificial Sequence: Synthetic peptide
  XENP020716 vhCDR3
QQDFSSPRT

SEQ ID NO: 23568 - protein, 5 aa, Artificial Sequence
  Description of Artificial Sequence: Synthetic peptide
  XENP020716 vlCDR1
NYWMN

SEQ ID NO: 23569 - protein, 19 aa, Artificial Sequence
  Description of Artificial Sequence: Synthetic peptide
  XENP020716 vlCDR2
EIRLYSNNYATHYAESVKG

SEQ ID NO: 23570 - protein, 11 aa, Artificial Sequence
  Description of Artificial Sequence: Synthetic peptide
  XENP020716 vlCDR3
YYGNYGGYFDV

SEQ ID NO: 23571 - protein, 215 aa, Artificial Sequence; identical to SEQ ID NO: 4504
  Description of Artificial Sequence: Synthetic polypeptide
  XENP020716 ipilimumab_H3_L0.22-1G6_L1.210_H1.288 M428L/N434S Light Chain

SEQ ID NO: 23572 - protein, 108 aa, Artificial Sequence; identical to SEQ ID NO: 1607
  Description of Artificial Sequence: Synthetic polypeptide
  VL of XENP020716

SEQ ID NO: 23573 - protein, 12 aa, Artificial Sequence
  Description of Artificial Sequence: Synthetic peptide
  XENP020716 vlCDR1
RASQSVSSSYLA

SEQ ID NO: 23574 - protein, 7 aa, Artificial Sequence
  Description of Artificial Sequence: Synthetic peptide
  XENP020716 vlCDR2
GAFSRAT

SEQ ID NO: 23575 - protein, 9 aa, Artificial Sequence
  Description of Artificial Sequence: Synthetic peptide
  XENP020716 vlCDR3
QQYGSSPWT

SEQ ID NO: 23576 - protein, 447 aa, Artificial Sequence; identical to SEQ ID NO: 23556
  Description of Artificial Sequence: Synthetic polypeptide
  XENP020717 ipilimumab_H3_L0.22-1G6_L1.194_H1.279 M428L/N434S Fab-Fc Heavy Chain

SEQ ID NO: 23577 - protein, 118 aa, Artificial Sequence; identical to SEQ ID NO: 139
  Description of Artificial Sequence: Synthetic polypeptide
  VH of XENP020717

SEQ ID NO: 23578 - protein, 5 aa, Artificial Sequence
  Description of Artificial Sequence: Synthetic peptide
  XENP020717 vhCDR1
SYTMH

SEQ ID NO: 23579 - protein, 17 aa, Artificial Sequence
  Description of Artificial Sequence: Synthetic peptide
  XENP020717 vhCDR2
FISYDGNNKYYADSVKG

SEQ ID NO: 23580 - protein, 9 aa, Artificial Sequence
  Description of Artificial Sequence: Synthetic peptide
  XENP020717 vhCDR3
TGWLGPFDY

SEQ ID NO: 23581 - protein, 480 aa, Artificial Sequence
  Description of Artificial Sequence: Synthetic polypeptide
  XENP020717 ipilimumab_H3_L0.22-1G6_L1.194_H1.279 M428L/N434S scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23582 - protein, 107 aa, Artificial Sequence; identical to SEQ ID NO: 10999
  Description of Artificial Sequence: Synthetic polypeptide
  VH of XENP020717

SEQ ID NO: 23583 - protein, 122 aa, Artificial Sequence; identical to SEQ ID NO: 10908
  Description of Artificial Sequence: Synthetic polypeptide
  VL of XENP020717

SEQ ID NO: 23584 - protein, 231 aa, Artificial Sequence; identical to SEQ ID NO: 21572
  Description of Artificial Sequence: Synthetic polypeptide
  Fc chain of XENP020717

SEQ ID NO: 23585 - protein, 11 aa, Artificial Sequence
  Description of Artificial Sequence: Synthetic peptide
  XENP020717 vhCDR1
RASQSVGNDVA

SEQ ID NO: 23586 - protein, 7 aa, Artificial Sequence
  Description of Artificial Sequence: Synthetic peptide
  XENP020717 vhCDR2
YASHRYT

SEQ ID NO: 23587 - protein, 9 aa, Artificial Sequence
  Description of Artificial Sequence: Synthetic peptide
  XENP020717 vhCDR3
QQDFSSPRT

SEQ ID NO: 23588 - protein, 5 aa, Artificial Sequence
  Description of Artificial Sequence: Synthetic peptide
  XENP020717 vlCDR1
NYWMN

SEQ ID NO: 23589 - protein, 19 aa, Artificial Sequence
  Description of Artificial Sequence: Synthetic peptide
  XENP020717 vlCDR2
EIRLYSNNYATHYAESVKG

SEQ ID NO: 23590 - protein, 11 aa, Artificial Sequence
  Description of Artificial Sequence: Synthetic peptide
  XENP020717 vlCDR3
YYGNYGGYFDV

SEQ ID NO: 23591 - protein, 215 aa, Artificial Sequence; identical to SEQ ID NO: 4504
  Description of Artificial Sequence: Synthetic polypeptide
  XENP020717 ipilimumab_H3_L0.22-1G6_L1.194_H1.279 M428L/N434S Light Chain

SEQ ID NO: 23592 - protein, 108 aa, Artificial Sequence; identical to SEQ ID NO: 1607
  Description of Artificial Sequence: Synthetic polypeptide
  VL of XENP020717

SEQ ID NO: 23593 - protein, 12 aa, Artificial Sequence
  Description of Artificial Sequence: Synthetic peptide
  XENP020717 vlCDR1
RASQSVSSSYLA

SEQ ID NO: 23594 - protein, 7 aa, Artificial Sequence
  Description of Artificial Sequence: Synthetic peptide
  XENP020717 vlCDR2
GAFSRAT

SEQ ID NO: 23595 - protein, 9 aa, Artificial Sequence
  Description of Artificial Sequence: Synthetic peptide
  XENP020717 vlCDR3
QQYGSSPWT

SEQ ID NO: 23596 - protein, 447 aa, Artificial Sequence; identical to SEQ ID NO: 23556
  Description of Artificial Sequence: Synthetic polypeptide
  XENP020718 ipilimumab_H3_L0.22-1G6_H1.279_L1.194 M428L/N434S Fab-Fc Heavy Chain

SEQ ID NO: 23597 - protein, 118 aa, Artificial Sequence; identical to SEQ ID NO: 139
  Description of Artificial Sequence: Synthetic polypeptide
  VH of XENP020718

SEQ ID NO: 23598 - protein, 5 aa, Artificial Sequence
  Description of Artificial Sequence: Synthetic peptide
  XENP020718 vhCDR1
SYTMH

SEQ ID NO: 23599 - protein, 17 aa, Artificial Sequence
  Description of Artificial Sequence: Synthetic peptide
  XENP020718 vhCDR2
FISYDGNNKYYADSVKG

SEQ ID NO: 23600 - protein, 9 aa, Artificial Sequence
  Description of Artificial Sequence: Synthetic peptide
  XENP020718 vhCDR3
TGWLGPFDY

SEQ ID NO: 23601 - protein, 480 aa, Artificial Sequence
  Description of Artificial Sequence: Synthetic polypeptide
  XENP020718 ipilimumab_H3_L0.22-1G6_H1.279_L1.194 M428L/N434S scFv-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23602 - protein, 122 aa, Artificial Sequence; identical to SEQ ID NO: 10908
  Description of Artificial Sequence: Synthetic polypeptide
  VH of XENP020718

SEQ ID NO: 23603 - protein, 107 aa, Artificial Sequence; identical to SEQ ID NO: 10999
  Description of Artificial Sequence: Synthetic polypeptide
  VL of XENP020718

SEQ ID NO: 23604 - protein, 231 aa, Artificial Sequence; identical to SEQ ID NO: 21572
  Description of Artificial Sequence: Synthetic polypeptide
  Fc chain of XENP020718

SEQ ID NO: 23605 - protein, 5 aa, Artificial Sequence
  Description of Artificial Sequence: Synthetic peptide
  XENP020718 vhCDR1
NYWMN

SEQ ID NO: 23606 - protein, 19 aa, Artificial Sequence
  Description of Artificial Sequence: Synthetic peptide
  XENP020718 vhCDR2
EIRLYSNNYATHYAESVKG

SEQ ID NO: 23607 - protein, 11 aa, Artificial Sequence
  Description of Artificial Sequence: Synthetic peptide
  XENP020718 vhCDR3
YYGNYGGYFDV

SEQ ID NO: 23608 - protein, 11 aa, Artificial Sequence
  Description of Artificial Sequence: Synthetic peptide
  XENP020718 vlCDR1
RASQSVGNDVA

SEQ ID NO: 23609 - protein, 7 aa, Artificial Sequence
  Description of Artificial Sequence: Synthetic peptide
  XENP020718 vlCDR2
YASHRYT

SEQ ID NO: 23610 - protein, 9 aa, Artificial Sequence
  Description of Artificial Sequence: Synthetic peptide
  XENP020718 vlCDR3
QQDFSSPRT

SEQ ID NO: 23611 - protein, 215 aa, Artificial Sequence; identical to SEQ ID NO: 4504
  Description of Artificial Sequence: Synthetic polypeptide
  XENP020718 ipilimumab_H3_L0.22-1G6_H1.279_L1.194 M428L/N434S Light Chain

SEQ ID NO: 23612 - protein, 108 aa, Artificial Sequence; identical to SEQ ID NO: 1607
  Description of Artificial Sequence: Synthetic polypeptide
  VL of XENP020718

SEQ ID NO: 23613 - protein, 12 aa, Artificial Sequence
  Description of Artificial Sequence: Synthetic peptide
  XENP020718 vlCDR1
RASQSVSSSYLA

SEQ ID NO: 23614 - protein, 7 aa, Artificial Sequence
  Description of Artificial Sequence: Synthetic peptide
  XENP020718 vlCDR2
GAFSRAT

SEQ ID NO: 23615 - protein, 9 aa, Artificial Sequence
  Description of Artificial Sequence: Synthetic peptide
  XENP020718 vlCDR3
QQYGSSPWT

SEQ ID NO: 23616 - protein, 447 aa, Artificial Sequence; identical to SEQ ID NO: 23556
  Description of Artificial Sequence: Synthetic polypeptide
  XENP020719 ipilimumab_H3_L0.22-1G6_H1.280_L1.224 M428L/N434S Fab-Fc Heavy Chain

SEQ ID NO: 23617 - protein, 118 aa, Artificial Sequence; identical to SEQ ID NO: 139
  Description of Artificial Sequence: Synthetic polypeptide
  VH of XENP020719

SEQ ID NO: 23618 - protein, 5 aa, Artificial Sequence
  Description of Artificial Sequence: Synthetic peptide
  XENP020719 vhCDR1
SYTMH

SEQ ID NO: 23619 - protein, 17 aa, Artificial Sequence
  Description of Artificial Sequence: Synthetic peptide
  XENP020719 vhCDR2
FISYDGNNKYYADSVKG

SEQ ID NO: 23620 - protein, 9 aa, Artificial Sequence
  Description of Artificial Sequence: Synthetic peptide
  XENP020719 vhCDR3
TGWLGPFDY

SEQ ID NO: 23621 - protein, 480 aa, Artificial Sequence
  Description of Artificial Sequence: Synthetic polypeptide
  XENP020719 ipilimumab_H3_L0.22-1G6_H1.280_L1.224 M428L/N434S scFv-Fc Heavy Chain
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23622 - protein, 122 aa, Artificial Sequence; identical to SEQ ID NO: 10917
  Description of Artificial Sequence: Synthetic polypeptide
  VH of XENP020719

SEQ ID NO: 23623 - protein, 107 aa, Artificial Sequence; identical to SEQ ID NO: 22811
  Description of Artificial Sequence: Synthetic polypeptide
  VL of XENP020719

SEQ ID NO: 23624 - protein, 231 aa, Artificial Sequence; identical to SEQ ID NO: 21572
  Description of Artificial Sequence: Synthetic polypeptide
  Fc chain of XENP020719

SEQ ID NO: 23625 - protein, 5 aa, Artificial Sequence
  Description of Artificial Sequence: Synthetic peptide
  XENP020719 vhCDR1
NYWMN

SEQ ID NO: 23626 - protein, 19 aa, Artificial Sequence
  Description of Artificial Sequence: Synthetic peptide
  XENP020719 vhCDR2
EIRLYSNNYATHYAESVKG

SEQ ID NO: 23627 - protein, 11 aa, Artificial Sequence
  Description of Artificial Sequence: Synthetic peptide
  XENP020719 vhCDR3
YYGNYGGYFDV

SEQ ID NO: 23628 - protein, 11 aa, Artificial Sequence
  Description of Artificial Sequence: Synthetic peptide
  XENP020719 vlCDR1
RASQSVGNDVA

SEQ ID NO: 23629 - protein, 7 aa, Artificial Sequence
  Description of Artificial Sequence: Synthetic peptide
  XENP020719 vlCDR2
YASHRYT

SEQ ID NO: 23630 - protein, 9 aa, Artificial Sequence
  Description of Artificial Sequence: Synthetic peptide
  XENP020719 vlCDR3
QQDWSSPRT

SEQ ID NO: 23631 - protein, 215 aa, Artificial Sequence; identical to SEQ ID NO: 4504
  Description of Artificial Sequence: Synthetic polypeptide
  XENP020719 ipilimumab_H3_L0.22-1G6_H1.280_L1.224 M428L/N434S Light Chain

SEQ ID NO: 23632 - protein, 108 aa, Artificial Sequence; identical to SEQ ID NO: 1607
  Description of Artificial Sequence: Synthetic polypeptide
  VL of XENP020719

SEQ ID NO: 23633 - protein, 12 aa, Artificial Sequence
  Description of Artificial Sequence: Synthetic peptide
  XENP020719 vlCDR1
RASQSVSSSYLA

SEQ ID NO: 23634 - protein, 7 aa, Artificial Sequence
  Description of Artificial Sequence: Synthetic peptide
  XENP020719 vlCDR2
GAFSRAT

SEQ ID NO: 23635 - protein, 9 aa, Artificial Sequence
  Description of Artificial Sequence: Synthetic peptide
  XENP020719 vlCDR3
QQYGSSPWT

SEQ ID NO: 23636 - protein, 451 aa, Artificial Sequence
  Description of Artificial Sequence: Synthetic polypeptide
  XENP020720 1G6_H1.278_L1.188-ipilimumab_H3.4_L0.12 M428L/N434S Fab-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 23637 - protein, 122 aa, Artificial Sequence; identical to SEQ ID NO: 10845
  Description of Artificial Sequence: Synthetic polypeptide
  VH of XENP020720

SEQ ID NO: 23638 - protein, 5 aa, Artificial Sequence
  Description of Artificial Sequence: Synthetic peptide
  XENP020720 vhCDR1
NYWMN

SEQ ID NO: 23639 - protein, 19 aa, Artificial Sequence
  Description of Artificial Sequence: Synthetic peptide
  XENP020720 vhCDR2
EIRLYSNNYATHYAESVKG

SEQ ID NO: 23640 - protein, 11 aa, Artificial Sequence
  Description of Artificial Sequence: Synthetic peptide
  XENP020720 vhCDR3
YYGNYGGYFDV

SEQ ID NO: 23641 - protein, 477 aa, Artificial Sequence; identical to SEQ ID NO: 21569
  Description of Artificial Sequence: Synthetic polypeptide
  XENP020720 1G6_H1.278_L1.188-ipilimumab_H3.4_L0.12 M428L/N434S scFv-Fc Heavy Chain

SEQ ID NO: 23642 - protein, 118 aa, Artificial Sequence; identical to SEQ ID NO: 2461
  Description of Artificial Sequence: Synthetic polypeptide
  VH of XENP020720

SEQ ID NO: 23643 - protein, 108 aa, Artificial Sequence; identical to SEQ ID NO: 1517
  Description of Artificial Sequence: Synthetic polypeptide
  VL of XENP020720

SEQ ID NO: 23644 - protein, 231 aa, Artificial Sequence; identical to SEQ ID NO: 21572
  Description of Artificial Sequence: Synthetic polypeptide
  Fc chain of XENP020720

SEQ ID NO: 23645 - protein, 5 aa, Artificial Sequence
  Description of Artificial Sequence: Synthetic peptide
  XENP020720 vhCDR1
SYTMH

SEQ ID NO: 23646 - protein, 17 aa, Artificial Sequence
  Description of Artificial Sequence: Synthetic peptide
  XENP020720 vhCDR2
FISYDGNHKYYADSVKG

SEQ ID NO: 23647 - protein, 9 aa, Artificial Sequence
  Description of Artificial Sequence: Synthetic peptide
  XENP020720 vhCDR3
TGHLGPFDL

SEQ ID NO: 23648 - protein, 12 aa, Artificial Sequence
  Description of Artificial Sequence: Synthetic peptide
  XENP020720 vlCDR1
RASQSVGSSYLA

SEQ ID NO: 23649 - protein, 7 aa, Artificial Sequence
  Description of Artificial Sequence: Synthetic peptide
  XENP020720 vlCDR2
GAFSRAT

SEQ ID NO: 23650 - protein, 9 aa, Artificial Sequence
  Description of Artificial Sequence: Synthetic peptide
  XENP020720 vlCDR3
QQYGSSPWT

SEQ ID NO: 23651 - protein, 214 aa, Artificial Sequence; identical to SEQ ID NO: 16660
  Description of Artificial Sequence: Synthetic polypeptide
  XENP020720 1G6_H1.278_L1.188-ipilimumab_H3.4_L0.12 M428L/N434S Light Chain

SEQ ID NO: 23652 - protein, 107 aa, Artificial Sequence; identical to SEQ ID NO: 10855
  Description of Artificial Sequence: Synthetic polypeptide
  VL of XENP020720

SEQ ID NO: 23653 - protein, 11 aa, Artificial Sequence
  Description of Artificial Sequence: Synthetic peptide
  XENP020720 vlCDR1
RASQSVGNDVA

SEQ ID NO: 23654 - protein, 7 aa, Artificial Sequence
  Description of Artificial Sequence: Synthetic peptide
  XENP020720 vlCDR2
YASHRYT

SEQ ID NO: 23655 - protein, 9 aa, Artificial Sequence
  Description of Artificial Sequence: Synthetic peptide
  XENP020720 vlCDR3
QQDFSSPRT

SEQ ID NO: 23656 - protein, 447 aa, Artificial Sequence; identical to SEQ ID NO: 23356
  Description of Artificial Sequence: Synthetic polypeptide
  XENP020726 ipilimumab_H3_L0.22-1G6_L1.224_H1.280 Fab-Fc Heavy Chain

SEQ ID NO: 23657 - protein, 118 aa, Artificial Sequence; identical to SEQ ID NO: 139
  Description of Artificial Sequence: Synthetic polypeptide
  VH of XENP020726

SEQ ID NO: 23658 - protein, 5 aa, Artificial Sequence
  Description of Artificial Sequence: Synthetic peptide
  XENP020726 vhCDR1
SYTMH

SEQ ID NO: 23659 - protein, 17 aa, Artificial Sequence
  Description of Artificial Sequence: Synthetic peptide
  XENP020726 vhCDR2
FISYDGNNKYYADSVKG

SEQ ID NO: 23660 - protein, 9 aa, Artificial Sequence
  Description of Artificial Sequence: Synthetic peptide
  XENP020726 vhCDR3
TGWLGPFDY

SEQ ID NO: 23661 - protein, 480 aa, Artificial Sequence
  Description of Artificial Sequence: Synthetic polypeptide
  XENP020726 ipilimumab_H3_L0.22-1G6_L1.224_H1.280 scFv-Fc Heavy Chain
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23662 - protein, 107 aa, Artificial Sequence; identical to SEQ ID NO: 22811
  Description of Artificial Sequence: Synthetic polypeptide
  VH of XENP020726

SEQ ID NO: 23663 - protein, 122 aa, Artificial Sequence; identical to SEQ ID NO: 10917
  Description of Artificial Sequence: Synthetic polypeptide
  VL of XENP020726

SEQ ID NO: 23664 - protein, 231 aa, Artificial Sequence; identical to SEQ ID NO: 21532
  Description of Artificial Sequence: Synthetic polypeptide
  Fc chain of XENP020726

SEQ ID NO: 23665 - protein, 11 aa, Artificial Sequence
  Description of Artificial Sequence: Synthetic peptide
  XENP020726 vhCDR1
RASQSVGNDVA

SEQ ID NO: 23666 - protein, 7 aa, Artificial Sequence
  Description of Artificial Sequence: Synthetic peptide
  XENP020726 vhCDR2
YASHRYT

SEQ ID NO: 23667 - protein, 9 aa, Artificial Sequence
  Description of Artificial Sequence: Synthetic peptide
  XENP020726 vhCDR3
QQDWSSPRT

SEQ ID NO: 23668 - protein, 5 aa, Artificial Sequence
  Description of Artificial Sequence: Synthetic peptide
  XENP020726 vlCDR1
NYWMN

SEQ ID NO: 23669 - protein, 19 aa, Artificial Sequence
  Description of Artificial Sequence: Synthetic peptide
  XENP020726 vlCDR2
EIRLYSNNYATHYAESVKG

SEQ ID NO: 23670 - protein, 11 aa, Artificial Sequence
  Description of Artificial Sequence: Synthetic peptide
  XENP020726 vlCDR3
YYGNYGGYFDV

SEQ ID NO: 23671 - protein, 215 aa, Artificial Sequence; identical to SEQ ID NO: 4504
  Description of Artificial Sequence: Synthetic polypeptide
  XENP020726 ipilimumab_H3_L0.22-1G6_L1.224_H1.280 Light Chain

SEQ ID NO: 23672 - protein, 108 aa, Artificial Sequence; identical to SEQ ID NO: 1607
  Description of Artificial Sequence: Synthetic polypeptide
  VL of XENP020726

SEQ ID NO: 23673 - protein, 12 aa, Artificial Sequence
  Description of Artificial Sequence: Synthetic peptide
  XENP020726 vlCDR1
RASQSVSSSYLA

SEQ ID NO: 23674 - protein, 7 aa, Artificial Sequence
  Description of Artificial Sequence: Synthetic peptide
  XENP020726 vlCDR2
GAFSRAT

SEQ ID NO: 23675 - protein, 9 aa, Artificial Sequence
  Description of Artificial Sequence: Synthetic peptide
  XENP020726 vlCDR3
QQYGSSPWT

SEQ ID NO: 23676 - protein, 447 aa, Artificial Sequence; identical to SEQ ID NO: 23356
  Description of Artificial Sequence: Synthetic polypeptide
  XENP020727 ipilimumab_H3_L0.22-1G6_L1.226_H1.292 Fab-Fc Heavy Chain

SEQ ID NO: 23677 - protein, 118 aa, Artificial Sequence; identical to SEQ ID NO: 139
  Description of Artificial Sequence: Synthetic polypeptide
  VH of XENP020727

SEQ ID NO: 23678 - protein, 5 aa, Artificial Sequence
  Description of Artificial Sequence: Synthetic peptide
  XENP020727 vhCDR1
SYTMH

SEQ ID NO: 23679 - protein, 17 aa, Artificial Sequence
  Description of Artificial Sequence: Synthetic peptide
  XENP020727 vhCDR2
FISYDGNNKYYADSVKG

SEQ ID NO: 23680 - protein, 9 aa, Artificial Sequence
  Description of Artificial Sequence: Synthetic peptide
  XENP020727 vhCDR3
TGWLGPFDY

SEQ ID NO: 23681 - protein, 480 aa, Artificial Sequence
  Description of Artificial Sequence: Synthetic polypeptide
  XENP020727 ipilimumab_H3_L0.22-1G6_L1.226_H1.292 scFv-Fc Heavy Chain
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGCGTKVEIKGKPGSGKPGSGKPGSGKPGSEVQLVESGGGLVKPGGSLRLTCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23682 - protein, 107 aa, Artificial Sequence
  Description of Artificial Sequence: Synthetic polypeptide
  VH of XENP020727
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGCGTKVEIK

SEQ ID NO: 23683 - protein, 122 aa, Artificial Sequence
  Description of Artificial Sequence: Synthetic polypeptide
  VL of XENP020727
EVQLVESGGGLVKPGGSLRLTCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSS

SEQ ID NO: 23684 - protein, 231 aa, Artificial Sequence; identical to SEQ ID NO: 21532
  Description of Artificial Sequence: Synthetic polypeptide
  Fc chain of XENP020727

SEQ ID NO: 23685 - protein, 11 aa, Artificial Sequence
  Description of Artificial Sequence: Synthetic peptide
  XENP020727 vhCDR1
RASQSVGNDVA

SEQ ID NO: 23686 - protein, 7 aa, Artificial Sequence
  Description of Artificial Sequence: Synthetic peptide
  XENP020727 vhCDR2
YASHRYT

SEQ ID NO: 23687 - protein, 9 aa, Artificial Sequence
  Description of Artificial Sequence: Synthetic peptide
  XENP020727 vhCDR3
QQDWSSPRT

SEQ ID NO: 23688 - protein, 5 aa, Artificial Sequence
  Description of Artificial Sequence: Synthetic peptide
  XENP020727 vlCDR1
NYWMN

SEQ ID NO: 23689 - protein, 19 aa, Artificial Sequence
  Description of Artificial Sequence: Synthetic peptide
  XENP020727 vlCDR2
EIRLYSNNYATHYAESVKG

SEQ ID NO: 23690 - protein, 11 aa, Artificial Sequence
  Description of Artificial Sequence: Synthetic peptide
  XENP020727 vlCDR3
YYGNYGGYFDV

SEQ ID NO: 23691 - protein, 215 aa, Artificial Sequence; identical to SEQ ID NO: 4504
  Description of Artificial Sequence: Synthetic polypeptide
  XENP020727 ipilimumab_H3_L0.22-1G6_L1.226_H1.292 Light Chain

SEQ ID NO: 23692 - protein, 108 aa, Artificial Sequence; identical to SEQ ID NO: 1607
  Description of Artificial Sequence: Synthetic polypeptide
  VL of XENP020727

SEQ ID NO: 23693 - protein, 12 aa, Artificial Sequence
  Description of Artificial Sequence: Synthetic peptide
  XENP020727 vlCDR1
RASQSVSSSYLA

SEQ ID NO: 23694 - protein, 7 aa, Artificial Sequence
  Description of Artificial Sequence: Synthetic peptide
  XENP020727 vlCDR2
GAFSRAT

SEQ ID NO: 23695 - protein, 9 aa, Artificial Sequence
  Description of Artificial Sequence: Synthetic peptide
  XENP020727 vlCDR3
QQYGSSPWT

SEQ ID NO: 23696 - protein, 447 aa, Artificial Sequence; identical to SEQ ID NO: 23556
  Description of Artificial Sequence: Synthetic polypeptide
  XENP020728 ipilimumab_H3_L0.22-1G6_L1.224_H1.280 M428L/N434S Fab-Fc Heavy Chain

SEQ ID NO: 23697 - protein, 118 aa, Artificial Sequence; identical to SEQ ID NO: 139
  Description of Artificial Sequence: Synthetic polypeptide
  VH of XENP020728

SEQ ID NO: 23698 - protein, 5 aa, Artificial Sequence
  Description of Artificial Sequence: Synthetic peptide
  XENP020728 vhCDR1
SYTMH

SEQ ID NO: 23699 - protein, 17 aa, Artificial Sequence
  Description of Artificial Sequence: Synthetic peptide
  XENP020728 vhCDR2
FISYDGNNKYYADSVKG

SEQ ID NO: 23700 - protein, 9 aa, Artificial Sequence
  Description of Artificial Sequence: Synthetic peptide
  XENP020728 vhCDR3
TGWLGPFDY

SEQ ID NO: 23701 - protein, 480 aa, Artificial Sequence
  Description of Artificial Sequence: Synthetic polypeptide
  XENP020728 ipilimumab_H3_L0.22-1G6_L1.224_H1.280 M428L/N434S scFv-Fc Heavy Chain
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23702 - protein, 107 aa, Artificial Sequence; identical to SEQ ID NO: 22811
  Description of Artificial Sequence: Synthetic polypeptide
  VH of XENP020728

SEQ ID NO: 23703 - protein, 122 aa, Artificial Sequence; identical to SEQ ID NO: 10917
  Description of Artificial Sequence: Synthetic polypeptide
  VL of XENP020728

SEQ ID NO: 23704 - protein, 231 aa, Artificial Sequence; identical to SEQ ID NO: 21572
  Description of Artificial Sequence: Synthetic polypeptide
  Fc chain of XENP020728

SEQ ID NO: 23705 - protein, 11 aa, Artificial Sequence
  Description of Artificial Sequence: Synthetic peptide
  XENP020728 vhCDR1
RASQSVGNDVA

SEQ ID NO: 23706 - protein, 7 aa, Artificial Sequence
  Description of Artificial Sequence: Synthetic peptide
  XENP020728 vhCDR2
YASHRYT

SEQ ID NO: 23707 - protein, 9 aa, Artificial Sequence
  Description of Artificial Sequence: Synthetic peptide
  XENP020728 vhCDR3
QQDWSSPRT

SEQ ID NO: 23708 - protein, 5 aa, Artificial Sequence
  Description of Artificial Sequence: Synthetic peptide
  XENP020728 vlCDR1
NYWMN

SEQ ID NO: 23709 - protein, 19 aa, Artificial Sequence
  Description of Artificial Sequence: Synthetic peptide
  XENP020728 vlCDR2
EIRLYSNNYATHYAESVKG

SEQ ID NO: 23710 - protein, 11 aa, Artificial Sequence
  Description of Artificial Sequence: Synthetic peptide
  XENP020728 vlCDR3
YYGNYGGYFDV

SEQ ID NO: 23711 - protein, 215 aa, Artificial Sequence; identical to SEQ ID NO: 4504
  Description of Artificial Sequence: Synthetic polypeptide
  XENP020728 ipilimumab_H3_L0.22-1G6_L1.224_H1.280 M428L/N434S Light Chain

SEQ ID NO: 23712 - protein, 108 aa, Artificial Sequence; identical to SEQ ID NO: 1607
  Description of Artificial Sequence: Synthetic polypeptide
  VL of XENP020728

SEQ ID NO: 23713 - protein, 12 aa, Artificial Sequence
  Description of Artificial Sequence: Synthetic peptide
  XENP020728 vlCDR1
RASQSVSSSYLA

SEQ ID NO: 23714 - protein, 7 aa, Artificial Sequence
  Description of Artificial Sequence: Synthetic peptide
  XENP020728 vlCDR2
GAFSRAT

SEQ ID NO: 23715 - protein, 9 aa, Artificial Sequence
  Description of Artificial Sequence: Synthetic peptide
  XENP020728 vlCDR3
QQYGSSPWT

SEQ ID NO: 23716 - protein, 447 aa, Artificial Sequence; identical to SEQ ID NO: 23556
  Description of Artificial Sequence: Synthetic polypeptide
  XENP020729 ipilimumab_H3_L0.22-1G6_L1.226_H1.292 M428L/N434S Fab-Fc Heavy Chain

SEQ ID NO: 23717 - protein, 118 aa, Artificial Sequence; identical to SEQ ID NO: 139
  Description of Artificial Sequence: Synthetic polypeptide
  VH of XENP020729

SEQ ID NO: 23718 - protein, 5 aa, Artificial Sequence
  Description of Artificial Sequence: Synthetic peptide
  XENP020729 vhCDR1
SYTMH

SEQ ID NO: 23719 - protein, 17 aa, Artificial Sequence
  Description of Artificial Sequence: Synthetic peptide
  XENP020729 vhCDR2
FISYDGNNKYYADSVKG

SEQ ID NO: 23720 - protein, 9 aa, Artificial Sequence
  Description of Artificial Sequence: Synthetic peptide
  XENP020729 vhCDR3
TGWLGPFDY

SEQ ID NO: 23721 - protein, 480 aa, Artificial Sequence
  Description of Artificial Sequence: Synthetic polypeptide
  XENP020729 ipilimumab_H3_L0.22-1G6_L1.226_H1.292 M428L/N434S scFv-Fc Heavy Chain
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGCGTKVEIKGKPGSGKPGSGKPGSGKPGSEVQLVESGGGLVKPGGSLRLTCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23722 - protein, 107 aa, Artificial Sequence; identical to SEQ ID NO: 23682
  Description of Artificial Sequence: Synthetic polypeptide
  VH of XENP020729

SEQ ID NO: 23723 - protein, 122 aa, Artificial Sequence; identical to SEQ ID NO: 23683
  Description of Artificial Sequence: Synthetic polypeptide
  VL of XENP020729

SEQ ID NO: 23724 - protein, 231 aa, Artificial Sequence; identical to SEQ ID NO: 21572
  Description of Artificial Sequence: Synthetic polypeptide
  Fc chain of XENP020729

SEQ ID NO: 23725 - protein, 11 aa, Artificial Sequence
  Description of Artificial Sequence: Synthetic peptide
  XENP020729 vhCDR1
RASQSVGNDVA

SEQ ID NO: 23726 - protein, 7 aa, Artificial Sequence
  Description of Artificial Sequence: Synthetic peptide
  XENP020729 vhCDR2
YASHRYT

SEQ ID NO: 23727 - protein, 9 aa, Artificial Sequence
  Description of Artificial Sequence: Synthetic peptide
  XENP020729 vhCDR3
QQDWSSPRT

SEQ ID NO: 23728 - protein, 5 aa, Artificial Sequence
  Description of Artificial Sequence: Synthetic peptide
  XENP020729 vlCDR1
NYWMN

SEQ ID NO: 23729 - protein, 19 aa, Artificial Sequence
  Description of Artificial Sequence: Synthetic peptide
  XENP020729 vlCDR2
EIRLYSNNYATHYAESVKG

SEQ ID NO: 23730 - protein, 11 aa, Artificial Sequence
  Description of Artificial Sequence: Synthetic peptide
  XENP020729 vlCDR3
YYGNYGGYFDV

SEQ ID NO: 23731 - protein, 215 aa, Artificial Sequence; identical to SEQ ID NO: 4504
  Description of Artificial Sequence: Synthetic polypeptide
  XENP020729 ipilimumab_H3_L0.22-1G6_L1.226_H1.292 M428L/N434S Light Chain

SEQ ID NO: 23732 - protein, 108 aa, Artificial Sequence; identical to SEQ ID NO: 1607
  Description of Artificial Sequence: Synthetic polypeptide
  VL of XENP020729

SEQ ID NO: 23733 - protein, 12 aa, Artificial Sequence
  Description of Artificial Sequence: Synthetic peptide
  XENP020729 vlCDR1
RASQSVSSSYLA

SEQ ID NO: 23734 - protein, 7 aa, Artificial Sequence
  Description of Artificial Sequence: Synthetic peptide
  XENP020729 vlCDR2
GAFSRAT

SEQ ID NO: 23735 - protein, 9 aa, Artificial Sequence
  Description of Artificial Sequence: Synthetic peptide
  XENP020729 vlCDR3
QQYGSSPWT

SEQ ID NO: 23736 - protein, 449 aa, Artificial Sequence; identical to SEQ ID NO: 21524
  Description of Artificial Sequence: Synthetic polypeptide
  XENP016429 25F7_H0L0-nivolumab_H0.1_L0 Fab-Fc Heavy Chain

SEQ ID NO: 23737 - protein, 120 aa, Artificial Sequence; identical to SEQ ID NO: 17136
  Description of Artificial Sequence: Synthetic polypeptide
  VH of XENP016429

SEQ ID NO: 23738 - protein, 5 aa, Artificial Sequence
  Description of Artificial Sequence: Synthetic peptide
  XENP016429 vhCDR1
DYYWN

SEQ ID NO: 23739 - protein, 16 aa, Artificial Sequence
  Description of Artificial Sequence: Synthetic peptide
  XENP016429 vhCDR2
EINHNGNTNSNPSLKS

SEQ ID NO: 23740 - protein, 12 aa, Artificial Sequence
  Description of Artificial Sequence: Synthetic peptide
  XENP016429 vhCDR3
GYSDYEYNWFDP

SEQ ID NO: 23741 - protein, 471 aa, Artificial Sequence; identical to SEQ ID NO: 22749
  Description of Artificial Sequence: Synthetic polypeptide
  XENP016429 25F7_H0L0-nivolumab_H0.1_L0 scFv-Fc Heavy Chain

SEQ ID NO: 23742 - protein, 113 aa, Artificial Sequence; identical to SEQ ID NO: 6210
  Description of Artificial Sequence: Synthetic polypeptide
  VH of XENP016429

SEQ ID NO: 23743 - protein, 107 aa, Artificial Sequence [sequence omitted]

SEQ ID NO: 23744 - protein, 231 aa, Artificial Sequence; identical to SEQ ID NO: 21532
  Description of Artificial Sequence: Synthetic polypeptide
  Fc chain of XENP016429

SEQ ID NO: 23745 - protein, 5 aa, Artificial Sequence
  Description of Artificial Sequence: Synthetic peptide
  XENP016429 vhCDR1
NSGMH

SEQ ID NO: 23746 - protein, 17 aa, Artificial Sequence
  Description of Artificial Sequence: Synthetic peptide
  XENP016429 vhCDR2
VIWYDGSKRYYADSVKG

SEQ ID NO: 23747 - protein, 4 aa, Artificial Sequence
  Description of Artificial Sequence: Synthetic peptide
  XENP016429 vhCDR3
NDDY

SEQ ID NO: 23748 - protein, 11 aa, Artificial Sequence
  Description of Artificial Sequence: Synthetic peptide
  XENP016429 vlCDR1
RASQSVSSYLA

SEQ ID NO: 23749 - protein, 7 aa, Artificial Sequence
  Description of Artificial Sequence: Synthetic peptide
  XENP016429 vlCDR2
DASNRAT

SEQ ID NO: 23750 - protein, 9 aa, Artificial Sequence
  Description of Artificial Sequence: Synthetic peptide
  XENP016429 vlCDR3
QQSSNWPRT

SEQ ID NO: 23751 - protein, 214 aa, Artificial Sequence; identical to SEQ ID NO: 17140
  Description of Artificial Sequence: Synthetic polypeptide
  XENP016429 25F7_H0L0-nivolumab_H0.1_L0 Light Chain

SEQ ID NO: 23752 - protein, 11 aa, Artificial Sequence
  Description of Artificial Sequence: Synthetic peptide
  XENP016429 vlCDR1
RASQSISSYLA

SEQ ID NO: 23753 - protein, 7 aa, Artificial Sequence
  Description of Artificial Sequence: Synthetic peptide
  XENP016429 vlCDR2
DASNRAT

SEQ ID NO: 23754 - protein, 9 aa, Artificial Sequence
  Description of Artificial Sequence: Synthetic peptide
  XENP016429 vlCDR3
QQRSNWPLT

SEQ ID NO: 23755 - protein, 449 aa, Artificial Sequence; identical to SEQ ID NO: 21524
  Description of Artificial Sequence: Synthetic polypeptide
  XENP018069 25F7_H0L0-1G6_H1L1 Fab-Fc Heavy Chain

SEQ ID NO: 23756 - protein, 120 aa, Artificial Sequence; identical to SEQ ID NO: 17136
  Description of Artificial Sequence: Synthetic polypeptide
  VH of XENP018069

SEQ ID NO: 23757 - protein, 5 aa, Artificial Sequence
  Description of Artificial Sequence: Synthetic peptide
  XENP018069 vhCDR1
DYYWN

SEQ ID NO: 23758 - protein, 16 aa, Artificial Sequence
  Description of Artificial Sequence: Synthetic peptide
  XENP018069 vhCDR2
EINHNGNTNSNPSLKS

SEQ ID NO: 23759 - protein, 12 aa, Artificial Sequence
  Description of Artificial Sequence: Synthetic peptide
  XENP018069 vhCDR3
GYSDYEYNWFDP

SEQ ID NO: 23760 - protein, 480 aa, Artificial Sequence; identical to SEQ ID NO: 23341
  Description of Artificial Sequence: Synthetic polypeptide
  XENP018069 25F7_H0L0-1G6_H1L1 scFv-Fc Heavy Chain

SEQ ID NO: 23761 - protein, 122 aa, Artificial Sequence; identical to SEQ ID NO: 6246
  Description of Artificial Sequence: Synthetic polypeptide
  VH of XENP018069

SEQ ID NO: 23762 - protein, 107 aa, Artificial Sequence; identical to SEQ ID NO: 6247
  Description of Artificial Sequence: Synthetic polypeptide
  VL of XENP018069

SEQ ID NO: 23763 - protein, 231 aa, Artificial Sequence; identical to SEQ ID NO: 21532
  Description of Artificial Sequence: Synthetic polypeptide
  Fc chain of XENP018069

SEQ ID NO: 23764 - protein, 5 aa, Artificial Sequence
  Description of Artificial Sequence: Synthetic peptide
  XENP018069 vhCDR1
NYWMN

SEQ ID NO: 23765 - protein, 19 aa, Artificial Sequence
  Description of Artificial Sequence: Synthetic peptide
  XENP018069 vhCDR2
EIRLKSNNYATHYAEPVKG

SEQ ID NO: 23766 - protein, 11 aa, Artificial Sequence
  Description of Artificial Sequence: Synthetic peptide
  XENP018069 vhCDR3
YYGNYGGYFDV

SEQ ID NO: 23767 - protein, 11 aa, Artificial Sequence
  Description of Artificial Sequence: Synthetic peptide
  XENP018069 vlCDR1
RASQSVSNDVA

SEQ ID NO: 23768 - protein, 7 aa, Artificial Sequence
  Description of Artificial Sequence: Synthetic peptide
  XENP018069 vlCDR2
YASHRYT

SEQ ID NO: 23769 - protein, 9 aa, Artificial Sequence
  Description of Artificial Sequence: Synthetic peptide
  XENP018069 vlCDR3
QQDYSSPRT

SEQ ID NO: 23770 - protein, 214 aa, Artificial Sequence; identical to SEQ ID NO: 17140
  Description of Artificial Sequence: Synthetic polypeptide
  XENP018069 25F7_H0L0-1G6_H1L1 Light Chain

SEQ ID NO: 23771 - skipped

SEQ ID NO: 23772 - protein, 11 aa, Artificial Sequence
  Description of Artificial Sequence: Synthetic peptide
  XENP018069 vlCDR1
RASQSISSYLA

SEQ ID NO: 23773 - protein, 7 aa, Artificial Sequence
  Description of Artificial Sequence: Synthetic peptide
  XENP018069 vlCDR2
DASNRAT

SEQ ID NO: 23774 - protein, 9 aa, Artificial Sequence
  Description of Artificial Sequence: Synthetic peptide
  XENP018069 vlCDR3
QQRSNWPLT

SEQ ID NO: 23775 - protein, 449 aa, Artificial Sequence; identical to SEQ ID NO: 21524
  Description of Artificial Sequence: Synthetic polypeptide
  XENP019410 25F7_H0L0-1G6_H1.278_L1.189 Fab-Fc Heavy Chain

SEQ ID NO: 23776 - protein, 120 aa, Artificial Sequence; identical to SEQ ID NO: 17136
  Description of Artificial Sequence: Synthetic polypeptide
  VH of XENP019410

SEQ ID NO: 23777 - protein, 5 aa, Artificial Sequence
  Description of Artificial Sequence: Synthetic peptide
  XENP019410 vhCDR1
DYYWN

SEQ ID NO: 23778 - protein, 16 aa, Artificial Sequence
  Description of Artificial Sequence: Synthetic peptide
  XENP019410 vhCDR2
EINHNGNTNSNPSLKS

SEQ ID NO: 23779 - protein, 12 aa, Artificial Sequence
  Description of Artificial Sequence: Synthetic peptide
  XENP019410 vhCDR3
GYSDYEYNWFDP

SEQ ID NO: 23780 - protein, 480 aa, Artificial Sequence
  Description of Artificial Sequence: Synthetic polypeptide
  XENP019410 25F7_H0L0-1G6_H1.278_L1.189 scFv-Fc Heavy Chain
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSGKPGSGKPGSGKPGSGKPGSEIVLTQSPATLSVSPGERVTLTCRASQSVGNDVAWYQQKPGQAPRLLINYASHRYTGVPDRFTGSGYGTEFTLTISSVQSEDFAVYYCQQDFSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23781 - protein, 122 aa, Artificial Sequence; identical to SEQ ID NO: 10845
  Description of Artificial Sequence: Synthetic polypeptide
  VH of XENP019410

SEQ ID NO: 23782 - protein, 107 aa, Artificial Sequence; identical to SEQ ID NO: 10864
  Description of Artificial Sequence: Synthetic polypeptide
  VL of XENP019410

SEQ ID NO: 23783 - protein, 231 aa, Artificial Sequence; identical to SEQ ID NO: 21532
  Description of Artificial Sequence: Synthetic polypeptide
  Fc chain of XENP019410

SEQ ID NO: 23784 - protein, 5 aa, Artificial Sequence
  Description of Artificial Sequence: Synthetic peptide
  XENP019410 vhCDR1
NYWMN

SEQ ID NO: 23785 - protein, 19 aa, Artificial Sequence
  Description of Artificial Sequence: Synthetic peptide
  XENP019410 vhCDR2
EIRLYSNNYATHYAESVKG

SEQ ID NO: 23786 - protein, 11 aa, Artificial Sequence
  Description of Artificial Sequence: Synthetic peptide
  XENP019410 vhCDR3
YYGNYGGYFDV

SEQ ID NO: 23787 - protein, 11 aa, Artificial Sequence
  Description of Artificial Sequence: Synthetic peptide
  XENP019410 vlCDR1
RASQSVGNDVA

SEQ ID NO: 23788 - protein, 7 aa, Artificial Sequence
  Description of Artificial Sequence: Synthetic peptide
  XENP019410 vlCDR2
YASHRYT

SEQ ID NO: 23789 - protein, 9 aa, Artificial Sequence
  Description of Artificial Sequence: Synthetic peptide
  XENP019410 vlCDR3
QQDFSSPRT

SEQ ID NO: 23790 - protein, 214 aa, Artificial Sequence; identical to SEQ ID NO: 17140
  Description of Artificial Sequence: Synthetic polypeptide
  XENP019410 25F7_H0L0-1G6_H1.278_L1.189 Light Chain

SEQ ID NO: 23791 - protein, 214 aa, Artificial Sequence; identical to SEQ ID NO: 17140
  Description of Artificial Sequence: Synthetic polypeptide
  VL of XENP019410

SEQ ID NO: 23792 - protein, 11 aa, Artificial Sequence
  Description of Artificial Sequence: Synthetic peptide
  XENP019410 vlCDR1
RASQSISSYLA

SEQ ID NO: 23793 - protein, 7 aa, Artificial Sequence
  Description of Artificial Sequence: Synthetic peptide
  XENP019410 vlCDR2
DASNRAT

SEQ ID NO: 23794 - protein, 9 aa, Artificial Sequence
  Description of Artificial Sequence: Synthetic peptide
  XENP019410 vlCDR3
QQRSNWPLT

SEQ ID NO: 23795 - protein, 449 aa, Artificial Sequence; identical to SEQ ID NO: 21524
  Description of Artificial Sequence: Synthetic polypeptide
  XENP019412 25F7_H0L0-1G6_L1.189_H1.278 Fab-Fc Heavy Chain

SEQ ID NO: 23796 - protein, 120 aa, Artificial Sequence; identical to SEQ ID NO: 17136
  Description of Artificial Sequence: Synthetic polypeptide
  VH of XENP019412

SEQ ID NO: 23797 - protein, 5 aa, Artificial Sequence
  Description of Artificial Sequence: Synthetic peptide
  XENP019412 vhCDR1
DYYWN

SEQ ID NO: 23798 - protein, 16 aa, Artificial Sequence
  Description of Artificial Sequence: Synthetic peptide
  XENP019412 vhCDR2
EINHNGNTNSNPSLKS

SEQ ID NO: 23799 - protein, 12 aa, Artificial Sequence
  Description of Artificial Sequence: Synthetic peptide
  XENP019412 vhCDR3
GYSDYEYNWFDP

SEQ ID NO: 23800 - protein, 480 aa, Artificial Sequence; identical to SEQ ID NO: 23780
  Description of Artificial Sequence: Synthetic polypeptide
  XENP019412 25F7_H0L0-1G6_L1.189_H1.278 scFv-Fc Heavy Chain

SEQ ID NO: 23801 - protein, 122 aa, Artificial Sequence; identical to SEQ ID NO: 10845
  Description of Artificial Sequence: Synthetic polypeptide
  VH of XENP019412

SEQ ID NO: 23802 - protein, 107 aa, Artificial Sequence; identical to SEQ ID NO: 10864
  Description of Artificial Sequence: Synthetic polypeptide
  VL of XENP019412

SEQ ID NO: 23803 - protein, 231 aa, Artificial Sequence; identical to SEQ ID NO: 21532
  Description of Artificial Sequence: Synthetic polypeptide
  Fc chain of XENP019412

SEQ ID NO: 23804 - protein, 5 aa, Artificial Sequence
  Description of Artificial Sequence: Synthetic peptide
  XENP019412 vhCDR1
NYWMN

SEQ ID NO: 23805 - protein, 19 aa, Artificial Sequence
  Description of Artificial Sequence: Synthetic peptide
  XENP019412 vhCDR2
EIRLYSNNYATHYAESVKG

SEQ ID NO: 23806 - protein, 11 aa, Artificial Sequence
  Description of Artificial Sequence: Synthetic peptide
  XENP019412 vhCDR3
YYGNYGGYFDV

SEQ ID NO: 23807 - protein, 11 aa, Artificial Sequence
  Description of Artificial Sequence: Synthetic peptide
  XENP019412 vlCDR1
RASQSVGNDVA

SEQ ID NO: 23808 - protein, 7 aa, Artificial Sequence
  Description of Artificial Sequence: Synthetic peptide
  XENP019412 vlCDR2
YASHRYT

SEQ ID NO: 23809 - protein, 9 aa, Artificial Sequence
  Description of Artificial Sequence: Synthetic peptide
  XENP019412 vlCDR3
QQDFSSPRT

SEQ ID NO: 23810 - protein, 214 aa, Artificial Sequence; identical to SEQ ID NO: 17140
  Description of Artificial Sequence: Synthetic polypeptide
  XENP019412 25F7_H0L0-1G6_L1.189_H1.278 Light Chain

SEQ ID NO: 23811 - protein, 214 aa, Artificial Sequence; identical to SEQ ID NO: 17140
  Description of Artificial Sequence: Synthetic polypeptide
  VL of XENP019412

SEQ ID NO: 23812 - protein, 11 aa, Artificial Sequence
  Description of Artificial Sequence: Synthetic peptide
  XENP019412 vlCDR1
RASQSISSYLA

SEQ ID NO: 23813 - protein, 7 aa, Artificial Sequence
  Description of Artificial Sequence: Synthetic peptide
  XENP019412 vlCDR2
DASNRAT

SEQ ID NO: 23814 - protein, 9 aa, Artificial Sequence
  Description of Artificial Sequence: Synthetic peptide
  XENP019412 vlCDR3
QQRSNWPLT

SEQ ID NO: 23815 - protein, 449 aa, Artificial Sequence; identical to SEQ ID NO: 21524
  Description of Artificial Sequence: Synthetic polypeptide
  XENP019670 25F7_H0L0-1G6_H1.284_L1.194 Fab-Fc Heavy Chain

SEQ ID NO: 23816 - protein, 120 aa, Artificial Sequence; identical to SEQ ID NO: 17136
  Description of Artificial Sequence: Synthetic polypeptide
  VH of XENP019670

SEQ ID NO: 23817 - protein, 5 aa, Artificial Sequence
  Description of Artificial Sequence: Synthetic peptide
  XENP019670 vhCDR1
DYYWN

SEQ ID NO: 23818 - protein, 16 aa, Artificial Sequence
  Description of Artificial Sequence: Synthetic peptide
  XENP019670 vhCDR2
EINHNGNTNSNPSLKS

SEQ ID NO: 23819 - protein, 12 aa, Artificial Sequence
  Description of Artificial Sequence: Synthetic peptide
  XENP019670 vhCDR3
GYSDYEYNWFDP

SEQ ID NO: 23820 - protein, 480 aa, Artificial Sequence
  Description of Artificial Sequence: Synthetic polypeptide
  XENP019670 25F7_H0L0-1G6_H1.284_L1.194 scFv-Fc Heavy Chain
EVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23821 - protein, 122 aa, Artificial Sequence; identical to SEQ ID NO: 10953
  Description of Artificial Sequence: Synthetic polypeptide
  VH of XENP019670

SEQ ID NO: 23822 - protein, 107 aa, Artificial Sequence; identical to SEQ ID NO: 10999
  Description of Artificial Sequence: Synthetic polypeptide
  VL of XENP019670

SEQ ID NO: 23823 - protein, 231 aa, Artificial Sequence; identical to SEQ ID NO: 21532
  Description of Artificial Sequence: Synthetic polypeptide
  Fc chain of XENP019670

SEQ ID NO: 23824 - protein, 5 aa, Artificial Sequence
  Description of Artificial Sequence: Synthetic peptide
  XENP019670 vhCDR1
NYWMN

SEQ ID NO: 23825 - protein, 19 aa, Artificial Sequence
  Description of Artificial Sequence: Synthetic peptide
  XENP019670 vhCDR2
EIRLYSNNYATHYAESVKG

SEQ ID NO: 23826 - protein, 11 aa, Artificial Sequence
  Description of Artificial Sequence: Synthetic peptide
  XENP019670 vhCDR3
YYGNYGGYFDV

SEQ ID NO: 23827 - protein, 11 aa, Artificial Sequence
  Description of Artificial Sequence: Synthetic peptide
  XENP019670 vlCDR1
RASQSVGNDVA

SEQ ID NO: 23828 - protein, 7 aa, Artificial Sequence
  Description of Artificial Sequence: Synthetic peptide
  XENP019670 vlCDR2
YASHRYT

SEQ ID NO: 23829 - protein, 9 aa, Artificial Sequence
  Description of Artificial Sequence: Synthetic peptide
  XENP019670 vlCDR3
QQDFSSPRT

SEQ ID NO: 23830 - protein, 214 aa, Artificial Sequence; identical to SEQ ID NO: 17140
  Description of Artificial Sequence: Synthetic polypeptide
  XENP019670 25F7_H0L0-1G6_H1.284_L1.194 Light Chain

SEQ ID NO: 23831 - protein, 214 aa, Artificial Sequence; identical to SEQ ID NO: 17140
  Description of Artificial Sequence: Synthetic polypeptide
  VL of XENP019670

SEQ ID NO: 23832 - protein, 11 aa, Artificial Sequence
  Description of Artificial Sequence: Synthetic peptide
  XENP019670 vlCDR1
RASQSISSYLA

SEQ ID NO: 23833 - protein, 7 aa, Artificial Sequence
  Description of Artificial Sequence: Synthetic peptide
  XENP019670 vlCDR2
DASNRAT

SEQ ID NO: 23834 - protein, 9 aa, Artificial Sequence
  Description of Artificial Sequence: Synthetic peptide
  XENP019670 vlCDR3
QQRSNWPLT

SEQ ID NO: 23835 - protein, 449 aa, Artificial Sequence; identical to SEQ ID NO: 21524
  Description of Artificial Sequence: Synthetic polypeptide
  XENP019671 25F7_H0L0-1G6_L1.194_H1.284 Fab-Fc Heavy Chain

SEQ ID NO: 23836 - protein, 120 aa, Artificial Sequence; identical to SEQ ID NO: 17136
  Description of Artificial Sequence: Synthetic polypeptide
  VH of XENP019671

SEQ ID NO: 23837 - protein, 5 aa, Artificial Sequence
  Description of Artificial Sequence: Synthetic peptide
  XENP019671 vhCDR1
DYYWN

SEQ ID NO: 23838 - protein, 16 aa, Artificial Sequence
  Description of Artificial Sequence: Synthetic peptide
  XENP019671 vhCDR2
EINHNGNTNSNPSLKS

SEQ ID NO: 23839 - protein, 12 aa, Artificial Sequence
  Description of Artificial Sequence: Synthetic peptide
  XENP019671 vhCDR3
GYSDYEYNWFDP

SEQ ID NO: 23840 - protein, 480 aa, Artificial Sequence
  Description of Artificial Sequence: Synthetic polypeptide
  XENP019671 25F7_H0L0-1G6_L1.194_H1.284 scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVCEIRLYSNNYATHYAESVKGRFTCSRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23841 - protein, 107 aa, Artificial Sequence; identical to SEQ ID NO: 10999
  Description of Artificial Sequence: Synthetic polypeptide
  VH of XENP019671

SEQ ID NO: 23842 - protein, 122 aa, Artificial Sequence; identical to SEQ ID NO: 10953
  Description of Artificial Sequence: Synthetic polypeptide
  VL of XENP019671

SEQ ID NO: 23843 - protein, 231 aa, Artificial Sequence; identical to SEQ ID NO: 21532
  Description of Artificial Sequence: Synthetic polypeptide
  Fc chain of XENP019671

SEQ ID NO: 23844 - protein, 11 aa, Artificial Sequence
  Description of Artificial Sequence: Synthetic peptide
  XENP019671 vhCDR1
RASQSVGNDVA

SEQ ID NO: 23845 - protein, 7 aa, Artificial Sequence
  Description of Artificial Sequence: Synthetic peptide
  XENP019671 vhCDR2
YASHRYT

SEQ ID NO: 23846 - protein, 9 aa, Artificial Sequence
  Description of Artificial Sequence: Synthetic peptide
  XENP019671 vhCDR3
QQDFSSPRT

SEQ ID NO: 23847 - protein, 5 aa, Artificial Sequence
  Description of Artificial Sequence: Synthetic peptide
  XENP019671 vlCDR1
NYWMN

SEQ ID NO: 23848 - protein, 19 aa, Artificial Sequence
  Description of Artificial Sequence: Synthetic peptide
  XENP019671 vlCDR2
EIRLYSNNYATHYAESVKG

SEQ ID NO: 23849 - protein, 11 aa, Artificial Sequence
  Description of Artificial Sequence: Synthetic peptide
  XENP019671 vlCDR3
YYGNYGGYFDV

SEQ ID NO: 23850 - protein, 214 aa, Artificial Sequence; identical to SEQ ID NO: 17140
  Description of Artificial Sequence: Synthetic polypeptide
  XENP019671 25F7_H0L0-1G6_L1.194_H1.284 Light Chain

SEQ ID NO: 23851 - protein, 214 aa, Artificial Sequence; identical to SEQ ID NO: 17140
  Description of Artificial Sequence: Synthetic polypeptide
  VL of XENP019671

SEQ ID NO: 23852 - protein, 11 aa, Artificial Sequence
  Description of Artificial Sequence: Synthetic peptide
  XENP019671 vlCDR1
RASQSISSYLA

SEQ ID NO: 23853 - protein, 7 aa, Artificial Sequence
  Description of Artificial Sequence: Synthetic peptide
  XENP019671 vlCDR2
DASNRAT

SEQ ID NO: 23854 - protein, 9 aa, Artificial Sequence
  Description of Artificial Sequence: Synthetic peptide
  XENP019671 vlCDR3
QQRSNWPLT

SEQ ID NO: 23855 - protein, 449 aa, Artificial Sequence; identical to SEQ ID NO: 21524
  Description of Artificial Sequence: Synthetic polypeptide
  XENP019672 25F7_H0L0-1G6_H1.288_L1.210 Fab-Fc Heavy Chain

SEQ ID NO: 23856 - protein, 120 aa, Artificial Sequence; identical to SEQ ID NO: 17136
  Description of Artificial Sequence: Synthetic polypeptide
  VH of XENP019672

SEQ ID NO: 23857 - protein, 5 aa, Artificial Sequence
  Description of Artificial Sequence: Synthetic peptide
  XENP019672 vhCDR1
DYYWN

SEQ ID NO: 23858 - protein, 16 aa, Artificial Sequence
  Description of Artificial Sequence: Synthetic peptide
  XENP019672 vhCDR2
EINHNGNTNSNPSLKS

SEQ ID NO: 23859 - protein, 12 aa, Artificial Sequence
  Description of Artificial Sequence: Synthetic peptide
  XENP019672 vhCDR3
GYSDYEYNWFDP

SEQ ID NO: 23860 - protein, 480 aa, Artificial Sequence
  Description of Artificial Sequence: Synthetic polypeptide
  XENP019672 25F7_H0L0-1G6_H1.288_L1.210 scFv-Fc Heavy Chain
EVQLVESGGGLVKPGGSLRLSCVASGFTFSNYWMNWVRQAPGKCLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGCGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23861 - protein, 122 aa, Artificial Sequence; identical to SEQ ID NO: 11358
  Description of Artificial Sequence: Synthetic polypeptide
  VH of XENP019672

SEQ ID NO: 23862 - protein, 107 aa, Artificial Sequence; identical to SEQ ID NO: 11359
  Description of Artificial Sequence: Synthetic polypeptide
  VL of XENP019672

SEQ ID NO: 23863 - protein, 231 aa, Artificial Sequence; identical to SEQ ID NO: 21532
  Description of Artificial Sequence: Synthetic polypeptide
  Fc chain of XENP019672

SEQ ID NO: 23864 - protein, 5 aa, Artificial Sequence
  Description of Artificial Sequence: Synthetic peptide
  XENP019672 vhCDR1
NYWMN

SEQ ID NO: 23865 - protein, 19 aa, Artificial Sequence
  Description of Artificial Sequence: Synthetic peptide
  XENP019672 vhCDR2
EIRLYSNNYATHYAESVKG

SEQ ID NO: 23866 - protein, 11 aa, Artificial Sequence
  Description of Artificial Sequence: Synthetic peptide
  XENP019672 vhCDR3
YYGNYGGYFDV

SEQ ID NO: 23867 - protein, 11 aa, Artificial Sequence
  Description of Artificial Sequence: Synthetic peptide
  XENP019672 vlCDR1
RASQSVGNDVA

SEQ ID NO: 23868 - protein, 7 aa, Artificial Sequence
  Description of Artificial Sequence: Synthetic peptide
  XENP019672 vlCDR2
YASHRYT

SEQ ID NO: 23869 - protein, 9 aa, Artificial Sequence
  Description of Artificial Sequence: Synthetic peptide
  XENP019672 vlCDR3
QQDFSSPRT

SEQ ID NO: 23870 - protein, 214 aa, Artificial Sequence; identical to SEQ ID NO: 17140
  Description of Artificial Sequence: Synthetic polypeptide
  XENP019672 25F7_H0L0-1G6_H1.288_L1.210 Light Chain

SEQ ID NO: 23871 - protein, 214 aa, Artificial Sequence; identical to SEQ ID NO: 17140
  Description of Artificial Sequence: Synthetic polypeptide
  VL of XENP019672

SEQ ID NO: 23872 - protein, 11 aa, Artificial Sequence
  Description of Artificial Sequence: Synthetic peptide
  XENP019672 vlCDR1
RASQSISSYLA

SEQ ID NO: 23873 - protein, 7 aa, Artificial Sequence
  Description of Artificial Sequence: Synthetic peptide
  XENP019672 vlCDR2
DASNRAT

SEQ ID NO: 23874 - protein, 9 aa, Artificial Sequence
  Description of Artificial Sequence: Synthetic peptide
  XENP019672 vlCDR3
QQRSNWPLT

SEQ ID NO: 23875 - protein, 449 aa, Artificial Sequence; identical to SEQ ID NO: 21524
  Description of Artificial Sequence: Synthetic polypeptide
  XENP019673 25F7_H0L0-1G6_L1.210_H1.288 Fab-Fc Heavy Chain

SEQ ID NO: 23876 - protein, 120 aa, Artificial Sequence; identical to SEQ ID NO: 17136
  Description of Artificial Sequence: Synthetic polypeptide
  VH of XENP019673

SEQ ID NO: 23877 - protein, 5 aa, Artificial Sequence
  Description of Artificial Sequence: Synthetic peptide
  XENP019673 vhCDR1
DYYWN

SEQ ID NO: 23878 - protein, 16 aa, Artificial Sequence
  Description of Artificial Sequence: Synthetic peptide
  XENP019673 vhCDR2
EINHNGNTNSNPSLKS

SEQ ID NO: 23879 - protein, 12 aa, Artificial Sequence
  Description of Artificial Sequence: Synthetic peptide
  XENP019673 vhCDR3
GYSDYEYNWFDP

SEQ ID NO: 23880 - protein, 480 aa, Artificial Sequence; identical to SEQ ID NO: 23381
  Description of Artificial Sequence: Synthetic polypeptide
  XENP019673 25F7_H0L0-1G6_L1.210_H1.288 scFv-Fc Heavy Chain

SEQ ID NO: 23881 - protein, 107 aa, Artificial Sequence; identical to SEQ ID NO: 11359
  Description of Artificial Sequence: Synthetic polypeptide
  VH of XENP019673

SEQ ID NO: 23882 - protein, 122 aa, Artificial Sequence; identical to SEQ ID NO: 11358
  Description of Artificial Sequence: Synthetic polypeptide
  VL of XENP019673

SEQ ID NO: 23883 - protein, 231 aa, Artificial Sequence; identical to SEQ ID NO: 21532
  Description of Artificial Sequence: Synthetic polypeptide
  Fc chain of XENP019673

SEQ ID NO: 23884 - protein, 11 aa, Artificial Sequence
  Description of Artificial Sequence: Synthetic peptide
  XENP019673 vhCDR1
RASQSVGNDVA

SEQ ID NO: 23885 - protein, 7 aa, Artificial Sequence
  Description of Artificial Sequence: Synthetic peptide
  XENP019673 vhCDR2
YASHRYT

SEQ ID NO: 23886 - protein, 9 aa, Artificial Sequence
  Description of Artificial Sequence: Synthetic peptide
  XENP019673 vhCDR3
QQDFSSPRT

SEQ ID NO: 23887 - protein, 5 aa, Artificial Sequence
  Description of Artificial Sequence: Synthetic peptide
  XENP019673 vlCDR1
NYWMN

SEQ ID NO: 23888 - protein, 19 aa, Artificial Sequence
  Description of Artificial Sequence: Synthetic peptide
  XENP019673 vlCDR2
EIRLYSNNYATHYAESVKG

SEQ ID NO: 23889 - protein, 11 aa, Artificial Sequence
  Description of Artificial Sequence: Synthetic peptide
  XENP019673 vlCDR3
YYGNYGGYFDV

SEQ ID NO: 23890 - protein, 214 aa, Artificial Sequence; identical to SEQ ID NO: 17140
  Description of Artificial Sequence: Synthetic polypeptide
  XENP019673 25F7_H0L0-1G6_L1.210_H1.288 Light Chain

SEQ ID NO: 23891 - protein, 214 aa, Artificial Sequence; identical to SEQ ID NO: 17140
  Description of Artificial Sequence: Synthetic polypeptide
  VL of XENP019673

SEQ ID NO: 23892 - protein, 11 aa, Artificial Sequence
  Description of Artificial Sequence: Synthetic peptide
  XENP019673 vlCDR1
RASQSISSYLA

SEQ ID NO: 23893 - protein, 7 aa, Artificial Sequence
  Description of Artificial Sequence: Synthetic peptide
  XENP019673 vlCDR2
DASNRAT

SEQ ID NO: 23894 - protein, 9 aa, Artificial Sequence
  Description of Artificial Sequence: Synthetic peptide
  XENP019673 vlCDR3
QQRSNWPLT

SEQ ID NO: 23895 - protein, 449 aa, Artificial Sequence; identical to SEQ ID NO: 21524
  Description of Artificial Sequence: Synthetic polypeptide
  XENP019674 25F7_H0L0-1G6_H1.279_L1.194 Fab-Fc Heavy Chain

SEQ ID NO: 23896 - protein, 120 aa, Artificial Sequence; identical to SEQ ID NO: 17136
  Description of Artificial Sequence: Synthetic polypeptide
  VH of XENP019674

SEQ ID NO: 23897 - protein, 5 aa, Artificial Sequence
  Description of Artificial Sequence: Synthetic peptide
  XENP019674 vhCDR1
DYYWN

SEQ ID NO: 23898 - protein, 16 aa, Artificial Sequence
  Description of Artificial Sequence: Synthetic peptide
  XENP019674 vhCDR2
EINHNGNTNSNPSLKS

SEQ ID NO: 23899 - protein, 12 aa, Artificial Sequence
  Description of Artificial Sequence: Synthetic peptide
  XENP019674 vhCDR3
GYSDYEYNWFDP

SEQ ID NO: 23900 - protein, 480 aa, Artificial Sequence; identical to SEQ ID NO: 23401
  Description of Artificial Sequence: Synthetic polypeptide
  XENP019674 25F7_H0L0-1G6_H1.279_L1.194 scFv-Fc Heavy Chain

SEQ ID NO: 23901 - protein, 122 aa, Artificial Sequence; identical to SEQ ID NO: 10908
  Description of Artificial Sequence: Synthetic polypeptide
  VH of XENP019674

SEQ ID NO: 23902 - protein, 107 aa, Artificial Sequence; identical to SEQ ID NO: 10999
  Description of Artificial Sequence: Synthetic polypeptide
  VL of XENP019674

SEQ ID NO: 23903 - protein, 231 aa, Artificial Sequence; identical to SEQ ID NO: 21532
  Description of Artificial Sequence: Synthetic polypeptide
  Fc chain of XENP019674

SEQ ID NO: 23904 - protein, 5 aa, Artificial Sequence
  Description of Artificial Sequence: Synthetic peptide
  XENP019674 vhCDR1
NYWMN

SEQ ID NO: 23905 - protein, 19 aa, Artificial Sequence
  Description of Artificial Sequence: Synthetic peptide
  XENP019674 vhCDR2
EIRLYSNNYATHYAESVKG

SEQ ID NO: 23906 - protein, 11 aa, Artificial Sequence
  Description of Artificial Sequence: Synthetic peptide
  XENP019674 vhCDR3
YYGNYGGYFDV

SEQ ID NO: 23907 - protein, 11 aa, Artificial Sequence
  Description of Artificial Sequence: Synthetic peptide
  XENP019674 vlCDR1
RASQSVGNDVA

SEQ ID NO: 23908 - protein, 7 aa, Artificial Sequence
  Description of Artificial Sequence: Synthetic peptide
  XENP019674 vlCDR2
YASHRYT

SEQ ID NO: 23909 - protein, 9 aa, Artificial Sequence
  Description of Artificial Sequence: Synthetic peptide
  XENP019674 vlCDR3
QQDFSSPRT

SEQ ID NO: 23910 - protein, 214 aa, Artificial Sequence; identical to SEQ ID NO: 17140
  Description of Artificial Sequence: Synthetic polypeptide
  XENP019674 25F7_H0L0-1G6_H1.279_L1.194 Light Chain

SEQ ID NO: 23911 - protein, 214 aa, Artificial Sequence; identical to SEQ ID NO: 17140
  Description of Artificial Sequence: Synthetic polypeptide
  VL of XENP019674

SEQ ID NO: 23912 - protein, 11 aa, Artificial Sequence
  Description of Artificial Sequence: Synthetic peptide
  XENP019674 vlCDR1
RASQSISSYLA

SEQ ID NO: 23913 - protein, 7 aa, Artificial Sequence
  Description of Artificial Sequence: Synthetic peptide
  XENP019674 vlCDR2
DASNRAT

SEQ ID NO: 23914 - protein, 9 aa, Artificial Sequence
  Description of Artificial Sequence: Synthetic peptide
  XENP019674 vlCDR3
QQRSNWPLT

SEQ ID NO: 23915 - protein, 449 aa, Artificial Sequence; identical to SEQ ID NO: 21524
  Description of Artificial Sequence: Synthetic polypeptide
  XENP019675 25F7_H0L0-1G6_H1.282_L1.194 Fab-Fc Heavy Chain

SEQ ID NO: 23916 - protein, 120 aa, Artificial Sequence; identical to SEQ ID NO: 17136
  Description of Artificial Sequence: Synthetic polypeptide
  VH of XENP019675

SEQ ID NO: 23917 - protein, 5 aa, Artificial Sequence
  Description of Artificial Sequence: Synthetic peptide
  XENP019675 vhCDR1
DYYWN

SEQ ID NO: 23918 - protein, 16 aa, Artificial Sequence
  Description of Artificial Sequence: Synthetic peptide
  XENP019675 vhCDR2
EINHNGNTNSNPSLKS

SEQ ID NO: 23919 - protein, 12 aa, Artificial Sequence
  Description of Artificial Sequence: Synthetic peptide
  XENP019675 vhCDR3
GYSDYEYNWFDP

SEQ ID NO: 23920 - protein, 480 aa, Artificial Sequence
  Description of Artificial Sequence: Synthetic polypeptide
  XENP019675 25F7_H0L0-1G6_H1.282_L1.194 scFv-Fc Heavy Chain
EVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSGKPGSGKPGSGKPGSGKPGSEIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23921 - protein, 122 aa, Artificial Sequence; identical to SEQ ID NO: 10935
  Description of Artificial Sequence: Synthetic polypeptide
  VH of XENP019675

SEQ ID NO: 23922 - protein, 107 aa, Artificial Sequence; identical to SEQ ID NO: 10999
  Description of Artificial Sequence: Synthetic polypeptide
  VL of XENP019675

SEQ ID NO: 23923 - protein, 231 aa, Artificial Sequence; identical to SEQ ID NO: 21532
  Description of Artificial Sequence: Synthetic polypeptide
  Fc chain of XENP019675

SEQ ID NO: 23924 - protein, 5 aa, Artificial Sequence
  Description of Artificial Sequence: Synthetic peptide
  XENP019675 vhCDR1
NYWMN

SEQ ID NO: 23925 - protein, 19 aa, Artificial Sequence
  Description of Artificial Sequence: Synthetic peptide
  XENP019675 vhCDR2
EIRLYSNNYATHYAESVKG

SEQ ID NO: 23926 - protein, 11 aa, Artificial Sequence
  Description of Artificial Sequence: Synthetic peptide
  XENP019675 vhCDR3
YYGNYGGYFDV

SEQ ID NO: 23927 - protein, 11 aa, Artificial Sequence
  Description of Artificial Sequence: Synthetic peptide
  XENP019675 vlCDR1
RASQSVGNDVA

SEQ ID NO: 23928 - protein, 7 aa, Artificial Sequence
  Description of Artificial Sequence: Synthetic peptide
  XENP019675 vlCDR2
YASHRYT

SEQ ID NO: 23929 - protein, 9 aa, Artificial Sequence
  Description of Artificial Sequence: Synthetic peptide
  XENP019675 vlCDR3
QQDFSSPRT

SEQ ID NO: 23930 - protein, 214 aa, Artificial Sequence; identical to SEQ ID NO: 17140
  Description of Artificial Sequence: Synthetic polypeptide
  XENP019675 25F7_H0L0-1G6_H1.282_L1.194 Light Chain

SEQ ID NO: 23931 - protein, 214 aa, Artificial Sequence; identical to SEQ ID NO: 17140
  Description of Artificial Sequence: Synthetic polypeptide
  VL of XENP019675

SEQ ID NO: 23932 - protein, 11 aa, Artificial Sequence
  Description of Artificial Sequence: Synthetic peptide
  XENP019675 vlCDR1
RASQSISSYLA

SEQ ID NO: 23933 - protein, 7 aa, Artificial Sequence
  Description of Artificial Sequence: Synthetic peptide
  XENP019675 vlCDR2
DASNRAT

SEQ ID NO: 23934 - protein, 9 aa, Artificial Sequence
  Description of Artificial Sequence: Synthetic peptide
  XENP019675 vlCDR3
QQRSNWPLT

SEQ ID NO: 23935 - protein, 449 aa, Artificial Sequence; identical to SEQ ID NO: 21524
  Description of Artificial Sequence: Synthetic polypeptide
  XENP019676 25F7_H0L0-1G6_L1.194_H1.279 Fab-Fc Heavy Chain

SEQ ID NO: 23936 - protein, 120 aa, Artificial Sequence; identical to SEQ ID NO: 17136
  Description of Artificial Sequence: Synthetic polypeptide
  VH of XENP019676

SEQ ID NO: 23937 - protein, 5 aa, Artificial Sequence
  Description of Artificial Sequence: Synthetic peptide
  XENP019676 vhCDR1
DYYWN

SEQ ID NO: 23938 - protein, 16 aa, Artificial Sequence
  Description of Artificial Sequence: Synthetic peptide
  XENP019676 vhCDR2
EINHNGNTNSNPSLKS

SEQ ID NO: 23939 - protein, 12 aa, Artificial Sequence
  Description of Artificial Sequence: Synthetic peptide
  XENP019676 vhCDR3
GYSDYEYNWFDP

SEQ ID NO: 23940 - protein, 480 aa, Artificial Sequence; identical to SEQ ID NO: 23221
  Description of Artificial Sequence: Synthetic polypeptide
  XENP019676 25F7_H0L0-1G6_L1.194_H1.279 scFv-Fc Heavy Chain

SEQ ID NO: 23941 - protein, 107 aa, Artificial Sequence; identical to SEQ ID NO: 10999
  Description of Artificial Sequence: Synthetic polypeptide
  VH of XENP019676

SEQ ID NO: 23942 - protein, 122 aa, Artificial Sequence; identical to SEQ ID NO: 10908
  Description of Artificial Sequence: Synthetic polypeptide
  VL of XENP019676

SEQ ID NO: 23943 - protein, 231 aa, Artificial Sequence; identical to SEQ ID NO: 21532
  Description of Artificial Sequence: Synthetic polypeptide
  Fc chain of XENP019676

SEQ ID NO: 23944 - protein, 11 aa, Artificial Sequence
  Description of Artificial Sequence: Synthetic peptide
  XENP019676 vhCDR1
RASQSVGNDVA

SEQ ID NO: 23945 - protein, 7 aa, Artificial Sequence
  Description of Artificial Sequence: Synthetic peptide
  XENP019676 vhCDR2
YASHRYT

SEQ ID NO: 23946 - protein, 9 aa, Artificial Sequence
  Description of Artificial Sequence: Synthetic peptide
  XENP019676 vhCDR3
QQDFSSPRT

SEQ ID NO: 23947 - protein, 5 aa, Artificial Sequence
  Description of Artificial Sequence: Synthetic peptide
  XENP019676 vlCDR1
NYWMN

SEQ ID NO: 23948 - protein, 19 aa, Artificial Sequence
  Description of Artificial Sequence: Synthetic peptide
  XENP019676 vlCDR2
EIRLYSNNYATHYAESVKG

SEQ ID NO: 23949 - protein, 11 aa, Artificial Sequence
  Description of Artificial Sequence: Synthetic peptide
  XENP019676 vlCDR3
YYGNYGGYFDV

SEQ ID NO: 23950 - protein, 214 aa, Artificial Sequence; identical to SEQ ID NO: 17140
  Description of Artificial Sequence: Synthetic polypeptide
  XENP019676 25F7_H0L0-1G6_L1.194_H1.279 Light Chain

SEQ ID NO: 23951 - protein, 214 aa, Artificial Sequence; identical to SEQ ID NO: 17140
  Description of Artificial Sequence: Synthetic polypeptide
  VL of XENP019676

SEQ ID NO: 23952 - protein, 11 aa, Artificial Sequence
  Description of Artificial Sequence: Synthetic peptide
  XENP019676 vlCDR1
RASQSISSYLA

SEQ ID NO: 23953 - protein, 7 aa, Artificial Sequence
  Description of Artificial Sequence: Synthetic peptide
  XENP019676 vlCDR2
DASNRAT

SEQ ID NO: 23954 - protein, 9 aa, Artificial Sequence
  Description of Artificial Sequence: Synthetic peptide
  XENP019676 vlCDR3
QQRSNWPLT

SEQ ID NO: 23955 - protein, 449 aa, Artificial Sequence; identical to SEQ ID NO: 21524
  Description of Artificial Sequence: Synthetic polypeptide
  XENP019677 25F7_H0L0-1G6_L1.194_H1.282 Fab-Fc Heavy Chain

SEQ ID NO: 23956 - protein, 120 aa, Artificial Sequence; identical to SEQ ID NO: 17136
  Description of Artificial Sequence: Synthetic polypeptide
  VH of XENP019677

SEQ ID NO: 23957 - protein, 5 aa, Artificial Sequence
  Description of Artificial Sequence: Synthetic peptide
  XENP019677 vhCDR1
DYYWN

SEQ ID NO: 23958 - protein, 16 aa, Artificial Sequence
  Description of Artificial Sequence: Synthetic peptide
  XENP019677 vhCDR2
EINHNGNTNSNPSLKS

SEQ ID NO: 23959 - protein, 12 aa, Artificial Sequence
  Description of Artificial Sequence: Synthetic peptide
  XENP019677 vhCDR3
GYSDYEYNWFDP

SEQ ID NO: 23960 - protein, 480 aa, Artificial Sequence
  Description of Artificial Sequence: Synthetic polypeptide
  XENP019677 25F7_H0L0-1G6_L1.194_H1.282 scFv-Fc Heavy Chain
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLTCVASGFTFSNYWMNWVRQAPGKGLEWVAEIRLYSNNYATHYAESVKGRFTISRDDSKSMLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23961 - protein, 107 aa, Artificial Sequence; identical to SEQ ID NO: 10999
  Description of Artificial Sequence: Synthetic polypeptide
  VH of XENP019677

SEQ ID NO: 23962 - protein, 122 aa, Artificial Sequence; identical to SEQ ID NO: 10935
  Description of Artificial Sequence: Synthetic polypeptide
  VL of XENP019677

SEQ ID NO: 23963 - protein, 231 aa, Artificial Sequence; identical to SEQ ID NO: 21532
  Description of Artificial Sequence: Synthetic polypeptide
  Fc chain of XENP019677

SEQ ID NO: 23964 - protein, 11 aa, Artificial Sequence
  Description of Artificial Sequence: Synthetic peptide
  XENP019677 vhCDR1
RASQSVGNDVA

SEQ ID NO: 23965 - protein, 7 aa, Artificial Sequence
  Description of Artificial Sequence: Synthetic peptide
  XENP019677 vhCDR2
YASHRYT

SEQ ID NO: 23966 - protein, 9 aa, Artificial Sequence
  Description of Artificial Sequence: Synthetic peptide
  XENP019677 vhCDR3
QQDFSSPRT

SEQ ID NO: 23967 - protein, 5 aa, Artificial Sequence
  Description of Artificial Sequence: Synthetic peptide
  XENP019677 vlCDR1
NYWMN

SEQ ID NO: 23968 - protein, 19 aa, Artificial Sequence
  Description of Artificial Sequence: Synthetic peptide
  XENP019677 vlCDR2
EIRLYSNNYATHYAESVKG

SEQ ID NO: 23969 - protein, 11 aa, Artificial Sequence
  Description of Artificial Sequence: Synthetic peptide
  XENP019677 vlCDR3
YYGNYGGYFDV

SEQ ID NO: 23970 - protein, 214 aa, Artificial Sequence; identical to SEQ ID NO: 17140
  Description of Artificial Sequence: Synthetic polypeptide
  XENP019677 25F7_H0L0-1G6_L1.194_H1.282 Light Chain

SEQ ID NO: 23971 - protein, 214 aa, Artificial Sequence; identical to SEQ ID NO: 17140
  Description of Artificial Sequence: Synthetic polypeptide
  VL of XENP019677

SEQ ID NO: 23972 - protein, 11 aa, Artificial Sequence
  Description of Artificial Sequence: Synthetic peptide
  XENP019677 vlCDR1
RASQSISSYLA

SEQ ID NO: 23973 - protein, 7 aa, Artificial Sequence
  Description of Artificial Sequence: Synthetic peptide
  XENP019677 vlCDR2
DASNRAT

SEQ ID NO: 23974 - protein, 9 aa, Artificial Sequence
  Description of Artificial Sequence: Synthetic peptide
  XENP019677 vlCDR3
QQRSNWPLT

SEQ ID NO: 23975 - protein, 447 aa, Artificial Sequence; identical to SEQ ID NO: 17175
  Description of Artificial Sequence: Synthetic polypeptide
  XENP020032 1H11_H2L2-1G6_H1.279_L1.194 Fab-Fc Heavy Chain

SEQ ID NO: 23976 - protein, 118 aa, Artificial Sequence; identical to SEQ ID NO: 17176
  Description of Artificial Sequence: Synthetic polypeptide
  VH of XENP020032

SEQ ID NO: 23977 - protein, 5 aa, Artificial Sequence
  Description of Artificial Sequence: Synthetic peptide
  XENP020032 vhCDR1
NYGMN

SEQ ID NO: 23978 - protein, 17 aa, Artificial Sequence
  Description of Artificial Sequence: Synthetic peptide
  XENP020032 vhCDR2
WINTYTGEPTYADGFTG

SEQ ID NO: 23979 - protein, 9 aa, Artificial Sequence
  Description of Artificial Sequence: Synthetic peptide
  XENP020032 vhCDR3
GRGMGYFDY

SEQ ID NO: 23980 - protein, 480 aa, Artificial Sequence; identical to SEQ ID NO: 23401
  Description of Artificial Sequence: Synthetic polypeptide
  XENP020032 1H11_H2L2-1G6_H1.279_L1.194 scFv-Fc Heavy Chain

SEQ ID NO: 23981 - protein, 122 aa, Artificial Sequence; identical to SEQ ID NO: 10908
  Description of Artificial Sequence: Synthetic polypeptide
  VH of XENP020032

SEQ ID NO: 23982 - protein, 107 aa, Artificial Sequence; identical to SEQ ID NO: 10999
  Description of Artificial Sequence: Synthetic polypeptide
  VL of XENP020032

SEQ ID NO: 23983 - protein, 231 aa, Artificial Sequence; identical to SEQ ID NO: 21532
  Description of Artificial Sequence: Synthetic polypeptide
  Fc chain of XENP020032

SEQ ID NO: 23984 - protein, 5 aa, Artificial Sequence
  Description of Artificial Sequence: Synthetic peptide
  XENP020032 vhCDR1
NYWMN

SEQ ID NO: 23985 - protein, 19 aa, Artificial Sequence
  Description of Artificial Sequence: Synthetic peptide
  XENP020032 vhCDR2
EIRLYSNNYATHYAESVKG

SEQ ID NO: 23986 - protein, 11 aa, Artificial Sequence
  Description of Artificial Sequence: Synthetic peptide
  XENP020032 vhCDR3
YYGNYGGYFDV

SEQ ID NO: 23987 - protein, 11 aa, Artificial Sequence
  Description of Artificial Sequence: Synthetic peptide
  XENP020032 vlCDR1
RASQSVGNDVA

SEQ ID NO: 23988 - protein, 7 aa, Artificial Sequence
  Description of Artificial Sequence: Synthetic peptide
  XENP020032 vlCDR2
YASHRYT

SEQ ID NO: 23989 - protein, 9 aa, Artificial Sequence
  Description of Artificial Sequence: Synthetic peptide
  XENP020032 vlCDR3
QQDFSSPRT

SEQ ID NO: 23990 - protein, 214 aa, Artificial Sequence; identical to SEQ ID NO: 17170
  Description of Artificial Sequence: Synthetic polypeptide
  XENP020032 1H11_H2L2-1G6_H1.279_L1.194 Light Chain

SEQ ID NO: 23991 - protein, 214 aa, Artificial Sequence; identical to SEQ ID NO: 17170
  Description of Artificial Sequence: Synthetic polypeptide
  VL of XENP020032

SEQ ID NO: 23992 - protein, 11 aa, Artificial Sequence
  Description of Artificial Sequence: Synthetic peptide
  XENP020032 vlCDR1
RASENIYSNLA

SEQ ID NO: 23993 - protein, 7 aa, Artificial Sequence
  Description of Artificial Sequence: Synthetic peptide
  XENP020032 vlCDR2
AATNLAD

SEQ ID NO: 23994 - protein, 9 aa, Artificial Sequence
  Description of Artificial Sequence: Synthetic peptide
  XENP020032 vlCDR3
QHFWTTPRT

SEQ ID NO: 23995 - protein, 444 aa, Artificial Sequence; identical to SEQ ID NO: 17215
  Description of Artificial Sequence: Synthetic polypeptide
  XENP020033 8D7_H1L1-1G6_H1.279_L1.194 Fab-Fc Heavy Chain

SEQ ID NO: 23996 - protein, 115 aa, Artificial Sequence; identical to SEQ ID NO: 17216
  Description of Artificial Sequence: Synthetic polypeptide
  VH of XENP020033

SEQ ID NO: 23997 - protein, 5 aa, Artificial Sequence
  Description of Artificial Sequence: Synthetic peptide
  XENP020033 vhCDR1
SYGVH

SEQ ID NO: 23998 - protein, 15 aa, Artificial Sequence
  Description of Artificial Sequence: Synthetic peptide
  XENP020033 vhCDR2
VIWSGSTDYNPSLKS

SEQ ID NO: 23999 - protein, 8 aa, Artificial Sequence
  Description of Artificial Sequence: Synthetic peptide
  XENP020033 vhCDR3
TYYYAMDY

SEQ ID NO: 24000 - protein, 480 aa, Artificial Sequence; identical to SEQ ID NO: 23401
  Description of Artificial Sequence: Synthetic polypeptide
  XENP020033 8D7_H1L1-1G6_H1.279_L1.194 scFv-Fc Heavy Chain

SEQ ID NO: 24001 - protein, 122 aa, Artificial Sequence; identical to SEQ ID NO: 10908
  Description of Artificial Sequence: Synthetic polypeptide
  VH of XENP020033

SEQ ID NO: 24002 - protein, 107 aa, Artificial Sequence; identical to SEQ ID NO: 10999
  Description of Artificial Sequence: Synthetic polypeptide
  VL of XENP020033

SEQ ID NO: 24003 - protein, 231 aa, Artificial Sequence; identical to SEQ ID NO: 21532
  Description of Artificial Sequence: Synthetic polypeptide
  Fc chain of XENP020033

SEQ ID NO: 24004 - protein, 5 aa, Artificial Sequence
  Description of Artificial Sequence: Synthetic peptide
  XENP020033 vhCDR1
NYWMN

SEQ ID NO: 24005 - protein, 19 aa, Artificial Sequence
  Description of Artificial Sequence: Synthetic peptide
  XENP020033 vhCDR2
EIRLYSNNYATHYAESVKG

SEQ ID NO: 24006 - protein, 11 aa, Artificial Sequence
  Description of Artificial Sequence: Synthetic peptide
  XENP020033 vhCDR3
YYGNYGGYFDV

SEQ ID NO: 24007 - protein, 11 aa, Artificial Sequence
  Description of Artificial Sequence: Synthetic peptide
  XENP020033 vlCDR1
RASQSVGNDVA

SEQ ID NO: 24008 - protein, 7 aa, Artificial Sequence
  Description of Artificial Sequence: Synthetic peptide
  XENP020033 vlCDR2
YASHRYT

SEQ ID NO: 24009 - protein, 9 aa, Artificial Sequence
  Description of Artificial Sequence: Synthetic peptide
  XENP020033 vlCDR3
QQDFSSPRT

SEQ ID NO: 24010 - protein, 214 aa, Artificial Sequence; identical to SEQ ID NO: 17220
  Description of Artificial Sequence: Synthetic polypeptide
  XENP020033 8D7_H1L1-1G6_H1.279_L1.194 Light Chain

SEQ ID NO: 24011 - protein, 214 aa, Artificial Sequence; identical to SEQ ID NO: 17220
  Description of Artificial Sequence: Synthetic polypeptide
  VL of XENP020033

SEQ ID NO: 24012 - protein, 11 aa, Artificial Sequence
  Description of Artificial Sequence: Synthetic peptide
  XENP020033 vlCDR1
RASENIYSNLA

SEQ ID NO: 24013 - protein, 7 aa, Artificial Sequence
  Description of Artificial Sequence: Synthetic peptide
  XENP020033 vlCDR2
AATNLAD

SEQ ID NO: 24014 - protein, 9 aa, Artificial Sequence
  Description of Artificial Sequence: Synthetic peptide
  XENP020033 vlCDR3
QHFWGTPWT

SEQ ID NO: 24015 - protein, 447 aa, Artificial Sequence; identical to SEQ ID NO: 17235
  Description of Artificial Sequence: Synthetic polypeptide
  XENP020034 2A11_H1L2-1G6_H1.279_L1.194 Fab-Fc Heavy Chain

SEQ ID NO: 24016 - protein, 118 aa, Artificial Sequence; identical to SEQ ID NO: 17236
  Description of Artificial Sequence: Synthetic polypeptide
  VH of XENP020034

SEQ ID NO: 24017 - protein, 5 aa, Artificial Sequence
  Description of Artificial Sequence: Synthetic peptide
  XENP020034 vhCDR1
DYYMH

SEQ ID NO: 24018 - protein, 17 aa, Artificial Sequence
  Description of Artificial Sequence: Synthetic peptide
  XENP020034 vhCDR2
WIDPENGDTEYAPKFQG

SEQ ID NO: 24019 - protein, 9 aa, Artificial Sequence
  Description of Artificial Sequence: Synthetic peptide
  XENP020034 vhCDR3
RGVRQALDY

SEQ ID NO: 24020 - protein, 480 aa, Artificial Sequence; identical to SEQ ID NO: 23401
  Description of Artificial Sequence: Synthetic polypeptide
  XENP020034 2A11_H1L2-1G6_H1.279_L1.194 scFv-Fc Heavy Chain

SEQ ID NO: 24021 - protein, 122 aa, Artificial Sequence; identical to SEQ ID NO: 10908
  Description of Artificial Sequence: Synthetic polypeptide
  VH of XENP020034

SEQ ID NO: 24022 - protein, 107 aa, Artificial Sequence; identical to SEQ ID NO: 10999
  Description of Artificial Sequence: Synthetic polypeptide
  VL of XENP020034

SEQ ID NO: 24023 - protein, 231 aa, Artificial Sequence; identical to SEQ ID NO: 21532
  Description of Artificial Sequence: Synthetic polypeptide
  Fc chain of XENP020034

SEQ ID NO: 24024 - protein, 5 aa, Artificial Sequence
  Description of Artificial Sequence: Synthetic peptide
  XENP020034 vhCDR1
NYWMN

SEQ ID NO: 24025 - protein, 19 aa, Artificial Sequence
  Description of Artificial Sequence: Synthetic peptide
  XENP020034 vhCDR2
EIRLYSNNYATHYAESVKG

SEQ ID NO: 24026 - protein, 11 aa, Artificial Sequence
  Description of Artificial Sequence: Synthetic peptide
  XENP020034 vhCDR3
YYGNYGGYFDV

SEQ ID NO: 24027 - protein, 11 aa, Artificial Sequence
  Description of Artificial Sequence: Synthetic peptide
  XENP020034 vlCDR1
RASQSVGNDVA

SEQ ID NO: 24028 - protein, 7 aa, Artificial Sequence
  Description of Artificial Sequence: Synthetic peptide
  XENP020034 vlCDR2
YASHRYT

SEQ ID NO: 24029 - protein, 9 aa, Artificial Sequence
  Description of Artificial Sequence: Synthetic peptide
  XENP020034 vlCDR3
QQDFSSPRT

SEQ ID NO: 24030 - protein, 214 aa, Artificial Sequence; identical to SEQ ID NO: 17250
  Description of Artificial Sequence: Synthetic polypeptide
  XENP020034 2A11_H1L2-1G6_H1.279_L1.194 Light Chain

SEQ ID NO: 24031 - protein, 214 aa, Artificial Sequence; identical to SEQ ID NO: 17250
  Description of Artificial Sequence: Synthetic polypeptide
  VL of XENP020034

SEQ ID NO: 24032 - protein, 11 aa, Artificial Sequence
  Description of Artificial Sequence: Synthetic peptide
  XENP020034 vlCDR1
QASQDIGNYLN

SEQ ID NO: 24033 - protein, 7 aa, Artificial Sequence
  Description of Artificial Sequence: Synthetic peptide
  XENP020034 vlCDR2
YTSRLHS

SEQ ID NO: 24034 - protein, 9 aa, Artificial Sequence
  Description of Artificial Sequence: Synthetic peptide
  XENP020034 vlCDR3
QQGNTLPYT

SEQ ID NO: 24035 - protein, 444 aa, Artificial Sequence; identical to SEQ ID NO: 17405
  Description of Artificial Sequence: Synthetic polypeptide
  XENP020035 9E7_H4L1-1G6_H1.279_L1.194 Fab-Fc Heavy Chain

SEQ ID NO: 24036 - protein, 115 aa, Artificial Sequence; identical to SEQ ID NO: 17406
  Description of Artificial Sequence: Synthetic polypeptide
  VH of XENP020035

SEQ ID NO: 24037 - protein, 5 aa, Artificial Sequence
  Description of Artificial Sequence: Synthetic peptide
  XENP020035 vhCDR1
RYGIH

SEQ ID NO: 24038 - protein, 15 aa, Artificial Sequence
  Description of Artificial Sequence: Synthetic peptide
  XENP020035 vhCDR2
VIWSGVTDYNPSFQG

SEQ ID NO: 24039 - protein, 8 aa, Artificial Sequence
  Description of Artificial Sequence: Synthetic peptide
  XENP020035 vhCDR3
PYYYAMDY

SEQ ID NO: 24040 - protein, 480 aa, Artificial Sequence; identical to SEQ ID NO: 23401
  Description of Artificial Sequence: Synthetic polypeptide
  XENP020035 9E7_H4L1-1G6_H1.279_L1.194 scFv-Fc Heavy Chain

SEQ ID NO: 24041 - protein, 122 aa, Artificial Sequence; identical to SEQ ID NO: 10908
  Description of Artificial Sequence: Synthetic polypeptide
  VH of XENP020035

SEQ ID NO: 24042 - protein, 107 aa, Artificial Sequence; identical to SEQ ID NO: 10999
  Description of Artificial Sequence: Synthetic polypeptide
  VL of XENP020035

SEQ ID NO: 24043 - protein, 231 aa, Artificial Sequence; identical to SEQ ID NO: 21532
  Description of Artificial Sequence: Synthetic polypeptide
  Fc chain of XENP020035

SEQ ID NO: 24044 - protein, 5 aa, Artificial Sequence
  Description of Artificial Sequence: Synthetic peptide
  XENP020035 vhCDR1
NYWMN

SEQ ID NO: 24045 - protein, 19 aa, Artificial Sequence
  Description of Artificial Sequence: Synthetic peptide
  XENP020035 vhCDR2
EIRLYSNNYATHYAESVKG

SEQ ID NO: 24046 - protein, 11 aa, Artificial Sequence
  Description of Artificial Sequence: Synthetic peptide
  XENP020035 vhCDR3
YYGNYGGYFDV

SEQ ID NO: 24047 - protein, 11 aa, Artificial Sequence
  Description of Artificial Sequence: Synthetic peptide
  XENP020035 vlCDR1
RASQSVGNDVA

SEQ ID NO: 24048 - protein, 7 aa, Artificial Sequence
  Description of Artificial Sequence: Synthetic peptide
  XENP020035 vlCDR2
YASHRYT

SEQ ID NO: 24049 - protein, 9 aa, Artificial Sequence
  Description of Artificial Sequence: Synthetic peptide
  XENP020035 vlCDR3
QQDFSSPRT

SEQ ID NO: 24050 - protein, 214 aa, Artificial Sequence; identical to SEQ ID NO: 17350
  Description of Artificial Sequence: Synthetic polypeptide
  XENP020035 9E7_H4L1-1G6_H1.279_L1.194 Light Chain

SEQ ID NO: 24051 - protein, 214 aa, Artificial Sequence; identical to SEQ ID NO: 17350
  Description of Artificial Sequence: Synthetic polypeptide
  VL of XENP020035

SEQ ID NO: 24052 - protein, 11 aa, Artificial Sequence
  Description of Artificial Sequence: Synthetic peptide
  XENP020035 vlCDR1
RASENIYSNLA

SEQ ID NO: 24053 - protein, 7 aa, Artificial Sequence
  Description of Artificial Sequence: Synthetic peptide
  XENP020035 vlCDR2
AATTLAD

SEQ ID NO: 24054 - protein, 9 aa, Artificial Sequence
  Description of Artificial Sequence: Synthetic peptide
  XENP020035 vlCDR3
QHFWGTPWT

SEQ ID NO: 24055 - protein, 449 aa, Artificial Sequence; identical to SEQ ID NO: 17435
  Description of Artificial Sequence: Synthetic polypeptide
  XENP020036 4C8_H1L1-1G6_H1.279_L1.194 Fab-Fc Heavy Chain

SEQ ID NO: 24056 - protein, 120 aa, Artificial Sequence; identical to SEQ ID NO: 17436
  Description of Artificial Sequence: Synthetic polypeptide
  VH of XENP020036

SEQ ID NO: 24057 - protein, 5 aa, Artificial Sequence
  Description of Artificial Sequence: Synthetic peptide
  XENP020036 vhCDR1
DYNMH

SEQ ID NO: 24058 - protein, 17 aa, Artificial Sequence
  Description of Artificial Sequence: Synthetic peptide
  XENP020036 vhCDR2
YIYPYTGGTGYNQKFQG

SEQ ID NO: 24059 - protein, 11 aa, Artificial Sequence
  Description of Artificial Sequence: Synthetic peptide
  XENP020036 vhCDR3
SDDGYSYAMDY

SEQ ID NO: 24060 - protein, 480 aa, Artificial Sequence; identical to SEQ ID NO: 23401
  Description of Artificial Sequence: Synthetic polypeptide
  XENP020036 4C8_H1L1-1G6_H1.279_L1.194 scFv-Fc Heavy Chain

SEQ ID NO: 24061 - protein, 122 aa, Artificial Sequence; identical to SEQ ID NO: 10908
  Description of Artificial Sequence: Synthetic polypeptide
  VH of XENP020036

SEQ ID NO: 24062 - protein, 107 aa, Artificial Sequence; identical to SEQ ID NO: 10999
  Description of Artificial Sequence: Synthetic polypeptide
  VL of XENP020036

SEQ ID NO: 24063 - protein, 231 aa, Artificial Sequence; identical to SEQ ID NO: 21532
  Description of Artificial Sequence: Synthetic polypeptide
  Fc chain of XENP020036

SEQ ID NO: 24064 - protein, 5 aa, Artificial Sequence
  Description of Artificial Sequence: Synthetic peptide
  XENP020036 vhCDR1
NYWMN

SEQ ID NO: 24065 - protein, 19 aa, Artificial Sequence
  Description of Artificial Sequence: Synthetic peptide
  XENP020036 vhCDR2
EIRLYSNNYATHYAESVKG

SEQ ID NO: 24066 - protein, 11 aa, Artificial Sequence
  Description of Artificial Sequence: Synthetic peptide
  XENP020036 vhCDR3
YYGNYGGYFDV

SEQ ID NO: 24067 - protein, 11 aa, Artificial Sequence
  Description of Artificial Sequence: Synthetic peptide
  XENP020036 vlCDR1
RASQSVGNDVA

SEQ ID NO: 24068 - protein, 7 aa, Artificial Sequence
  Description of Artificial Sequence: Synthetic peptide
  XENP020036 vlCDR2
YASHRYT

SEQ ID NO: 24069 - protein, 9 aa, Artificial Sequence
  Description of Artificial Sequence: Synthetic peptide
  XENP020036 vlCDR3
QQDFSSPRT

SEQ ID NO: 24070 - protein, 213 aa, Artificial Sequence; identical to SEQ ID NO: 17440
  Description of Artificial Sequence: Synthetic polypeptide
  XENP020036 4C8_H1L1-1G6_H1.279_L1.194 Light Chain

SEQ ID NO: 24071 - protein, 213 aa, Artificial Sequence; identical to SEQ ID NO: 17440
  Description of Artificial Sequence: Synthetic polypeptide
  VL of XENP020036

SEQ ID NO: 24072 - protein, 11 aa, Artificial Sequence
  Description of Artificial Sequence: Synthetic peptide
  XENP020036 vlCDR1
QASQDISNYLN

SEQ ID NO: 24073 - protein, 7 aa, Artificial Sequence
  Description of Artificial Sequence: Synthetic peptide
  XENP020036 vlCDR2
YTSRLHS

SEQ ID NO: 24074 - protein, 8 aa, Artificial Sequence
  Description of Artificial Sequence: Synthetic peptide
  XENP020036 vlCDR3
QQGNTLWT

SEQ ID NO: 24075 - protein, 445 aa, Artificial Sequence; identical to SEQ ID NO: 17515
  Description of Artificial Sequence: Synthetic polypeptide
  XENP020037 7A6_H3L1-1G6_H1.279_L1.194 Fab-Fc Heavy Chain

SEQ ID NO: 24076 - protein, 116 aa, Artificial Sequence; identical to SEQ ID NO: 17516
  Description of Artificial Sequence: Synthetic polypeptide
  VH of XENP020037

SEQ ID NO: 24077 - protein, 6 aa, Artificial Sequence
  Description of Artificial Sequence: Synthetic peptide
  XENP020037 vhCDR1
SGYFWN

SEQ ID NO: 24078 - protein, 15 aa, Artificial Sequence
  Description of Artificial Sequence: Synthetic peptide
  XENP020037 vhCDR2
YISYDSNYYNPSVKS

SEQ ID NO: 24079 - protein, 8 aa, Artificial Sequence
  Description of Artificial Sequence: Synthetic peptide
  XENP020037 vhCDR3
GGITTFDY

SEQ ID NO: 24080 - protein, 480 aa, Artificial Sequence; identical to SEQ ID NO: 23401
  Description of Artificial Sequence: Synthetic polypeptide
  XENP020037 7A6_H3L1-1G6_H1.279_L1.194 scFv-Fc Heavy Chain

SEQ ID NO: 24081 - protein, 122 aa, Artificial Sequence; identical to SEQ ID NO: 10908
  Description of Artificial Sequence: Synthetic polypeptide
  VH of XENP020037

SEQ ID NO: 24082 - protein, 107 aa, Artificial Sequence; identical to SEQ ID NO: 10999
  Description of Artificial Sequence: Synthetic polypeptide
  VL of XENP020037

SEQ ID NO: 24083 - protein, 231 aa, Artificial Sequence; identical to SEQ ID NO: 21532
  Description of Artificial Sequence: Synthetic polypeptide
  Fc chain of XENP020037

SEQ ID NO: 24084 - protein, 5 aa, Artificial Sequence
  Description of Artificial Sequence: Synthetic peptide
  XENP020037 vhCDR1
NYWMN

SEQ ID NO: 24085 - protein, 19 aa, Artificial Sequence
  Description of Artificial Sequence: Synthetic peptide
  XENP020037 vhCDR2
EIRLYSNNYATHYAESVKG

SEQ ID NO: 24086 - protein, 11 aa, Artificial Sequence
  Description of Artificial Sequence: Synthetic peptide
  XENP020037 vhCDR3
YYGNYGGYFDV

SEQ ID NO: 24087 - protein, 11 aa, Artificial Sequence
  Description of Artificial Sequence: Synthetic peptide
  XENP020037 vlCDR1
RASQSVGNDVA

SEQ ID NO: 24088 - protein, 7 aa, Artificial Sequence
  Description of Artificial Sequence: Synthetic peptide
  XENP020037 vlCDR2
YASHRYT

SEQ ID NO: 24089 - protein, 9 aa, Artificial Sequence
  Description of Artificial Sequence: Synthetic peptide
  XENP020037 vlCDR3
QQDFSSPRT

SEQ ID NO: 24090 - protein, 218 aa, Artificial Sequence; identical to SEQ ID NO: 17460
  Description of Artificial Sequence: Synthetic polypeptide
  XENP020037 7A6_H3L1-1G6_H1.279_L1.194 Light Chain

SEQ ID NO: 24091 - protein, 218 aa, Artificial Sequence; identical to SEQ ID NO: 17460
  Description of Artificial Sequence: Synthetic polypeptide
  VL of XENP020037

SEQ ID NO: 24092 - protein, 15 aa, Artificial Sequence
  Description of Artificial Sequence: Synthetic peptide
  XENP020037 vlCDR1
RASQSVDYDGDSYMN

SEQ ID NO: 24093 - protein, 7 aa, Artificial Sequence
  Description of Artificial Sequence: Synthetic peptide
  XENP020037 vlCDR2
AASNLES

SEQ ID NO: 24094 - protein, 9 aa, Artificial Sequence
  Description of Artificial Sequence: Synthetic peptide
  XENP020037 vlCDR3
QQSNEDPRT

SEQ ID NO: 24095 - protein, 450 aa, Artificial Sequence; identical to SEQ ID NO: 17625
  Description of Artificial Sequence: Synthetic polypeptide
  XENP020038 7G8_H2L2-1G6_H1.279_L1.194 Fab-Fc Heavy Chain

SEQ ID NO: 24096 - protein, 121 aa, Artificial Sequence; identical to SEQ ID NO: 17626
  Description of Artificial Sequence: Synthetic polypeptide
  VH of XENP020038

SEQ ID NO: 24097 - protein, 5 aa, Artificial Sequence
  Description of Artificial Sequence: Synthetic peptide
  XENP020038 vhCDR1
DAWMD

SEQ ID NO: 24098 - protein, 19 aa, Artificial Sequence
  Description of Artificial Sequence: Synthetic peptide
  XENP020038 vhCDR2
EIRTKANNHATYYAESVKG

SEQ ID NO: 24099 - protein, 10 aa, Artificial Sequence
  Description of Artificial Sequence: Synthetic peptide
  XENP020038 vhCDR3
LANWDWYFDV

SEQ ID NO: 24100 - protein, 480 aa, Artificial Sequence; identical to SEQ ID NO: 23401
  Description of Artificial Sequence: Synthetic polypeptide
  XENP020038 7G8_H2L2-1G6_H1.279_L1.194 scFv-Fc Heavy Chain

SEQ ID NO: 24101 - protein, 122 aa, Artificial Sequence; identical to SEQ ID NO: 10908
  Description of Artificial Sequence: Synthetic polypeptide
  VH of XENP020038

SEQ ID NO: 24102 - protein, 107 aa, Artificial Sequence; identical to SEQ ID NO: 10999
  Description of Artificial Sequence: Synthetic polypeptide
  VL of XENP020038

SEQ ID NO: 24103 - protein, 231 aa, Artificial Sequence; identical to SEQ ID NO: 21532
  Description of Artificial Sequence: Synthetic polypeptide
  Fc chain of XENP020038

SEQ ID NO: 24104 - protein, 5 aa, Artificial Sequence
  Description of Artificial Sequence: Synthetic peptide
  XENP020038 vhCDR1
NYWMN

SEQ ID NO: 24105 - protein, 19 aa, Artificial Sequence
  Description of Artificial Sequence: Synthetic peptide
  XENP020038 vhCDR2
EIRLYSNNYATHYAESVKG

SEQ ID NO: 24106 - protein, 11 aa, Artificial Sequence
  Description of Artificial Sequence: Synthetic peptide
  XENP020038 vhCDR3
YYGNYGGYFDV

SEQ ID NO: 24107 - protein, 11 aa, Artificial Sequence
  Description of Artificial Sequence: Synthetic peptide
  XENP020038 vlCDR1
RASQSVGNDVA

SEQ ID NO: 24108 - protein, 7 aa, Artificial Sequence
  Description of Artificial Sequence: Synthetic peptide
  XENP020038 vlCDR2
YASHRYT

SEQ ID NO: 24109 - protein, 9 aa, Artificial Sequence
  Description of Artificial Sequence: Synthetic peptide
  XENP020038 vlCDR3
QQDFSSPRT

SEQ ID NO: 24110 - protein, 218 aa, Artificial Sequence; identical to SEQ ID NO: 17610
  Description of Artificial Sequence: Synthetic polypeptide
  XENP020038 7G8_H2L2-1G6_H1.279_L1.194 Light Chain

SEQ ID NO: 24111 - protein, 218 aa, Artificial Sequence; identical to SEQ ID NO: 17610
  Description of Artificial Sequence: Synthetic polypeptide
  VL of XENP020038

SEQ ID NO: 24112 - protein, 15 aa, Artificial Sequence
  Description of Artificial Sequence: Synthetic peptide
  XENP020038 vlCDR1
RASQSVDYDGDSYMN

SEQ ID NO: 24113 - protein, 7 aa, Artificial Sequence
  Description of Artificial Sequence: Synthetic peptide
  XENP020038 vlCDR2
AASNLES

SEQ ID NO: 24114 - protein, 9 aa, Artificial Sequence
  Description of Artificial Sequence: Synthetic peptide
  XENP020038 vlCDR3
QQSNEDPFT

SEQ ID NO: 24115 - protein, 447 aa, Artificial Sequence; identical to SEQ ID NO: 17235
  Description of Artificial Sequence: Synthetic polypeptide
  XENP020064 2A11_H1L2-1G6_H1.282_L1.194 Fab-Fc Heavy Chain

SEQ ID NO: 24116 - protein, 118 aa, Artificial Sequence; identical to SEQ ID NO: 17236
  Description of Artificial Sequence: Synthetic polypeptide
  VH of XENP020064

SEQ ID NO: 24117 - protein, 5 aa, Artificial Sequence
  Description of Artificial Sequence: Synthetic peptide
  XENP020064 vhCDR1
DYYMH

SEQ ID NO: 24118 - protein, 17 aa, Artificial Sequence
  Description of Artificial Sequence: Synthetic peptide
  XENP020064 vhCDR2
WIDPENGDTEYAPKFQG

SEQ ID NO: 24119 - protein, 9 aa, Artificial Sequence
  Description of Artificial Sequence: Synthetic peptide
  XENP020064 vhCDR3
RGVRQALDY

SEQ ID NO: 24120 - protein, 480 aa, Artificial Sequence; identical to SEQ ID NO: 23920
  Description of Artificial Sequence: Synthetic polypeptide
  XENP020064 2A11_H1L2-1G6_H1.282_L1.194 scFv-Fc Heavy Chain

SEQ ID NO: 24121 - protein, 122 aa, Artificial Sequence; identical to SEQ ID NO: 10935
  Description of Artificial Sequence: Synthetic polypeptide
  VH of XENP020064

SEQ ID NO: 24122 - protein, 107 aa, Artificial Sequence; identical to SEQ ID NO: 10999
  Description of Artificial Sequence: Synthetic polypeptide
  VL of XENP020064

SEQ ID NO: 24123 - protein, 231 aa, Artificial Sequence; identical to SEQ ID NO: 21532
  Description of Artificial Sequence: Synthetic polypeptide
  Fc chain of XENP020064

SEQ ID NO: 24124 - protein, 5 aa, Artificial Sequence
  Description of Artificial Sequence: Synthetic peptide
  XENP020064 vhCDR1
NYWMN

SEQ ID NO: 24125 - protein, 19 aa, Artificial Sequence
  Description of Artificial Sequence: Synthetic peptide
  XENP020064 vhCDR2
EIRLYSNNYATHYAESVKG

SEQ ID NO: 24126 - protein, 11 aa, Artificial Sequence
  Description of Artificial Sequence: Synthetic peptide
  XENP020064 vhCDR3
YYGNYGGYFDV

SEQ ID NO: 24127 - protein, 11 aa, Artificial Sequence
  Description of Artificial Sequence: Synthetic peptide
  XENP020064 vlCDR1
RASQSVGNDVA

SEQ ID NO: 24128 - protein, 7 aa, Artificial Sequence
  Description of Artificial Sequence: Synthetic peptide
  XENP020064 vlCDR2
YASHRYT

SEQ ID NO: 24129 - protein, 9 aa, Artificial Sequence
  Description of Artificial Sequence: Synthetic peptide
  XENP020064 vlCDR3
QQDFSSPRT

SEQ ID NO: 24130 - protein, 214 aa, Artificial Sequence; identical to SEQ ID NO: 17250
  Description of Artificial Sequence: Synthetic polypeptide
  XENP020064 2A11_H1L2-1G6_H1.282_L1.194 Light Chain

SEQ ID NO: 24131 - protein, 214 aa, Artificial Sequence; identical to SEQ ID NO: 17250
  Description of Artificial Sequence: Synthetic polypeptide
  VL of XENP020064

SEQ ID NO: 24132 - protein, 11 aa, Artificial Sequence
  Description of Artificial Sequence: Synthetic peptide
  XENP020064 vlCDR1
QASQDIGNYLN

SEQ ID NO: 24133 - protein, 7 aa, Artificial Sequence
  Description of Artificial Sequence: Synthetic peptide
  XENP020064 vlCDR2
YTSRLHS

SEQ ID NO: 24134 - protein, 9 aa, Artificial Sequence
  Description of Artificial Sequence: Synthetic peptide
  XENP020064 vlCDR3
QQGNTLPYT

SEQ ID NO: 24135 - protein, 444 aa, Artificial Sequence; identical to SEQ ID NO: 17405
  Description of Artificial Sequence: Synthetic polypeptide
  XENP020065 9E7_H4L1-1G6_H1.282_L1.194 Fab-Fc Heavy Chain

SEQ ID NO: 24136 - protein, 115 aa, Artificial Sequence; identical to SEQ ID NO: 17406
  Description of Artificial Sequence: Synthetic polypeptide
  VH of XENP020065

SEQ ID NO: 24137 - protein, 5 aa, Artificial Sequence
  Description of Artificial Sequence: Synthetic peptide
  XENP020065 vhCDR1
RYGIH

SEQ ID NO: 24138 - protein, 15 aa, Artificial Sequence
  Description of Artificial Sequence: Synthetic peptide
  XENP020065 vhCDR2
VIWSGVTDYNPSFQG

SEQ ID NO: 24139 - protein, 8 aa, Artificial Sequence
  Description of Artificial Sequence: Synthetic peptide
  XENP020065 vhCDR3
PYYYAMDY

SEQ ID NO: 24140 - protein, 480 aa, Artificial Sequence; identical to SEQ ID NO: 23920
  Description of Artificial Sequence: Synthetic polypeptide
  XENP020065 9E7_H4L1-1G6_H1.282_L1.194 scFv-Fc Heavy Chain

SEQ ID NO: 24141 - protein, 122 aa, Artificial Sequence; identical to SEQ ID NO: 10935
  Description of Artificial Sequence: Synthetic polypeptide
  VH of XENP020065

SEQ ID NO: 24142 - protein, 107 aa, Artificial Sequence; identical to SEQ ID NO: 10999
  Description of Artificial Sequence: Synthetic polypeptide
  VL of XENP020065

SEQ ID NO: 24143 - protein, 231 aa, Artificial Sequence; identical to SEQ ID NO: 21532
  Description of Artificial Sequence: Synthetic polypeptide
  Fc chain of XENP020065

SEQ ID NO: 24144 - protein, 5 aa, Artificial Sequence
  Description of Artificial Sequence: Synthetic peptide
  XENP020065 vhCDR1
NYWMN

SEQ ID NO: 24145 - protein, 19 aa, Artificial Sequence
  Description of Artificial Sequence: Synthetic peptide
  XENP020065 vhCDR2
EIRLYSNNYATHYAESVKG

SEQ ID NO: 24146 - protein, 11 aa, Artificial Sequence
  Description of Artificial Sequence: Synthetic peptide
  XENP020065 vhCDR3
YYGNYGGYFDV

SEQ ID NO: 24147 - protein, 11 aa, Artificial Sequence
  Description of Artificial Sequence: Synthetic peptide
  XENP020065 vlCDR1
RASQSVGNDVA

SEQ ID NO: 24148 - protein, 7 aa, Artificial Sequence
  Description of Artificial Sequence: Synthetic peptide
  XENP020065 vlCDR2
YASHRYT

SEQ ID NO: 24149 - protein, 9 aa, Artificial Sequence
  Description of Artificial Sequence: Synthetic peptide
  XENP020065 vlCDR3
QQDFSSPRT

SEQ ID NO: 24150 - protein, 214 aa, Artificial Sequence; identical to SEQ ID NO: 17350
  Description of Artificial Sequence: Synthetic polypeptide
  XENP020065 9E7_H4L1-1G6_H1.282_L1.194 Light Chain

SEQ ID NO: 24151 - protein, 214 aa, Artificial Sequence; identical to SEQ ID NO: 17350
  Description of Artificial Sequence: Synthetic polypeptide
  VL of XENP020065

SEQ ID NO: 24152 - protein, 11 aa, Artificial Sequence
  Description of Artificial Sequence: Synthetic peptide
  XENP020065 vlCDR1
RASENIYSNLA

SEQ ID NO: 24153 - protein, 7 aa, Artificial Sequence
  Description of Artificial Sequence: Synthetic peptide
  XENP020065 vlCDR2
AATTLAD

SEQ ID NO: 24154 - protein, 9 aa, Artificial Sequence
  Description of Artificial Sequence: Synthetic peptide
  XENP020065 vlCDR3
QHFWGTPWT

SEQ ID NO: 24155 - protein, 447 aa, Artificial Sequence; identical to SEQ ID NO: 17235
  Description of Artificial Sequence: Synthetic polypeptide
  XENP020203 2A11_H1L0-1G6_H1.279_L1.194 Fab-Fc Heavy Chain

SEQ ID NO: 24156 - protein, 118 aa, Artificial Sequence; identical to SEQ ID NO: 17236
  Description of Artificial Sequence: Synthetic polypeptide
  VH of XENP020203

SEQ ID NO: 24157 - protein, 5 aa, Artificial Sequence
  Description of Artificial Sequence: Synthetic peptide
  XENP020203 vhCDR1
DYYMH

SEQ ID NO: 24158 - protein, 17 aa, Artificial Sequence
  Description of Artificial Sequence: Synthetic peptide
  XENP020203 vhCDR2
WIDPENGDTEYAPKFQG

SEQ ID NO: 24159 - protein, 9 aa, Artificial Sequence
  Description of Artificial Sequence: Synthetic peptide
  XENP020203 vhCDR3
RGVRQALDY

SEQ ID NO: 24160 - protein, 480 aa, Artificial Sequence; identical to SEQ ID NO: 23401
  Description of Artificial Sequence: Synthetic polypeptide
  XENP020203 2A11_H1L0-1G6_H1.279_L1.194 scFv-Fc Heavy Chain

SEQ ID NO: 24161 - protein, 122 aa, Artificial Sequence; identical to SEQ ID NO: 10908
  Description of Artificial Sequence: Synthetic polypeptide
  VH of XENP020203

SEQ ID NO: 24162 - protein, 107 aa, Artificial Sequence; identical to SEQ ID NO: 10999
  Description of Artificial Sequence: Synthetic polypeptide
  VL of XENP020203

SEQ ID NO: 24163 - protein, 231 aa, Artificial Sequence; identical to SEQ ID NO: 21532
  Description of Artificial Sequence: Synthetic polypeptide
  Fc chain of XENP020203

SEQ ID NO: 24164 - protein, 5 aa, Artificial Sequence
  Description of Artificial Sequence: Synthetic peptide
  XENP020203 vhCDR1
NYWMN

SEQ ID NO: 24165 - protein, 19 aa, Artificial Sequence
  Description of Artificial Sequence: Synthetic peptide
  XENP020203 vhCDR2
EIRLYSNNYATHYAESVKG

SEQ ID NO: 24166 - protein, 11 aa, Artificial Sequence
  Description of Artificial Sequence: Synthetic peptide
  XENP020203 vhCDR3
YYGNYGGYFDV

SEQ ID NO: 24167 - protein, 11 aa, Artificial Sequence
  Description of Artificial Sequence: Synthetic peptide
  XENP020203 vlCDR1
RASQSVGNDVA

SEQ ID NO: 24168 - protein, 7 aa, Artificial Sequence
  Description of Artificial Sequence: Synthetic peptide
  XENP020203 vlCDR2
YASHRYT

SEQ ID NO: 24169 - protein, 9 aa, Artificial Sequence
  Description of Artificial Sequence: Synthetic peptide
  XENP020203 vlCDR3
QQDFSSPRT

SEQ ID NO: 24170 - protein, 214 aa, Artificial Sequence; identical to SEQ ID NO: 17230
  Description of Artificial Sequence: Synthetic polypeptide
  XENP020203 2A11_H1L0-1G6_H1.279_L1.194 Light Chain

SEQ ID NO: 24171 - protein, 214 aa, Artificial Sequence; identical to SEQ ID NO: 17230
  Description of Artificial Sequence: Synthetic polypeptide
  VL of XENP020203

SEQ ID NO: 24172 - protein, 11 aa, Artificial Sequence
  Description of Artificial Sequence: Synthetic peptide
  XENP020203 vlCDR1
RASQDIGNYLN

SEQ ID NO: 24173 - protein, 7 aa, Artificial Sequence
  Description of Artificial Sequence: Synthetic peptide
  XENP020203 vlCDR2
YTSRLHS

SEQ ID NO: 24174 - protein, 9 aa, Artificial Sequence
  Description of Artificial Sequence: Synthetic peptide
  XENP020203 vlCDR3
QQGNTLPYT

SEQ ID NO: 24175 - protein, 447 aa, Artificial Sequence; identical to SEQ ID NO: 17235
  Description of Artificial Sequence: Synthetic polypeptide
  XENP020204 2A11_H1L1-1G6_H1.279_L1.194 Fab-Fc Heavy Chain

SEQ ID NO: 24176 - protein, 118 aa, Artificial Sequence; identical to SEQ ID NO: 17236
  Description of Artificial Sequence: Synthetic polypeptide
  VH of XENP020204

SEQ ID NO: 24177 - protein, 5 aa, Artificial Sequence
  Description of Artificial Sequence: Synthetic peptide
  XENP020204 vhCDR1
DYYMH

SEQ ID NO: 24178 - protein, 17 aa, Artificial Sequence
  Description of Artificial Sequence: Synthetic peptide
  XENP020204 vhCDR2
WIDPENGDTEYAPKFQG

SEQ ID NO: 24179 - protein, 9 aa, Artificial Sequence
  Description of Artificial Sequence: Synthetic peptide
  XENP020204 vhCDR3
RGVRQALDY

SEQ ID NO: 24180 - protein, 480 aa, Artificial Sequence; identical to SEQ ID NO: 23401
  Description of Artificial Sequence: Synthetic polypeptide
  XENP020204 2A11_H1L1-1G6_H1.279_L1.194 scFv-Fc Heavy Chain

SEQ ID NO: 24181 - protein, 122 aa, Artificial Sequence; identical to SEQ ID NO: 10908
  Description of Artificial Sequence: Synthetic polypeptide
  VH of XENP020204

SEQ ID NO: 24182 - protein, 107 aa, Artificial Sequence; identical to SEQ ID NO: 10999
  Description of Artificial Sequence: Synthetic polypeptide
  VL of XENP020204

SEQ ID NO: 24183 - protein, 231 aa, Artificial Sequence; identical to SEQ ID NO: 21532
  Description of Artificial Sequence: Synthetic polypeptide
  Fc chain of XENP020204

SEQ ID NO: 24184 - protein, 5 aa, Artificial Sequence
  Description of Artificial Sequence: Synthetic peptide
  XENP020204 vhCDR1
NYWMN

SEQ ID NO: 24185 - protein, 19 aa, Artificial Sequence
  Description of Artificial Sequence: Synthetic peptide
  XENP020204 vhCDR2
EIRLYSNNYATHYAESVKG

SEQ ID NO: 24186 - protein, 11 aa, Artificial Sequence
  Description of Artificial Sequence: Synthetic peptide
  XENP020204 vhCDR3
YYGNYGGYFDV

SEQ ID NO: 24187 - protein, 11 aa, Artificial Sequence
  Description of Artificial Sequence: Synthetic peptide
  XENP020204 vlCDR1
RASQSVGNDVA

SEQ ID NO: 24188 - protein, 7 aa, Artificial Sequence
  Description of Artificial Sequence: Synthetic peptide
  XENP020204 vlCDR2
YASHRYT

SEQ ID NO: 24189 - protein, 9 aa, Artificial Sequence
  Description of Artificial Sequence: Synthetic peptide
  XENP020204 vlCDR3
QQDFSSPRT

SEQ ID NO: 24190 - protein, 214 aa, Artificial Sequence; identical to SEQ ID NO: 17240
  Description of Artificial Sequence: Synthetic polypeptide
  XENP020204 2A11_H1L1-1G6_H1.279_L1.194 Light Chain

SEQ ID NO: 24191 - protein, 214 aa, Artificial Sequence; identical to SEQ ID NO: 17240
  Description of Artificial Sequence: Synthetic polypeptide
  VL of XENP020204

SEQ ID NO: 24192 - protein, 11 aa, Artificial Sequence
  Description of Artificial Sequence: Synthetic peptide
  XENP020204 vlCDR1
RASQDIGNYLN

SEQ ID NO: 24193 - protein, 7 aa, Artificial Sequence
  Description of Artificial Sequence: Synthetic peptide
  XENP020204 vlCDR2
YTSRLHS

SEQ ID NO: 24194 - protein, 9 aa, Artificial Sequence
  Description of Artificial Sequence: Synthetic peptide
  XENP020204 vlCDR3
QQGNTLPYT

SEQ ID NO: 24195 - protein, 447 aa, Artificial Sequence; identical to SEQ ID NO: 17235
  Description of Artificial Sequence: Synthetic polypeptide
  XENP020205 2A11_H1_25F7_L0-1G6_H1.279_L1.194 Fab-Fc Heavy Chain

SEQ ID NO: 24196 - protein, 118 aa, Artificial Sequence; identical to SEQ ID NO: 17236
  Description of Artificial Sequence: Synthetic polypeptide
  VH of XENP020205

SEQ ID NO: 24197 - protein, 5 aa, Artificial Sequence
  Description of Artificial Sequence: Synthetic peptide
  XENP020205 vhCDR1
DYYMH

SEQ ID NO: 24198 - protein, 17 aa, Artificial Sequence
  Description of Artificial Sequence: Synthetic peptide
  XENP020205 vhCDR2
WIDPENGDTEYAPKFQG

SEQ ID NO: 24199 - protein, 9 aa, Artificial Sequence
  Description of Artificial Sequence: Synthetic peptide
  XENP020205 vhCDR3
RGVRQALDY

SEQ ID NO: 24200 - protein, 480 aa, Artificial Sequence; identical to SEQ ID NO: 23401
  Description of Artificial Sequence: Synthetic polypeptide
  XENP020205 2A11_H1_25F7_L0-1G6_H1.279_L1.194 scFv-Fc Heavy Chain

SEQ ID NO: 24201 - protein, 122 aa, Artificial Sequence; identical to SEQ ID NO: 10908
  Description of Artificial Sequence: Synthetic polypeptide
  VH of XENP020205

SEQ ID NO: 24202 - protein, 107 aa, Artificial Sequence; identical to SEQ ID NO: 10999
  Description of Artificial Sequence: Synthetic polypeptide
  VL of XENP020205

SEQ ID NO: 24203 - protein, 231 aa, Artificial Sequence; identical to SEQ ID NO: 21532
  Description of Artificial Sequence: Synthetic polypeptide
  Fc chain of XENP020205

SEQ ID NO: 24204 - protein, 5 aa, Artificial Sequence
  Description of Artificial Sequence: Synthetic peptide
  XENP020205 vhCDR1
NYWMN

SEQ ID NO: 24205 - protein, 19 aa, Artificial Sequence
  Description of Artificial Sequence: Synthetic peptide
  XENP020205 vhCDR2
EIRLYSNNYATHYAESVKG

SEQ ID NO: 24206 - protein, 11 aa, Artificial Sequence
  Description of Artificial Sequence: Synthetic peptide
  XENP020205 vhCDR3
YYGNYGGYFDV

SEQ ID NO: 24207 - protein, 11 aa, Artificial Sequence
  Description of Artificial Sequence: Synthetic peptide
  XENP020205 vlCDR1
RASQSVGNDVA

SEQ ID NO: 24208 - protein, 7 aa, Artificial Sequence
  Description of Artificial Sequence: Synthetic peptide
  XENP020205 vlCDR2
YASHRYT

SEQ ID NO: 24209 - protein, 9 aa, Artificial Sequence
  Description of Artificial Sequence: Synthetic peptide
  XENP020205 vlCDR3
QQDFSSPRT

SEQ ID NO: 24210 - protein, 214 aa, Artificial Sequence; identical to SEQ ID NO: 17140
  Description of Artificial Sequence: Synthetic polypeptide
  XENP020205 2A11_H1_25F7_L0-1G6_H1.279_L1.194 Light Chain

SEQ ID NO: 24211 - protein, 214 aa, Artificial Sequence; identical to SEQ ID NO: 17140
  Description of Artificial Sequence: Synthetic polypeptide
  VL of XENP020205

SEQ ID NO: 24212 - protein, 11 aa, Artificial Sequence
  Description of Artificial Sequence: Synthetic peptide
  XENP020205 vlCDR1
RASQSISSYLA

SEQ ID NO: 24213 - protein, 7 aa, Artificial Sequence
  Description of Artificial Sequence: Synthetic peptide
  XENP020205 vlCDR2
DASNRAT

SEQ ID NO: 24214 - protein, 9 aa, Artificial Sequence
  Description of Artificial Sequence: Synthetic peptide
  XENP020205 vlCDR3
QQRSNWPLT

SEQ ID NO: 24215 - protein, 447 aa, Artificial Sequence; identical to SEQ ID NO: 17235
  Description of Artificial Sequence: Synthetic polypeptide
  XENP020206 2A11_H1L2-1G6_L1.194_H1.279 Fab-Fc Heavy Chain

SEQ ID NO: 24216 - protein, 118 aa, Artificial Sequence; identical to SEQ ID NO: 17236
  Description of Artificial Sequence: Synthetic polypeptide
  VH of XENP020206

SEQ ID NO: 24217 - protein, 5 aa, Artificial Sequence
  Description of Artificial Sequence: Synthetic peptide
  XENP020206 vhCDR1
DYYMH

SEQ ID NO: 24218 - protein, 17 aa, Artificial Sequence
  Description of Artificial Sequence: Synthetic peptide
  XENP020206 vhCDR2
WIDPENGDTEYAPKFQG

SEQ ID NO: 24219 - protein, 9 aa, Artificial Sequence
  Description of Artificial Sequence: Synthetic peptide
  XENP020206 vhCDR3
RGVRQALDY

SEQ ID NO: 24220 - protein, 480 aa, Artificial Sequence; identical to SEQ ID NO: 23221
  Description of Artificial Sequence: Synthetic polypeptide
  XENP020206 2A11_H1L2-1G6_L1.194_H1.279 scFv-Fc Heavy Chain

SEQ ID NO: 24221 - protein, 107 aa, Artificial Sequence; identical to SEQ ID NO: 10999
  Description of Artificial Sequence: Synthetic polypeptide
  VH of XENP020206

SEQ ID NO: 24222 - protein, 122 aa, Artificial Sequence; identical to SEQ ID NO: 10908
  Description of Artificial Sequence: Synthetic polypeptide
  VL of XENP020206

SEQ ID NO: 24223 - protein, 231 aa, Artificial Sequence; identical to SEQ ID NO: 21532
  Description of Artificial Sequence: Synthetic polypeptide
  Fc chain of XENP020206

SEQ ID NO: 24224 - protein, 11 aa, Artificial Sequence
  Description of Artificial Sequence: Synthetic peptide
  XENP020206 vhCDR1
RASQSVGNDVA

SEQ ID NO: 24225 - protein, 7 aa, Artificial Sequence
  Description of Artificial Sequence: Synthetic peptide
  XENP020206 vhCDR2
YASHRYT

SEQ ID NO: 24226 - protein, 9 aa, Artificial Sequence
  Description of Artificial Sequence: Synthetic peptide
  XENP020206 vhCDR3
QQDFSSPRT

SEQ ID NO: 24227 - protein, 5 aa, Artificial Sequence
  Description of Artificial Sequence: Synthetic peptide
  XENP020206 vlCDR1
NYWMN

SEQ ID NO: 24228 - protein, 19 aa, Artificial Sequence
  Description of Artificial Sequence: Synthetic peptide
  XENP020206 vlCDR2
EIRLYSNNYATHYAESVKG

SEQ ID NO: 24229 - protein, 11 aa, Artificial Sequence
  Description of Artificial Sequence: Synthetic peptide
  XENP020206 vlCDR3
YYGNYGGYFDV

SEQ ID NO: 24230 - protein, 214 aa, Artificial Sequence; identical to SEQ ID NO: 17250
  Description of Artificial Sequence: Synthetic polypeptide
  XENP020206 2A11_H1L2-1G6_L1.194_H1.279 Light Chain

SEQ ID NO: 24231 - protein, 214 aa, Artificial Sequence; identical to SEQ ID NO: 17250
  Description of Artificial Sequence: Synthetic polypeptide
  VL of XENP020206

SEQ ID NO: 24232 - protein, 11 aa, Artificial Sequence
  Description of Artificial Sequence: Synthetic peptide
  XENP020206 vlCDR1
QASQDIGNYLN

SEQ ID NO: 24233 - protein, 7 aa, Artificial Sequence
  Description of Artificial Sequence: Synthetic peptide
  XENP020206 vlCDR2
YTSRLHS

SEQ ID NO: 24234 - protein, 9 aa, Artificial Sequence
  Description of Artificial Sequence: Synthetic peptide
  XENP020206 vlCDR3
QQGNTLPYT

SEQ ID NO: 24235 - protein, 447 aa, Artificial Sequence; identical to SEQ ID NO: 17235
  Description of Artificial Sequence: Synthetic polypeptide
  XENP020207 2A11_H1L2-1G6_L1.210_H1.288 Fab-Fc Heavy Chain

SEQ ID NO: 24236 - protein, 118 aa, Artificial Sequence; identical to SEQ ID NO: 17236
  Description of Artificial Sequence: Synthetic polypeptide
  VH of XENP020207

SEQ ID NO: 24237 - protein, 5 aa, Artificial Sequence
  Description of Artificial Sequence: Synthetic peptide
  XENP020207 vhCDR1
DYYMH

SEQ ID NO: 24238 - protein, 17 aa, Artificial Sequence
  Description of Artificial Sequence: Synthetic peptide
  XENP020207 vhCDR2
WIDPENGDTEYAPKFQG

SEQ ID NO: 24239 - protein, 9 aa, Artificial Sequence
  Description of Artificial Sequence: Synthetic peptide
  XENP020207 vhCDR3
RGVRQALDY

SEQ ID NO: 24240 - protein, 480 aa, Artificial Sequence; identical to SEQ ID NO: 23381
  Description of Artificial Sequence: Synthetic polypeptide
  XENP020207 2A11_H1L2-1G6_L1.210_H1.288 scFv-Fc Heavy Chain

SEQ ID NO: 24241 - protein, 107 aa, Artificial Sequence; identical to SEQ ID NO: 11359
  Description of Artificial Sequence: Synthetic polypeptide
  VH of XENP020207

SEQ ID NO: 24242 - protein, 122 aa, Artificial Sequence; identical to SEQ ID NO: 11358
  Description of Artificial Sequence: Synthetic polypeptide
  VL of XENP020207

SEQ ID NO: 24243 - protein, 231 aa, Artificial Sequence; identical to SEQ ID NO: 21532
  Description of Artificial Sequence: Synthetic polypeptide
  Fc chain of XENP020207

SEQ ID NO: 24244 - protein, 11 aa, Artificial Sequence
  Description of Artificial Sequence: Synthetic peptide
  XENP020207 vhCDR1
RASQSVGNDVA

SEQ ID NO: 24245 - protein, 7 aa, Artificial Sequence
  Description of Artificial Sequence: Synthetic peptide
  XENP020207 vhCDR2
YASHRYT

SEQ ID NO: 24246 - protein, 9 aa, Artificial Sequence
  Description of Artificial Sequence: Synthetic peptide
  XENP020207 vhCDR3
QQDFSSPRT

SEQ ID NO: 24247 - protein, 5 aa, Artificial Sequence
  Description of Artificial Sequence: Synthetic peptide
  XENP020207 vlCDR1
NYWMN

SEQ ID NO: 24248 - protein, 19 aa, Artificial Sequence
  Description of Artificial Sequence: Synthetic peptide
  XENP020207 vlCDR2
EIRLYSNNYATHYAESVKG

SEQ ID NO: 24249 - protein, 11 aa, Artificial Sequence
  Description of Artificial Sequence: Synthetic peptide
  XENP020207 vlCDR3
YYGNYGGYFDV

SEQ ID NO: 24250 - protein, 214 aa, Artificial Sequence; identical to SEQ ID NO: 17250
  Description of Artificial Sequence: Synthetic polypeptide
  XENP020207 2A11_H1L2-1G6_L1.210_H1.288 Light Chain

SEQ ID NO: 24251 - protein, 214 aa, Artificial Sequence; identical to SEQ ID NO: 17250
  Description of Artificial Sequence: Synthetic polypeptide
  VL of XENP020207

SEQ ID NO: 24252 - protein, 11 aa, Artificial Sequence
  Description of Artificial Sequence: Synthetic peptide
  XENP020207 vlCDR1
QASQDIGNYLN

SEQ ID NO: 24253 - protein, 7 aa, Artificial Sequence
  Description of Artificial Sequence: Synthetic peptide
  XENP020207 vlCDR2
YTSRLHS

SEQ ID NO: 24254 - protein, 9 aa, Artificial Sequence
  Description of Artificial Sequence: Synthetic peptide
  XENP020207 vlCDR3
QQGNTLPYT

SEQ ID NO: 24255 - protein, 447 aa, Artificial Sequence; identical to SEQ ID NO: 17235
  Description of Artificial Sequence: Synthetic polypeptide
  XENP020208 2A11_H1L2-1G6_H1.288_L1.210 Fab-Fc Heavy Chain

SEQ ID NO: 24256 - protein, 118 aa, Artificial Sequence; identical to SEQ ID NO: 17236
  Description of Artificial Sequence: Synthetic polypeptide
  VH of XENP020208

SEQ ID NO: 24257 - protein, 5 aa, Artificial Sequence
  Description of Artificial Sequence: Synthetic peptide
  XENP020208 vhCDR1
DYYMH

SEQ ID NO: 24258 - protein, 17 aa, Artificial Sequence
  Description of Artificial Sequence: Synthetic peptide
  XENP020208 vhCDR2
WIDPENGDTEYAPKFQG

SEQ ID NO: 24259 - protein, 9 aa, Artificial Sequence
  Description of Artificial Sequence: Synthetic peptide
  XENP020208 vhCDR3
RGVRQALDY

SEQ ID NO: 24260 - protein, 480 aa, Artificial Sequence; identical to SEQ ID NO: 23860
  Description of Artificial Sequence: Synthetic polypeptide
  XENP020208 2A11_H1L2-1G6_H1.288_L1.210 scFv-Fc Heavy Chain

SEQ ID NO: 24261 - protein, 122 aa, Artificial Sequence; identical to SEQ ID NO: 11358
  Description of Artificial Sequence: Synthetic polypeptide
  VH of XENP020208

SEQ ID NO: 24262 - protein, 107 aa, Artificial Sequence; identical to SEQ ID NO: 11359
  Description of Artificial Sequence: Synthetic polypeptide
  VL of XENP020208

SEQ ID NO: 24263 - protein, 231 aa, Artificial Sequence; identical to SEQ ID NO: 21532
  Description of Artificial Sequence: Synthetic polypeptide
  Fc chain of XENP020208

SEQ ID NO: 24264 - protein, 5 aa, Artificial Sequence
  Description of Artificial Sequence: Synthetic peptide
  XENP020208 vhCDR1
NYWMN

SEQ ID NO: 24265 - protein, 19 aa, Artificial Sequence
  Description of Artificial Sequence: Synthetic peptide
  XENP020208 vhCDR2
EIRLYSNNYATHYAESVKG

SEQ ID NO: 24266 - protein, 11 aa, Artificial Sequence
  Description of Artificial Sequence: Synthetic peptide
  XENP020208 vhCDR3
YYGNYGGYFDV

SEQ ID NO: 24267 - protein, 11 aa, Artificial Sequence
  Description of Artificial Sequence: Synthetic peptide
  XENP020208 vlCDR1
RASQSVGNDVA

SEQ ID NO: 24268 - protein, 7 aa, Artificial Sequence
  Description of Artificial Sequence: Synthetic peptide
  XENP020208 vlCDR2
YASHRYT

SEQ ID NO: 24269 - protein, 9 aa, Artificial Sequence
  Description of Artificial Sequence: Synthetic peptide
  XENP020208 vlCDR3
QQDFSSPRT

SEQ ID NO: 24270 - protein, 214 aa, Artificial Sequence; identical to SEQ ID NO: 17250
  Description of Artificial Sequence: Synthetic polypeptide
  XENP020208 2A11_H1L2-1G6_H1.288_L1.210 Light Chain

SEQ ID NO: 24271 - protein, 214 aa, Artificial Sequence; identical to SEQ ID NO: 17250
  Description of Artificial Sequence: Synthetic polypeptide
  VL of XENP020208

SEQ ID NO: 24272 - protein, 11 aa, Artificial Sequence
  Description of Artificial Sequence: Synthetic peptide
  XENP020208 vlCDR1
QASQDIGNYLN

SEQ ID NO: 24273 - protein, 7 aa, Artificial Sequence
  Description of Artificial Sequence: Synthetic peptide
  XENP020208 vlCDR2
YTSRLHS

SEQ ID NO: 24274 - protein, 9 aa, Artificial Sequence
  Description of Artificial Sequence: Synthetic peptide
  XENP020208 vlCDR3
QQGNTLPYT

SEQ ID NO: 24275 - protein, 447 aa, Artificial Sequence; identical to SEQ ID NO: 17235
  Description of Artificial Sequence: Synthetic polypeptide
  XENP020034 2A11_H1L2_Fab-1G6_H1.279_L1.194 Fab-Fc Heavy Chain

SEQ ID NO: 24276 - protein, 118 aa, Artificial Sequence; identical to SEQ ID NO: 17236
  Description of Artificial Sequence: Synthetic polypeptide
  VH of XENP020034

SEQ ID NO: 24277 - protein, 5 aa, Artificial Sequence
  Description of Artificial Sequence: Synthetic peptide
  XENP020034 vhCDR1
DYYMH

SEQ ID NO: 24278 - protein, 17 aa, Artificial Sequence
  Description of Artificial Sequence: Synthetic peptide
  XENP020034 vhCDR2
WIDPENGDTEYAPKFQG

SEQ ID NO: 24279 - protein, 9 aa, Artificial Sequence
  Description of Artificial Sequence: Synthetic peptide
  XENP020034 vhCDR3
RGVRQALDY

SEQ ID NO: 24280 - protein, 480 aa, Artificial Sequence; identical to SEQ ID NO: 23401
  Description of Artificial Sequence: Synthetic polypeptide
  XENP020034 2A11_H1L2_Fab-1G6_H1.279_L1.194 scFv-Fc Heavy Chain

SEQ ID NO: 24281 - protein, 122 aa, Artificial Sequence; identical to SEQ ID NO: 10908
  Description of Artificial Sequence: Synthetic polypeptide
  VH of XENP020034

SEQ ID NO: 24282 - protein, 107 aa, Artificial Sequence; identical to SEQ ID NO: 10999
  Description of Artificial Sequence: Synthetic polypeptide
  VL of XENP020034

SEQ ID NO: 24283 - protein, 231 aa, Artificial Sequence; identical to SEQ ID NO: 21532
  Description of Artificial Sequence: Synthetic polypeptide
  Fc chain of XENP020034

SEQ ID NO: 24284 - protein, 5 aa, Artificial Sequence
  Description of Artificial Sequence: Synthetic peptide
  XENP020034 vhCDR1
NYWMN

SEQ ID NO: 24285 - protein, 19 aa, Artificial Sequence
  Description of Artificial Sequence: Synthetic peptide
  XENP020034 vhCDR2
EIRLYSNNYATHYAESVKG

SEQ ID NO: 24286 - protein, 11 aa, Artificial Sequence
  Description of Artificial Sequence: Synthetic peptide
  XENP020034 vhCDR3
YYGNYGGYFDV

SEQ ID NO: 24287 - protein, 11 aa, Artificial Sequence
  Description of Artificial Sequence: Synthetic peptide
  XENP020034 vlCDR1
RASQSVGNDVA

SEQ ID NO: 24288 - protein, 7 aa, Artificial Sequence
  Description of Artificial Sequence: Synthetic peptide
  XENP020034 vlCDR2
YASHRYT

SEQ ID NO: 24289 - protein, 9 aa, Artificial Sequence
  Description of Artificial Sequence: Synthetic peptide
  XENP020034 vlCDR3
QQDFSSPRT

SEQ ID NO: 24290 - protein, 214 aa, Artificial Sequence; identical to SEQ ID NO: 17250
  Description of Artificial Sequence: Synthetic polypeptide
  XENP020034 2A11_H1L2_Fab-1G6_H1.279_L1.194 Light Chain

SEQ ID NO: 24291 - protein, 107 aa, Artificial Sequence; identical to SEQ ID NO: 17251
  Description of Artificial Sequence: Synthetic polypeptide
  VL of XENP020034

SEQ ID NO: 24292 - protein, 11 aa, Artificial Sequence
  Description of Artificial Sequence: Synthetic peptide
  XENP020034 vlCDR1
QASQDIGNYLN

SEQ ID NO: 24293 - protein, 7 aa, Artificial Sequence
  Description of Artificial Sequence: Synthetic peptide
  XENP020034 vlCDR2
YTSRLHS

SEQ ID NO: 24294 - protein, 9 aa, Artificial Sequence
  Description of Artificial Sequence: Synthetic peptide
  XENP020034 vlCDR3
QQGNTLPYT

SEQ ID NO: 24295 - protein, 447 aa, Artificial Sequence; identical to SEQ ID NO: 17235
  Description of Artificial Sequence: Synthetic polypeptide
  XENP020064 2A11_H1L2_Fab-1G6_H1.282_L1.194 Fab-Fc Heavy Chain

SEQ ID NO: 24296 - protein, 118 aa, Artificial Sequence; identical to SEQ ID NO: 17236
  Description of Artificial Sequence: Synthetic polypeptide
  VH of XENP020064

SEQ ID NO: 24297 - protein, 5 aa, Artificial Sequence
  Description of Artificial Sequence: Synthetic peptide
  XENP020064 vhCDR1
DYYMH

SEQ ID NO: 24298 - protein, 17 aa, Artificial Sequence
  Description of Artificial Sequence: Synthetic peptide
  XENP020064 vhCDR2
WIDPENGDTEYAPKFQG

SEQ ID NO: 24299 - protein, 9 aa, Artificial Sequence
  Description of Artificial Sequence: Synthetic peptide
  XENP020064 vhCDR3
RGVRQALDY

SEQ ID NO: 24300 - protein, 480 aa, Artificial Sequence; identical to SEQ ID NO: 23920
  Description of Artificial Sequence: Synthetic polypeptide
  XENP020064 2A11_H1L2_Fab-1G6_H1.282_L1.194 scFv-Fc Heavy Chain

SEQ ID NO: 24301 - protein, 122 aa, Artificial Sequence; identical to SEQ ID NO: 10935
  Description of Artificial Sequence: Synthetic polypeptide
  VH of XENP020064

SEQ ID NO: 24302 - protein, 107 aa, Artificial Sequence; identical to SEQ ID NO: 10999
  Description of Artificial Sequence: Synthetic polypeptide
  VL of XENP020064

SEQ ID NO: 24303 - protein, 231 aa, Artificial Sequence; identical to SEQ ID NO: 21532
  Description of Artificial Sequence: Synthetic polypeptide
  Fc chain of XENP020064

SEQ ID NO: 24304 - protein, 5 aa, Artificial Sequence
  Description of Artificial Sequence: Synthetic peptide
  XENP020064 vhCDR1
NYWMN

SEQ ID NO: 24305 - protein, 19 aa, Artificial Sequence
  Description of Artificial Sequence: Synthetic peptide
  XENP020064 vhCDR2
EIRLYSNNYATHYAESVKG

SEQ ID NO: 24306 - protein, 11 aa, Artificial Sequence
  Description of Artificial Sequence: Synthetic peptide
  XENP020064 vhCDR3
YYGNYGGYFDV

SEQ ID NO: 24307 - protein, 11 aa, Artificial Sequence
  Description of Artificial Sequence: Synthetic peptide
  XENP020064 vlCDR1
RASQSVGNDVA

SEQ ID NO: 24308 - protein, 7 aa, Artificial Sequence
  Description of Artificial Sequence: Synthetic peptide
  XENP020064 vlCDR2
YASHRYT

SEQ ID NO: 24309 - protein, 9 aa, Artificial Sequence
  Description of Artificial Sequence: Synthetic peptide
  XENP020064 vlCDR3
QQDFSSPRT

SEQ ID NO: 24310 - protein, 214 aa, Artificial Sequence; identical to SEQ ID NO: 17250
  Description of Artificial Sequence: Synthetic polypeptide
  XENP020064 2A11_H1L2_Fab-1G6_H1.282_L1.194 Light Chain

SEQ ID NO: 24311 - protein, 107 aa, Artificial Sequence; identical to SEQ ID NO: 17251
  Description of Artificial Sequence: Synthetic polypeptide
  VL of XENP020064

SEQ ID NO: 24312 - protein, 11 aa, Artificial Sequence
  Description of Artificial Sequence: Synthetic peptide
  XENP020064 vlCDR1
QASQDIGNYLN

SEQ ID NO: 24313 - protein, 7 aa, Artificial Sequence
  Description of Artificial Sequence: Synthetic peptide
  XENP020064 vlCDR2
YTSRLHS

SEQ ID NO: 24314 - protein, 9 aa, Artificial Sequence
  Description of Artificial Sequence: Synthetic peptide
  XENP020064 vlCDR3
QQGNTLPYT

SEQ ID NO: 24315 - protein, 447 aa, Artificial Sequence; identical to SEQ ID NO: 17235
  Description of Artificial Sequence: Synthetic polypeptide
  XENP020203 2A11_H1L0_Fab-1G6_H1.279_L1.194 Fab-Fc Heavy Chain

SEQ ID NO: 24316 - protein, 118 aa, Artificial Sequence; identical to SEQ ID NO: 17236
  Description of Artificial Sequence: Synthetic polypeptide
  VH of XENP020203

SEQ ID NO: 24317 - protein, 5 aa, Artificial Sequence
  Description of Artificial Sequence: Synthetic peptide
  XENP020203 vhCDR1
DYYMH

SEQ ID NO: 24318 - protein, 17 aa, Artificial Sequence
  Description of Artificial Sequence: Synthetic peptide
  XENP020203 vhCDR2
WIDPENGDTEYAPKFQG

SEQ ID NO: 24319 - protein, 9 aa, Artificial Sequence
  Description of Artificial Sequence: Synthetic peptide
  XENP020203 vhCDR3
RGVRQALDY

SEQ ID NO: 24320 - protein, 480 aa, Artificial Sequence; identical to SEQ ID NO: 23401
  Description of Artificial Sequence: Synthetic polypeptide
  XENP020203 2A11_H1L0_Fab-1G6_H1.279_L1.194 scFv-Fc Heavy Chain

SEQ ID NO: 24321 - protein, 122 aa, Artificial Sequence; identical to SEQ ID NO: 10908
  Description of Artificial Sequence: Synthetic polypeptide
  VH of XENP020203

SEQ ID NO: 24322 - protein, 107 aa, Artificial Sequence; identical to SEQ ID NO: 10999
  Description of Artificial Sequence: Synthetic polypeptide
  VL of XENP020203

SEQ ID NO: 24323 - protein, 231 aa, Artificial Sequence; identical to SEQ ID NO: 21532
  Description of Artificial Sequence: Synthetic polypeptide
  Fc chain of XENP020203

SEQ ID NO: 24324 - protein, 5 aa, Artificial Sequence
  Description of Artificial Sequence: Synthetic peptide
  XENP020203 vhCDR1
NYWMN

SEQ ID NO: 24325 - protein, 19 aa, Artificial Sequence
  Description of Artificial Sequence: Synthetic peptide
  XENP020203 vhCDR2
EIRLYSNNYATHYAESVKG

SEQ ID NO: 24326 - protein, 11 aa, Artificial Sequence
  Description of Artificial Sequence: Synthetic peptide
  XENP020203 vhCDR3
YYGNYGGYFDV

SEQ ID NO: 24327 - protein, 11 aa, Artificial Sequence
  Description of Artificial Sequence: Synthetic peptide
  XENP020203 vlCDR1
RASQSVGNDVA

SEQ ID NO: 24328 - protein, 7 aa, Artificial Sequence
  Description of Artificial Sequence: Synthetic peptide
  XENP020203 vlCDR2
YASHRYT

SEQ ID NO: 24329 - protein, 9 aa, Artificial Sequence
  Description of Artificial Sequence: Synthetic peptide
  XENP020203 vlCDR3
QQDFSSPRT

SEQ ID NO: 24330 - protein, 214 aa, Artificial Sequence; identical to SEQ ID NO: 17230
  Description of Artificial Sequence: Synthetic polypeptide
  XENP020203 2A11_H1L0_Fab-1G6_H1.279_L1.194 Light Chain

SEQ ID NO: 24331 - protein, 107 aa, Artificial Sequence; identical to SEQ ID NO: 17231
  Description of Artificial Sequence: Synthetic polypeptide
  VL of XENP020203

SEQ ID NO: 24332 - protein, 11 aa, Artificial Sequence
  Description of Artificial Sequence: Synthetic peptide
  XENP020203 vlCDR1
RASQDIGNYLN

SEQ ID NO: 24333 - protein, 7 aa, Artificial Sequence
  Description of Artificial Sequence: Synthetic peptide
  XENP020203 vlCDR2
YTSRLHS

SEQ ID NO: 24334 - protein, 9 aa, Artificial Sequence
  Description of Artificial Sequence: Synthetic peptide
  XENP020203 vlCDR3
QQGNTLPYT

SEQ ID NO: 24335 - protein, 447 aa, Artificial Sequence; identical to SEQ ID NO: 17235
  Description of Artificial Sequence: Synthetic polypeptide
  XENP020204 2A11_H1L1_Fab-1G6_H1.279_L1.194 Fab-Fc Heavy Chain

SEQ ID NO: 24336 - protein, 118 aa, Artificial Sequence; identical to SEQ ID NO: 17236
  Description of Artificial Sequence: Synthetic polypeptide
  VH of XENP020204

SEQ ID NO: 24337 - protein, 5 aa, Artificial Sequence
  Description of Artificial Sequence: Synthetic peptide
  XENP020204 vhCDR1
DYYMH

SEQ ID NO: 24338 - protein, 17 aa, Artificial Sequence
  Description of Artificial Sequence: Synthetic peptide
  XENP020204 vhCDR2
WIDPENGDTEYAPKFQG

SEQ ID NO: 24339 - protein, 9 aa, Artificial Sequence
  Description of Artificial Sequence: Synthetic peptide
  XENP020204 vhCDR3
RGVRQALDY

SEQ ID NO: 24340 - protein, 480 aa, Artificial Sequence; identical to SEQ ID NO: 23401
  Description of Artificial Sequence: Synthetic polypeptide
  XENP020204 2A11_H1L1_Fab-1G6_H1.279_L1.194 scFv-Fc Heavy Chain

SEQ ID NO: 24341 - protein, 122 aa, Artificial Sequence; identical to SEQ ID NO: 10908
  Description of Artificial Sequence: Synthetic polypeptide
  VH of XENP020204

SEQ ID NO: 24342 - protein, 107 aa, Artificial Sequence; identical to SEQ ID NO: 10999
  Description of Artificial Sequence: Synthetic polypeptide
  VL of XENP020204

SEQ ID NO: 24343 - protein, 231 aa, Artificial Sequence; identical to SEQ ID NO: 21532
  Description of Artificial Sequence: Synthetic polypeptide
  Fc chain of XENP020204

SEQ ID NO: 24344 - protein, 5 aa, Artificial Sequence
  Description of Artificial Sequence: Synthetic peptide
  XENP020204 vhCDR1
NYWMN

SEQ ID NO: 24345 - protein, 19 aa, Artificial Sequence
  Description of Artificial Sequence: Synthetic peptide
  XENP020204 vhCDR2
EIRLYSNNYATHYAESVKG

SEQ ID NO: 24346 - protein, 11 aa, Artificial Sequence
  Description of Artificial Sequence: Synthetic peptide
  XENP020204 vhCDR3
YYGNYGGYFDV

SEQ ID NO: 24347 - protein, 11 aa, Artificial Sequence
  Description of Artificial Sequence: Synthetic peptide
  XENP020204 vlCDR1
RASQSVGNDVA

SEQ ID NO: 24348 - protein, 7 aa, Artificial Sequence
  Description of Artificial Sequence: Synthetic peptide
  XENP020204 vlCDR2
YASHRYT

SEQ ID NO: 24349 - protein, 9 aa, Artificial Sequence
  Description of Artificial Sequence: Synthetic peptide
  XENP020204 vlCDR3
QQDFSSPRT

SEQ ID NO: 24350 - protein, 214 aa, Artificial Sequence; identical to SEQ ID NO: 17240
  Description of Artificial Sequence: Synthetic polypeptide
  XENP020204 2A11_H1L1_Fab-1G6_H1.279_L1.194 Light Chain

SEQ ID NO: 24351 - protein, 107 aa, Artificial Sequence; identical to SEQ ID NO: 17241
  Description of Artificial Sequence: Synthetic polypeptide
  VL of XENP020204

SEQ ID NO: 24352 - protein, 11 aa, Artificial Sequence
  Description of Artificial Sequence: Synthetic peptide
  XENP020204 vlCDR1
RASQDIGNYLN

SEQ ID NO: 24353 - protein, 7 aa, Artificial Sequence
  Description of Artificial Sequence: Synthetic peptide
  XENP020204 vlCDR2
YTSRLHS

SEQ ID NO: 24354 - protein, 9 aa, Artificial Sequence
  Description of Artificial Sequence: Synthetic peptide
  XENP020204 vlCDR3
QQGNTLPYT

SEQ ID NO: 24355 - protein, 447 aa, Artificial Sequence; identical to SEQ ID NO: 17235
  Description of Artificial Sequence: Synthetic polypeptide
  XENP020206 2A11_H1L2_Fab-1G6_L1.194_H1.279 Fab-Fc Heavy Chain

SEQ ID NO: 24356 - protein, 118 aa, Artificial Sequence; identical to SEQ ID NO: 17236
  Description of Artificial Sequence: Synthetic polypeptide
  VH of XENP020206

SEQ ID NO: 24357 - protein, 5 aa, Artificial Sequence
  Description of Artificial Sequence: Synthetic peptide
  XENP020206 vhCDR1
DYYMH

SEQ ID NO: 24358 - protein, 17 aa, Artificial Sequence
  Description of Artificial Sequence: Synthetic peptide
  XENP020206 vhCDR2
WIDPENGDTEYAPKFQG

SEQ ID NO: 24359 - protein, 9 aa, Artificial Sequence
  Description of Artificial Sequence: Synthetic peptide
  XENP020206 vhCDR3
RGVRQALDY

SEQ ID NO: 24360 - protein, 480 aa, Artificial Sequence; identical to SEQ ID NO: 23221
  Description of Artificial Sequence: Synthetic polypeptide
  XENP020206 2A11_H1L2_Fab-1G6_L1.194_H1.279 scFv-Fc Heavy Chain

SEQ ID NO: 24361 - protein, 107 aa, Artificial Sequence; identical to SEQ ID NO: 10999
  Description of Artificial Sequence: Synthetic polypeptide
  VH of XENP020206

SEQ ID NO: 24362 - protein, 122 aa, Artificial Sequence; identical to SEQ ID NO: 10908
  Description of Artificial Sequence: Synthetic polypeptide
  VL of XENP020206

SEQ ID NO: 24363 - protein, 231 aa, Artificial Sequence; identical to SEQ ID NO: 21532
  Description of Artificial Sequence: Synthetic polypeptide
  Fc chain of XENP020206

SEQ ID NO: 24364 - protein, 11 aa, Artificial Sequence
  Description of Artificial Sequence: Synthetic peptide
  XENP020206 vhCDR1
RASQSVGNDVA

SEQ ID NO: 24365 - protein, 7 aa, Artificial Sequence
  Description of Artificial Sequence: Synthetic peptide
  XENP020206 vhCDR2
YASHRYT

SEQ ID NO: 24366 - protein, 9 aa, Artificial Sequence
  Description of Artificial Sequence: Synthetic peptide
  XENP020206 vhCDR3
QQDFSSPRT

SEQ ID NO: 24367 - protein, 5 aa, Artificial Sequence
  Description of Artificial Sequence: Synthetic peptide
  XENP020206 vlCDR1
NYWMN

SEQ ID NO: 24368 - protein, 19 aa, Artificial Sequence
  Description of Artificial Sequence: Synthetic peptide
  XENP020206 vlCDR2
EIRLYSNNYATHYAESVKG

SEQ ID NO: 24369 - protein, 11 aa, Artificial Sequence
  Description of Artificial Sequence: Synthetic peptide
  XENP020206 vlCDR3
YYGNYGGYFDV

SEQ ID NO: 24370 - protein, 214 aa, Artificial Sequence; identical to SEQ ID NO: 17250
  Description of Artificial Sequence: Synthetic polypeptide
  XENP020206 2A11_H1L2_Fab-1G6_L1.194_H1.279 Light Chain

SEQ ID NO: 24371 - protein, 107 aa, Artificial Sequence; identical to SEQ ID NO: 17251
  Description of Artificial Sequence: Synthetic polypeptide
  VL of XENP020206

SEQ ID NO: 24372 - protein, 11 aa, Artificial Sequence
  Description of Artificial Sequence: Synthetic peptide
  XENP020206 vlCDR1
QASQDIGNYLN

SEQ ID NO: 24373 - protein, 7 aa, Artificial Sequence
  Description of Artificial Sequence: Synthetic peptide
  XENP020206 vlCDR2
YTSRLHS

SEQ ID NO: 24374 - protein, 9 aa, Artificial Sequence
  Description of Artificial Sequence: Synthetic peptide
  XENP020206 vlCDR3
QQGNTLPYT

SEQ ID NO: 24375 - protein, 447 aa, Artificial Sequence; identical to SEQ ID NO: 17235
  Description of Artificial Sequence: Synthetic polypeptide
  XENP020207 2A11_H1L2_Fab-1G6_L1.210_H1.288 Fab-Fc Heavy Chain

SEQ ID NO: 24376 - protein, 118 aa, Artificial Sequence; identical to SEQ ID NO: 17236
  Description of Artificial Sequence: Synthetic polypeptide
  VH of XENP020207

SEQ ID NO: 24377 - protein, 5 aa, Artificial Sequence
  Description of Artificial Sequence: Synthetic peptide
  XENP020207 vhCDR1
DYYMH

SEQ ID NO: 24378 - protein, 17 aa, Artificial Sequence
  Description of Artificial Sequence: Synthetic peptide
  XENP020207 vhCDR2
WIDPENGDTEYAPKFQG

SEQ ID NO: 24379 - protein, 9 aa, Artificial Sequence
  Description of Artificial Sequence: Synthetic peptide
  XENP020207 vhCDR3
RGVRQALDY

SEQ ID NO: 24380 - protein, 480 aa, Artificial Sequence; identical to SEQ ID NO: 23381
  Description of Artificial Sequence: Synthetic polypeptide
  XENP020207 2A11_H1L2_Fab-1G6_L1.210_H1.288 scFv-Fc Heavy Chain

SEQ ID NO: 24381 - protein, 107 aa, Artificial Sequence; identical to SEQ ID NO: 11359
  Description of Artificial Sequence: Synthetic polypeptide
  VH of XENP020207

SEQ ID NO: 24382 - protein, 122 aa, Artificial Sequence; identical to SEQ ID NO: 11358
  Description of Artificial Sequence: Synthetic polypeptide
  VL of XENP020207

SEQ ID NO: 24383 - protein, 231 aa, Artificial Sequence; identical to SEQ ID NO: 21532
  Description of Artificial Sequence: Synthetic polypeptide
  Fc chain of XENP020207

SEQ ID NO: 24384 - protein, 11 aa, Artificial Sequence
  Description of Artificial Sequence: Synthetic peptide
  XENP020207 vhCDR1
RASQSVGNDVA

SEQ ID NO: 24385 - protein, 7 aa, Artificial Sequence
  Description of Artificial Sequence: Synthetic peptide
  XENP020207 vhCDR2
YASHRYT

SEQ ID NO: 24386 - protein, 9 aa, Artificial Sequence
  Description of Artificial Sequence: Synthetic peptide
  XENP020207 vhCDR3
QQDFSSPRT

SEQ ID NO: 24387 - protein, 5 aa, Artificial Sequence
  Description of Artificial Sequence: Synthetic peptide
  XENP020207 vlCDR1
NYWMN

SEQ ID NO: 24388 - protein, 19 aa, Artificial Sequence
  Description of Artificial Sequence: Synthetic peptide
  XENP020207 vlCDR2
EIRLYSNNYATHYAESVKG

SEQ ID NO: 24389 - protein, 11 aa, Artificial Sequence
  Description of Artificial Sequence: Synthetic peptide
  XENP020207 vlCDR3
YYGNYGGYFDV

SEQ ID NO: 24390 - protein, 214 aa, Artificial Sequence; identical to SEQ ID NO: 17250
  Description of Artificial Sequence: Synthetic polypeptide
  XENP020207 2A11_H1L2_Fab-1G6_L1.210_H1.288 Light Chain

SEQ ID NO: 24391 - protein, 107 aa, Artificial Sequence; identical to SEQ ID NO: 17251
  Description of Artificial Sequence: Synthetic polypeptide
  VL of XENP020207

SEQ ID NO: 24392 - protein, 11 aa, Artificial Sequence
  Description of Artificial Sequence: Synthetic peptide
  XENP020207 vlCDR1
QASQDIGNYLN

SEQ ID NO: 24393 - protein, 7 aa, Artificial Sequence
  Description of Artificial Sequence: Synthetic peptide
  XENP020207 vlCDR2
YTSRLHS

SEQ ID NO: 24394 - protein, 9 aa, Artificial Sequence
  Description of Artificial Sequence: Synthetic peptide
  XENP020207 vlCDR3
QQGNTLPYT

SEQ ID NO: 24395 - protein, 447 aa, Artificial Sequence; identical to SEQ ID NO: 17235
  Description of Artificial Sequence: Synthetic polypeptide
  XENP020208 2A11_H1L2_Fab-1G6_H1.288_L1.210 Fab-Fc Heavy Chain

SEQ ID NO: 24396 - protein, 118 aa, Artificial Sequence; identical to SEQ ID NO: 17236
  Description of Artificial Sequence: Synthetic polypeptide
  VH of XENP020208

SEQ ID NO: 24397 - protein, 5 aa, Artificial Sequence
  Description of Artificial Sequence: Synthetic peptide
  XENP020208 vhCDR1
DYYMH

SEQ ID NO: 24398 - protein, 17 aa, Artificial Sequence
  Description of Artificial Sequence: Synthetic peptide
  XENP020208 vhCDR2
WIDPENGDTEYAPKFQG

SEQ ID NO: 24399 - protein, 9 aa, Artificial Sequence
  Description of Artificial Sequence: Synthetic peptide
  XENP020208 vhCDR3
RGVRQALDY

SEQ ID NO: 24400 - protein, 480 aa, Artificial Sequence; identical to SEQ ID NO: 23860
  Description of Artificial Sequence: Synthetic polypeptide
  XENP020208 2A11_H1L2_Fab-1G6_H1.288_L1.210 scFv-Fc Heavy Chain

SEQ ID NO: 24401 - protein, 122 aa, Artificial Sequence; identical to SEQ ID NO: 11358
  Description of Artificial Sequence: Synthetic polypeptide
  VH of XENP020208

SEQ ID NO: 24402 - protein, 107 aa, Artificial Sequence; identical to SEQ ID NO: 11359
  Description of Artificial Sequence: Synthetic polypeptide
  VL of XENP020208

SEQ ID NO: 24403 - protein, 231 aa, Artificial Sequence; identical to SEQ ID NO: 21532
  Description of Artificial Sequence: Synthetic polypeptide
  Fc chain of XENP020208

SEQ ID NO: 24404 - protein, 5 aa, Artificial Sequence
  Description of Artificial Sequence: Synthetic peptide
  XENP020208 vhCDR1
NYWMN

SEQ ID NO: 24405 - protein, 19 aa, Artificial Sequence
  Description of Artificial Sequence: Synthetic peptide
  XENP020208 vhCDR2
EIRLYSNNYATHYAESVKG

SEQ ID NO: 24406 - protein, 11 aa, Artificial Sequence
  Description of Artificial Sequence: Synthetic peptide
  XENP020208 vhCDR3
YYGNYGGYFDV

SEQ ID NO: 24407 - protein, 11 aa, Artificial Sequence
  Description of Artificial Sequence: Synthetic peptide
  XENP020208 vlCDR1
RASQSVGNDVA

SEQ ID NO: 24408 - protein, 7 aa, Artificial Sequence
  Description of Artificial Sequence: Synthetic peptide
  XENP020208 vlCDR2
YASHRYT

SEQ ID NO: 24409 - protein, 9 aa, Artificial Sequence
  Description of Artificial Sequence: Synthetic peptide
  XENP020208 vlCDR3
QQDFSSPRT

SEQ ID NO: 24410 - protein, 214 aa, Artificial Sequence; identical to SEQ ID NO: 17250
  Description of Artificial Sequence: Synthetic polypeptide
  XENP020208 2A11_H1L2_Fab-1G6_H1.288_L1.210 Light Chain

SEQ ID NO: 24411 - protein, 107 aa, Artificial Sequence; identical to SEQ ID NO: 17251
  Description of Artificial Sequence: Synthetic polypeptide
  VL of XENP020208

SEQ ID NO: 24412 - protein, 11 aa, Artificial Sequence
  Description of Artificial Sequence: Synthetic peptide
  XENP020208 vlCDR1
QASQDIGNYLN

SEQ ID NO: 24413 - protein, 7 aa, Artificial Sequence
  Description of Artificial Sequence: Synthetic peptide
  XENP020208 vlCDR2
YTSRLHS

SEQ ID NO: 24414 - protein, 9 aa, Artificial Sequence
  Description of Artificial Sequence: Synthetic peptide
  XENP020208 vlCDR3
QQGNTLPYT

SEQ ID NO: 24415 - protein, 447 aa, Artificial Sequence; identical to SEQ ID NO: 17235
  Description of Artificial Sequence: Synthetic polypeptide
  XENP021580 2A11_H1_25F7_L0_Fab-1G6_L1.194_H1.279 Fab-Fc Heavy Chain

SEQ ID NO: 24416 - protein, 118 aa, Artificial Sequence; identical to SEQ ID NO: 17236
  Description of Artificial Sequence: Synthetic polypeptide
  VH of XENP021580

SEQ ID NO: 24417 - protein, 5 aa, Artificial Sequence
  Description of Artificial Sequence: Synthetic peptide
  XENP021580 vhCDR1
DYYMH

SEQ ID NO: 24418 - protein, 17 aa, Artificial Sequence
  Description of Artificial Sequence: Synthetic peptide
  XENP021580 vhCDR2
WIDPENGDTEYAPKFQG

SEQ ID NO: 24419 - protein, 9 aa, Artificial Sequence
  Description of Artificial Sequence: Synthetic peptide
  XENP021580 vhCDR3
RGVRQALDY

SEQ ID NO: 24420 - protein, 480 aa, Artificial Sequence; identical to SEQ ID NO: 23221
  Description of Artificial Sequence: Synthetic polypeptide
  XENP021580 2A11_H1_25F7_L0_Fab-1G6_L1.194_H1.279 scFv-Fc Heavy Chain

SEQ ID NO: 24421 - protein, 107 aa, Artificial Sequence; identical to SEQ ID NO: 10999
  Description of Artificial Sequence: Synthetic polypeptide
  VH of XENP021580

SEQ ID NO: 24422 - protein, 122 aa, Artificial Sequence; identical to SEQ ID NO: 10908
  Description of Artificial Sequence: Synthetic polypeptide
  VL of XENP021580

SEQ ID NO: 24423 - protein, 231 aa, Artificial Sequence; identical to SEQ ID NO: 21532
  Description of Artificial Sequence: Synthetic polypeptide
  Fc chain of XENP021580

SEQ ID NO: 24424 - protein, 11 aa, Artificial Sequence
  Description of Artificial Sequence: Synthetic peptide
  XENP021580 vhCDR1
RASQSVGNDVA

SEQ ID NO: 24425 - protein, 7 aa, Artificial Sequence
  Description of Artificial Sequence: Synthetic peptide
  XENP021580 vhCDR2
YASHRYT

SEQ ID NO: 24426 - protein, 9 aa, Artificial Sequence
  Description of Artificial Sequence: Synthetic peptide
  XENP021580 vhCDR3
QQDFSSPRT

SEQ ID NO: 24427 - protein, 5 aa, Artificial Sequence
  Description of Artificial Sequence: Synthetic peptide
  XENP021580 vlCDR1
NYWMN

SEQ ID NO: 24428 - protein, 19 aa, Artificial Sequence
  Description of Artificial Sequence: Synthetic peptide
  XENP021580 vlCDR2
EIRLYSNNYATHYAESVKG

SEQ ID NO: 24429 - protein, 11 aa, Artificial Sequence
  Description of Artificial Sequence: Synthetic peptide
  XENP021580 vlCDR3
YYGNYGGYFDV

SEQ ID NO: 24430 - protein, 214 aa, Artificial Sequence; identical to SEQ ID NO: 17140
  Description of Artificial Sequence: Synthetic polypeptide
  XENP021580 2A11_H1_25F7_L0_Fab-1G6_L1.194_H1.279 Light Chain

SEQ ID NO: 24431 - protein, 107 aa, Artificial Sequence; identical to SEQ ID NO: 17141
  Description of Artificial Sequence: Synthetic polypeptide
  VL of XENP021580

SEQ ID NO: 24432 - protein, 11 aa, Artificial Sequence
  Description of Artificial Sequence: Synthetic peptide
  XENP021580 vlCDR1
RASQSISSYLA

SEQ ID NO: 24433 - protein, 7 aa, Artificial Sequence
  Description of Artificial Sequence: Synthetic peptide
  XENP021580 vlCDR2
DASNRAT

SEQ ID NO: 24434 - protein, 9 aa, Artificial Sequence
  Description of Artificial Sequence: Synthetic peptide
  XENP021580 vlCDR3
QQRSNWPLT

SEQ ID NO: 24435 - protein, 447 aa, Artificial Sequence; identical to SEQ ID NO: 17235
  Description of Artificial Sequence: Synthetic polypeptide
  XENP021581 2A11_H1_L2.90_Fab-1G6_L1.194_H1.279 Fab-Fc Heavy Chain

SEQ ID NO: 24436 - protein, 118 aa, Artificial Sequence; identical to SEQ ID NO: 17236
  Description of Artificial Sequence: Synthetic polypeptide
  VH of XENP021581

SEQ ID NO: 24437 - protein, 5 aa, Artificial Sequence
  Description of Artificial Sequence: Synthetic peptide
  XENP021581 vhCDR1
DYYMH

SEQ ID NO: 24438 - protein, 17 aa, Artificial Sequence
  Description of Artificial Sequence: Synthetic peptide
  XENP021581 vhCDR2
WIDPENGDTEYAPKFQG

SEQ ID NO: 24439 - protein, 9 aa, Artificial Sequence
  Description of Artificial Sequence: Synthetic peptide
  XENP021581 vhCDR3
RGVRQALDY

SEQ ID NO: 24440 - protein, 480 aa, Artificial Sequence; identical to SEQ ID NO: 23221
  Description of Artificial Sequence: Synthetic polypeptide
  XENP021581 2A11_H1_L2.90_Fab-1G6_L1.194_H1.279 scFv-Fc Heavy Chain

SEQ ID NO: 24441 - protein, 107 aa, Artificial Sequence; identical to SEQ ID NO: 10999
  Description of Artificial Sequence: Synthetic polypeptide
  VH of XENP021581

SEQ ID NO: 24442 - protein, 122 aa, Artificial Sequence; identical to SEQ ID NO: 10908
  Description of Artificial Sequence: Synthetic polypeptide
  VL of XENP021581

SEQ ID NO: 24443 - protein, 231 aa, Artificial Sequence; identical to SEQ ID NO: 21532
  Description of Artificial Sequence: Synthetic polypeptide
  Fc chain of XENP021581

SEQ ID NO: 24444 - protein, 11 aa, Artificial Sequence
  Description of Artificial Sequence: Synthetic peptide
  XENP021581 vhCDR1
RASQSVGNDVA

SEQ ID NO: 24445 - protein, 7 aa, Artificial Sequence
  Description of Artificial Sequence: Synthetic peptide
  XENP021581 vhCDR2
YASHRYT

SEQ ID NO: 24446 - protein, 9 aa, Artificial Sequence
  Description of Artificial Sequence: Synthetic peptide
  XENP021581 vhCDR3
QQDFSSPRT

SEQ ID NO: 24447 - protein, 5 aa, Artificial Sequence
  Description of Artificial Sequence: Synthetic peptide
  XENP021581 vlCDR1
NYWMN

SEQ ID NO: 24448 - protein, 19 aa, Artificial Sequence
  Description of Artificial Sequence: Synthetic peptide
  XENP021581 vlCDR2
EIRLYSNNYATHYAESVKG

SEQ ID NO: 24449 - protein, 11 aa, Artificial Sequence
  Description of Artificial Sequence: Synthetic peptide
  XENP021581 vlCDR3
YYGNYGGYFDV

SEQ ID NO: 24450 - protein, 214 aa, Artificial Sequence
  Description of Artificial Sequence: Synthetic polypeptide
  XENP021581 2A11_H1_L2.90_Fab-1G6_L1.194_H1.279 Light Chain
DIQMTQSPAFLSVTPGEKVTITCQASQDIGNYLNWYQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24451 - protein, 107 aa, Artificial Sequence
  Description of Artificial Sequence: Synthetic polypeptide
  VL of XENP021581
DIQMTQSPAFLSVTPGEKVTITCQASQDIGNYLNWYQQKPDQTVKLLIYYTSRLHSGVPSRFSGSGSGTDYTFTISSLEAEDAATYFCQQGNTLPYTFGGGTKVEIK

SEQ ID NO: 24452 - protein, 11 aa, Artificial Sequence
  Description of Artificial Sequence: Synthetic peptide
  XENP021581 vlCDR1
QASQDIGNYLN

SEQ ID NO: 24453 - protein, 7 aa, Artificial Sequence
  Description of Artificial Sequence: Synthetic peptide
  XENP021581 vlCDR2
YTSRLHS

SEQ ID NO: 24454 - protein, 9 aa, Artificial Sequence
  Description of Artificial Sequence: Synthetic peptide
  XENP021581 vlCDR3
QQGNTLPYT

SEQ ID NO: 24455 - protein, 447 aa, Artificial Sequence; identical to SEQ ID NO: 17235
  Description of Artificial Sequence: Synthetic polypeptide
  XENP021582 2A11_H1_L2.91_Fab-1G6_L1.194_H1.279 Fab-Fc Heavy Chain

SEQ ID NO: 24456 - protein, 118 aa, Artificial Sequence; identical to SEQ ID NO: 17236
  Description of Artificial Sequence: Synthetic polypeptide
  VH of XENP021582

SEQ ID NO: 24457 - protein, 5 aa, Artificial Sequence
  Description of Artificial Sequence: Synthetic peptide
  XENP021582 vhCDR1
DYYMH

SEQ ID NO: 24458 - protein, 17 aa, Artificial Sequence
  Description of Artificial Sequence: Synthetic peptide
  XENP021582 vhCDR2
WIDPENGDTEYAPKFQG

SEQ ID NO: 24459 - protein, 9 aa, Artificial Sequence
  Description of Artificial Sequence: Synthetic peptide
  XENP021582 vhCDR3
RGVRQALDY

SEQ ID NO: 24460 - protein, 480 aa, Artificial Sequence; identical to SEQ ID NO: 23221
  Description of Artificial Sequence: Synthetic polypeptide
  XENP021582 2A11_H1_L2.91_Fab-1G6_L1.194_H1.279 scFv-Fc Heavy Chain

SEQ ID NO: 24461 - protein, 107 aa, Artificial Sequence; identical to SEQ ID NO: 10999
  Description of Artificial Sequence: Synthetic polypeptide
  VH of XENP021582

SEQ ID NO: 24462 - protein, 122 aa, Artificial Sequence; identical to SEQ ID NO: 10908
  Description of Artificial Sequence: Synthetic polypeptide
  VL of XENP021582

SEQ ID NO: 24463 - protein, 231 aa, Artificial Sequence; identical to SEQ ID NO: 21532
  Description of Artificial Sequence: Synthetic polypeptide
  Fc chain of XENP021582

SEQ ID NO: 24464 - protein, 11 aa, Artificial Sequence
  Description of Artificial Sequence: Synthetic peptide
  XENP021582 vhCDR1
RASQSVGNDVA

SEQ ID NO: 24465 - protein, 7 aa, Artificial Sequence
  Description of Artificial Sequence: Synthetic peptide
  XENP021582 vhCDR2
YASHRYT

SEQ ID NO: 24466 - protein, 9 aa, Artificial Sequence
  Description of Artificial Sequence: Synthetic peptide
  XENP021582 vhCDR3
QQDFSSPRT

SEQ ID NO: 24467 - protein, 5 aa, Artificial Sequence
  Description of Artificial Sequence: Synthetic peptide
  XENP021582 vlCDR1
NYWMN

SEQ ID NO: 24468 - protein, 19 aa, Artificial Sequence
  Description of Artificial Sequence: Synthetic peptide
  XENP021582 vlCDR2
EIRLYSNNYATHYAESVKG

SEQ ID NO: 24469 - protein, 11 aa, Artificial Sequence
  Description of Artificial Sequence: Synthetic peptide
  XENP021582 vlCDR3
YYGNYGGYFDV

SEQ ID NO: 24470 - protein, 214 aa, Artificial Sequence
  Description of Artificial Sequence: Synthetic polypeptide
  XENP021582 2A11_H1_L2.91_Fab-1G6_L1.194_H1.279 Light Chain
DIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24471 - protein, 107 aa, Artificial Sequence
  Description of Artificial Sequence: Synthetic polypeptide
  VL of XENP021582
DIQMTQSPAFLSVTPGEKVTITCQASQDIGNYLNWFQQKPGQTVKLLIYYTSRLHSGVPSRFSGSGSGTDYTFTISSLEAEDAATYFCQQGNTLPYTFGGGTKVEIK

SEQ ID NO: 24472 - protein, 11 aa, Artificial Sequence
  Description of Artificial Sequence: Synthetic peptide
  XENP021582 vlCDR1
QASQDIGNYLN

SEQ ID NO: 24473 - protein, 7 aa, Artificial Sequence
  Description of Artificial Sequence: Synthetic peptide
  XENP021582 vlCDR2
YTSRLHS

SEQ ID NO: 24474 - protein, 9 aa, Artificial Sequence
  Description of Artificial Sequence: Synthetic peptide
  XENP021582 vlCDR3
QQGNTLPYT

SEQ ID NO: 24475 - protein, 447 aa, Artificial Sequence; identical to SEQ ID NO: 17235
  Description of Artificial Sequence: Synthetic polypeptide
  XENP021583 2A11_H1_L2.92_Fab-1G6_L1.194_H1.279 Fab-Fc Heavy Chain

SEQ ID NO: 24476 - protein, 118 aa, Artificial Sequence; identical to SEQ ID NO: 17236
  Description of Artificial Sequence: Synthetic polypeptide
  VH of XENP021583

SEQ ID NO: 24477 - protein, 5 aa, Artificial Sequence
  Description of Artificial Sequence: Synthetic peptide
  XENP021583 vhCDR1
DYYMH

SEQ ID NO: 24478 - protein, 17 aa, Artificial Sequence
  Description of Artificial Sequence: Synthetic peptide
  XENP021583 vhCDR2
WIDPENGDTEYAPKFQG

SEQ ID NO: 24479 - protein, 9 aa, Artificial Sequence
  Description of Artificial Sequence: Synthetic peptide
  XENP021583 vhCDR3
RGVRQALDY

SEQ ID NO: 24480 - protein, 480 aa, Artificial Sequence; identical to SEQ ID NO: 23221
  Description of Artificial Sequence: Synthetic polypeptide
  XENP021583 2A11_H1_L2.92_Fab-1G6_L1.194_H1.279 scFv-Fc Heavy Chain

SEQ ID NO: 24481 - protein, 107 aa, Artificial Sequence; identical to SEQ ID NO: 10999
  Description of Artificial Sequence: Synthetic polypeptide
  VH of XENP021583

SEQ ID NO: 24482 - protein, 122 aa, Artificial Sequence; identical to SEQ ID NO: 10908
  Description of Artificial Sequence: Synthetic polypeptide
  VL of XENP021583

SEQ ID NO: 24483 - protein, 231 aa, Artificial Sequence; identical to SEQ ID NO: 21532
  Description of Artificial Sequence: Synthetic polypeptide
  Fc chain of XENP021583

SEQ ID NO: 24484 - protein, 11 aa, Artificial Sequence
  Description of Artificial Sequence: Synthetic peptide
  XENP021583 vhCDR1
RASQSVGNDVA

SEQ ID NO: 24485 - protein, 7 aa, Artificial Sequence
  Description of Artificial Sequence: Synthetic peptide
  XENP021583 vhCDR2
YASHRYT

SEQ ID NO: 24486 - protein, 9 aa, Artificial Sequence
  Description of Artificial Sequence: Synthetic peptide
  XENP021583 vhCDR3
QQDFSSPRT

SEQ ID NO: 24487 - protein, 5 aa, Artificial Sequence
  Description of Artificial Sequence: Synthetic peptide
  XENP021583 vlCDR1
NYWMN

SEQ ID NO: 24488 - protein, 19 aa, Artificial Sequence
  Description of Artificial Sequence: Synthetic peptide
  XENP021583 vlCDR2
EIRLYSNNYATHYAESVKG

SEQ ID NO: 24489 - protein, 11 aa, Artificial Sequence
  Description of Artificial Sequence: Synthetic peptide
  XENP021583 vlCDR3
YYGNYGGYFDV

SEQ ID NO: 24490 - protein, 214 aa, Artificial Sequence
  Description of Artificial Sequence: Synthetic polypeptide
  XENP021583 2A11_H1_L2.92_Fab-1G6_L1.194_H1.279 Light Chain
DIQMTQSPAFLSVTPGEKVTITCQASQDIGNYLNWFQQKPDQSVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24491 - protein, 107 aa, Artificial Sequence
  Description of Artificial Sequence: Synthetic polypeptide
  VL of XENP021583
DIQMTQSPAFLSVTPGEKVTITCQASQDIGNYLNWFQQKPDQSVKLLIYYTSRLHSGVPSRFSGSGSGTDYTFTISSLEAEDAATYFCQQGNTLPYTFGGGTKVEIK

SEQ ID NO: 24492 - protein, 11 aa, Artificial Sequence
  Description of Artificial Sequence: Synthetic peptide
  XENP021583 vlCDR1
QASQDIGNYLN

SEQ ID NO: 24493 - protein, 7 aa, Artificial Sequence
  Description of Artificial Sequence: Synthetic peptide
  XENP021583 vlCDR2
YTSRLHS

SEQ ID NO: 24494 - protein, 9 aa, Artificial Sequence
  Description of Artificial Sequence: Synthetic peptide
  XENP021583 vlCDR3
QQGNTLPYT

SEQ ID NO: 24495 - protein, 447 aa, Artificial Sequence; identical to SEQ ID NO: 17235
  Description of Artificial Sequence: Synthetic polypeptide
  XENP021584 2A11_H1_L2.93_Fab-1G6_L1.194_H1.279 Fab-Fc Heavy Chain

SEQ ID NO: 24496 - protein, 118 aa, Artificial Sequence; identical to SEQ ID NO: 17236
  Description of Artificial Sequence: Synthetic polypeptide
  VH of XENP021584

SEQ ID NO: 24497 - protein, 5 aa, Artificial Sequence
  Description of Artificial Sequence: Synthetic peptide
  XENP021584 vhCDR1
DYYMH

SEQ ID NO: 24498 - protein, 17 aa, Artificial Sequence
  Description of Artificial Sequence: Synthetic peptide
  XENP021584 vhCDR2
WIDPENGDTEYAPKFQG

SEQ ID NO: 24499 - protein, 9 aa, Artificial Sequence
  Description of Artificial Sequence: Synthetic peptide
  XENP021584 vhCDR3
RGVRQALDY

SEQ ID NO: 24500 - protein, 480 aa, Artificial Sequence; identical to SEQ ID NO: 23221
  Description of Artificial Sequence: Synthetic polypeptide
  XENP021584 2A11_H1_L2.93_Fab-1G6_L1.194_H1.279 scFv-Fc Heavy Chain

SEQ ID NO: 24501 - protein, 107 aa, Artificial Sequence; identical to SEQ ID NO: 10999
  Description of Artificial Sequence: Synthetic polypeptide
  VH of XENP021584

SEQ ID NO: 24502 - protein, 122 aa, Artificial Sequence; identical to SEQ ID NO: 10908
  Description of Artificial Sequence: Synthetic polypeptide
  VL of XENP021584

SEQ ID NO: 24503 - protein, 231 aa, Artificial Sequence; identical to SEQ ID NO: 21532
  Description of Artificial Sequence: Synthetic polypeptide
  Fc chain of XENP021584

SEQ ID NO: 24504 - protein, 11 aa, Artificial Sequence
  Description of Artificial Sequence: Synthetic peptide
  XENP021584 vhCDR1
RASQSVGNDVA

SEQ ID NO: 24505 - protein, 7 aa, Artificial Sequence
  Description of Artificial Sequence: Synthetic peptide
  XENP021584 vhCDR2
YASHRYT

SEQ ID NO: 24506 - protein, 9 aa, Artificial Sequence
  Description of Artificial Sequence: Synthetic peptide
  XENP021584 vhCDR3
QQDFSSPRT

SEQ ID NO: 24507 - protein, 5 aa, Artificial Sequence
  Description of Artificial Sequence: Synthetic peptide
  XENP021584 vlCDR1
NYWMN

SEQ ID NO: 24508 - protein, 19 aa, Artificial Sequence
  Description of Artificial Sequence: Synthetic peptide
  XENP021584 vlCDR2
EIRLYSNNYATHYAESVKG

SEQ ID NO: 24509 - protein, 11 aa, Artificial Sequence
  Description of Artificial Sequence: Synthetic peptide
  XENP021584 vlCDR3
YYGNYGGYFDV

SEQ ID NO: 24510 - protein, 214 aa, Artificial Sequence
  Description of Artificial Sequence: Synthetic polypeptide
  XENP021584 2A11_H1_L2.93_Fab-1G6_L1.194_H1.279 Light Chain
DIQMTQSPAFLSVTPGEKVTITCQASQDIGNYLNWFQQKPDQTPKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24511 - protein, 107 aa, Artificial Sequence
  Description of Artificial Sequence: Synthetic polypeptide
  VL of XENP021584
DIQMTQSPAFLSVTPGEKVTITCQASQDIGNYLNWFQQKPDQTPKLLIYYTSRLHSGVPSRFSGSGSGTDYTFTISSLEAEDAATYFCQQGNTLPYTFGGGTKVEIK

SEQ ID NO: 24512 - protein, 11 aa, Artificial Sequence
  Description of Artificial Sequence: Synthetic peptide
  XENP021584 vlCDR1
QASQDIGNYLN

SEQ ID NO: 24513 - protein, 7 aa, Artificial Sequence
  Description of Artificial Sequence: Synthetic peptide
  XENP021584 vlCDR2
YTSRLHS

SEQ ID NO: 24514 - protein, 9 aa, Artificial Sequence
  Description of Artificial Sequence: Synthetic peptide
  XENP021584 vlCDR3
QQGNTLPYT

SEQ ID NO: 24515 - protein, 447 aa, Artificial Sequence; identical to SEQ ID NO: 17235
  Description of Artificial Sequence: Synthetic polypeptide
  XENP021585 2A11_H1_L2.94_Fab-1G6_L1.194_H1.279 Fab-Fc Heavy Chain

SEQ ID NO: 24516 - protein, 118 aa, Artificial Sequence; identical to SEQ ID NO: 17236
  Description of Artificial Sequence: Synthetic polypeptide
  VH of XENP021585

SEQ ID NO: 24517 - protein, 5 aa, Artificial Sequence
  Description of Artificial Sequence: Synthetic peptide
  XENP021585 vhCDR1
DYYMH

SEQ ID NO: 24518 - protein, 17 aa, Artificial Sequence
  Description of Artificial Sequence: Synthetic peptide
  XENP021585 vhCDR2
WIDPENGDTEYAPKFQG

SEQ ID NO: 24519 - protein, 9 aa, Artificial Sequence
  Description of Artificial Sequence: Synthetic peptide
  XENP021585 vhCDR3
RGVRQALDY

SEQ ID NO: 24520 - protein, 480 aa, Artificial Sequence; identical to SEQ ID NO: 23221
  Description of Artificial Sequence: Synthetic polypeptide
  XENP021585 2A11_H1_L2.94_Fab-1G6_L1.194_H1.279 scFv-Fc Heavy Chain

SEQ ID NO: 24521 - protein, 107 aa, Artificial Sequence; identical to SEQ ID NO: 10999
  Description of Artificial Sequence: Synthetic polypeptide
  VH of XENP021585

SEQ ID NO: 24522 - protein, 122 aa, Artificial Sequence; identical to SEQ ID NO: 10908
  Description of Artificial Sequence: Synthetic polypeptide
  VL of XENP021585

SEQ ID NO: 24523 - protein, 231 aa, Artificial Sequence; identical to SEQ ID NO: 21532
  Description of Artificial Sequence: Synthetic polypeptide
  Fc chain of XENP021585

SEQ ID NO: 24524 - protein, 11 aa, Artificial Sequence
  Description of Artificial Sequence: Synthetic peptide
  XENP021585 vhCDR1
RASQSVGNDVA

SEQ ID NO: 24525 - protein, 7 aa, Artificial Sequence
  Description of Artificial Sequence: Synthetic peptide
  XENP021585 vhCDR2
YASHRYT

SEQ ID NO: 24526 - protein, 9 aa, Artificial Sequence
  Description of Artificial Sequence: Synthetic peptide
  XENP021585 vhCDR3
QQDFSSPRT

SEQ ID NO: 24527 - protein, 5 aa, Artificial Sequence
  Description of Artificial Sequence: Synthetic peptide
  XENP021585 vlCDR1
NYWMN

SEQ ID NO: 24528 - protein, 19 aa, Artificial Sequence
  Description of Artificial Sequence: Synthetic peptide
  XENP021585 vlCDR2
EIRLYSNNYATHYAESVKG

SEQ ID NO: 24529 - protein, 11 aa, Artificial Sequence
  Description of Artificial Sequence: Synthetic peptide
  XENP021585 vlCDR3
YYGNYGGYFDV

SEQ ID NO: 24530 - protein, 214 aa, Artificial Sequence
  Description of Artificial Sequence: Synthetic polypeptide
  XENP021585 2A11_H1_L2.94_Fab-1G6_L1.194_H1.279 Light Chain
DIQMTQSPAFLSVTPGEKVTITCQASQDIGNYLNWFQQKPDQTVKLLIYYTSRLHSGVPSRFSGSGSGTDYTFTISSLEAEDAATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24531 - protein, 107 aa, Artificial Sequence
  Description of Artificial Sequence: Synthetic polypeptide
  VL of XENP021585
DIQMTQSPAFLSVTPGEKVTITCQASQDIGNYLNWFQQKPDQTVKLLIYYTSRLHSGVPSRFSGSGSGTDYTFTISSLEAEDAATYYCQQGNTLPYTFGGGTKVEIK

SEQ ID NO: 24532 - protein, 11 aa, Artificial Sequence
  Description of Artificial Sequence: Synthetic peptide
  XENP021585 vlCDR1
QASQDIGNYLN

SEQ ID NO: 24533 - protein, 7 aa, Artificial Sequence
  Description of Artificial Sequence: Synthetic peptide
  XENP021585 vlCDR2
YTSRLHS

SEQ ID NO: 24534 - protein, 9 aa, Artificial Sequence
  Description of Artificial Sequence: Synthetic peptide
  XENP021585 vlCDR3
QQGNTLPYT

SEQ ID NO: 24535 - protein, 447 aa, Artificial Sequence; identical to SEQ ID NO: 17235
  Description of Artificial Sequence: Synthetic polypeptide
  XENP021586 2A11_H1_L2.95_Fab-1G6_L1.194_H1.279 Fab-Fc Heavy Chain

SEQ ID NO: 24536 - protein, 118 aa, Artificial Sequence; identical to SEQ ID NO: 17236
  Description of Artificial Sequence: Synthetic polypeptide
  VH of XENP021586

SEQ ID NO: 24537 - protein, 5 aa, Artificial Sequence
  Description of Artificial Sequence: Synthetic peptide
  XENP021586 vhCDR1
DYYMH

SEQ ID NO: 24538 - protein, 17 aa, Artificial Sequence
  Description of Artificial Sequence: Synthetic peptide
  XENP021586 vhCDR2
WIDPENGDTEYAPKFQG

SEQ ID NO: 24539 - protein, 9 aa, Artificial Sequence
  Description of Artificial Sequence: Synthetic peptide
  XENP021586 vhCDR3
RGVRQALDY

SEQ ID NO: 24540 - protein, 480 aa, Artificial Sequence; identical to SEQ ID NO: 23221
  Description of Artificial Sequence: Synthetic polypeptide
  XENP021586 2A11_H1_L2.95_Fab-1G6_L1.194_H1.279 scFv-Fc Heavy Chain

SEQ ID NO: 24541 - protein, 107 aa, Artificial Sequence; identical to SEQ ID NO: 10999
  Description of Artificial Sequence: Synthetic polypeptide
  VH of XENP021586

SEQ ID NO: 24542 - protein, 122 aa, Artificial Sequence; identical to SEQ ID NO: 10908
  Description of Artificial Sequence: Synthetic polypeptide
  VL of XENP021586

SEQ ID NO: 24543 - protein, 231 aa, Artificial Sequence; identical to SEQ ID NO: 21532
  Description of Artificial Sequence: Synthetic polypeptide
  Fc chain of XENP021586

SEQ ID NO: 24544 - protein, 11 aa, Artificial Sequence
  Description of Artificial Sequence: Synthetic peptide
  XENP021586 vhCDR1
RASQSVGNDVA

SEQ ID NO: 24545 - protein, 7 aa, Artificial Sequence
  Description of Artificial Sequence: Synthetic peptide
  XENP021586 vhCDR2
YASHRYT

SEQ ID NO: 24546 - protein, 9 aa, Artificial Sequence
  Description of Artificial Sequence: Synthetic peptide
  XENP021586 vhCDR3
QQDFSSPRT

SEQ ID NO: 24547 - protein, 5 aa, Artificial Sequence
  Description of Artificial Sequence: Synthetic peptide
  XENP021586 vlCDR1
NYWMN

SEQ ID NO: 24548 - protein, 19 aa, Artificial Sequence
  Description of Artificial Sequence: Synthetic peptide
  XENP021586 vlCDR2
EIRLYSNNYATHYAESVKG

SEQ ID NO: 24549 - protein, 11 aa, Artificial Sequence
  Description of Artificial Sequence: Synthetic peptide
  XENP021586 vlCDR3
YYGNYGGYFDV

SEQ ID NO: 24550 - protein, 214 aa, Artificial Sequence
  Description of Artificial Sequence: Synthetic polypeptide
  XENP021586 2A11_H1_L2.95_Fab-1G6_L1.194_H1.279 Light Chain
DIQMTQSPAFLSVTPGEKVTITCQASQDIGNYLNWYQQKPDQTPKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24551 - protein, 107 aa, Artificial Sequence
  Description of Artificial Sequence: Synthetic polypeptide
  VL of XENP021586
DIQMTQSPAFLSVTPGEKVTITCQASQDIGNYLNWYQQKPDQTPKLLIYYTSRLHSGVPSRFSGSGSGTDYTFTISSLEAEDAATYFCQQGNTLPYTFGGGTKVEIK

SEQ ID NO: 24552 - protein, 11 aa, Artificial Sequence
  Description of Artificial Sequence: Synthetic peptide
  XENP021586 vlCDR1
QASQDIGNYLN

SEQ ID NO: 24553 - protein, 7 aa, Artificial Sequence
  Description of Artificial Sequence: Synthetic peptide
  XENP021586 vlCDR2
YTSRLHS

SEQ ID NO: 24554 - protein, 9 aa, Artificial Sequence
  Description of Artificial Sequence: Synthetic peptide
  XENP021586 vlCDR3
QQGNTLPYT

SEQ ID NO: 24555 - protein, 447 aa, Artificial Sequence; identical to SEQ ID NO: 17235
  Description of Artificial Sequence: Synthetic polypeptide
  XENP021587 2A11_H1_L2.96_Fab-1G6_L1.194_H1.279 Fab-Fc Heavy Chain

SEQ ID NO: 24556 - protein, 118 aa, Artificial Sequence; identical to SEQ ID NO: 17236
  Description of Artificial Sequence: Synthetic polypeptide
  VH of XENP021587

SEQ ID NO: 24557 - protein, 5 aa, Artificial Sequence
  Description of Artificial Sequence: Synthetic peptide
  XENP021587 vhCDR1
DYYMH

SEQ ID NO: 24558 - protein, 17 aa, Artificial Sequence
  Description of Artificial Sequence: Synthetic peptide
  XENP021587 vhCDR2
WIDPENGDTEYAPKFQG

SEQ ID NO: 24559 - protein, 9 aa, Artificial Sequence
  Description of Artificial Sequence: Synthetic peptide
  XENP021587 vhCDR3
RGVRQALDY

SEQ ID NO: 24560 - protein, 480 aa, Artificial Sequence; identical to SEQ ID NO: 23221
  Description of Artificial Sequence: Synthetic polypeptide
  XENP021587 2A11_H1_L2.96_Fab-1G6_L1.194_H1.279 scFv-Fc Heavy Chain

SEQ ID NO: 24561 - protein, 107 aa, Artificial Sequence; identical to SEQ ID NO: 10999
  Description of Artificial Sequence: Synthetic polypeptide
  VH of XENP021587

SEQ ID NO: 24562 - protein, 122 aa, Artificial Sequence; identical to SEQ ID NO: 10908
  Description of Artificial Sequence: Synthetic polypeptide
  VL of XENP021587

SEQ ID NO: 24563 - protein, 231 aa, Artificial Sequence; identical to SEQ ID NO: 21532
  Description of Artificial Sequence: Synthetic polypeptide
  Fc chain of XENP021587

SEQ ID NO: 24564 - protein, 11 aa, Artificial Sequence
  Description of Artificial Sequence: Synthetic peptide
  XENP021587 vhCDR1
RASQSVGNDVA

SEQ ID NO: 24565 - protein, 7 aa, Artificial Sequence
  Description of Artificial Sequence: Synthetic peptide
  XENP021587 vhCDR2
YASHRYT

SEQ ID NO: 24566 - protein, 9 aa, Artificial Sequence
  Description of Artificial Sequence: Synthetic peptide
  XENP021587 vhCDR3
QQDFSSPRT

SEQ ID NO: 24567 - protein, 5 aa, Artificial Sequence
  Description of Artificial Sequence: Synthetic peptide
  XENP021587 vlCDR1
NYWMN

SEQ ID NO: 24568 - protein, 19 aa, Artificial Sequence
  Description of Artificial Sequence: Synthetic peptide
  XENP021587 vlCDR2
EIRLYSNNYATHYAESVKG

SEQ ID NO: 24569 - protein, 11 aa, Artificial Sequence
  Description of Artificial Sequence: Synthetic peptide
  XENP021587 vlCDR3
YYGNYGGYFDV

SEQ ID NO: 24570 - protein, 214 aa, Artificial Sequence
  Description of Artificial Sequence: Synthetic polypeptide
  XENP021587 2A11_H1_L2.96_Fab-1G6_L1.194_H1.279 Light Chain
DIQMTQSPAFLSVTPGEKVTITCQASQDIGNYLNWYQQKPDQTPKLLIYYTSRLHSGVPSRFSGSGSGTDYTFTISSLEAEDAATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24571 - protein, 107 aa, Artificial Sequence
  Description of Artificial Sequence: Synthetic polypeptide
  VL of XENP021587
DIQMTQSPAFLSVTPGEKVTITCQASQDIGNYLNWYQQKPDQTPKLLIYYTSRLHSGVPSRFSGSGSGTDYTFTISSLEAEDAATYYCQQGNTLPYTFGGGTKVEIK

SEQ ID NO: 24572 - protein, 11 aa, Artificial Sequence
  Description of Artificial Sequence: Synthetic peptide
  XENP021587 vlCDR1
QASQDIGNYLN

SEQ ID NO: 24573 - protein, 7 aa, Artificial Sequence
  Description of Artificial Sequence: Synthetic peptide
  XENP021587 vlCDR2
YTSRLHS

SEQ ID NO: 24574 - protein, 9 aa, Artificial Sequence
  Description of Artificial Sequence: Synthetic peptide
  XENP021587 vlCDR3
QQGNTLPYT

SEQ ID NO: 24575 - protein, 447 aa, Artificial Sequence; identical to SEQ ID NO: 17235
  Description of Artificial Sequence: Synthetic polypeptide
  XENP021588 2A11_H1_L2.97_Fab-1G6_L1.194_H1.279 Fab-Fc Heavy Chain

SEQ ID NO: 24576 - protein, 118 aa, Artificial Sequence; identical to SEQ ID NO: 17236
  Description of Artificial Sequence: Synthetic polypeptide
  VH of XENP021588

SEQ ID NO: 24577 - protein, 5 aa, Artificial Sequence
  Description of Artificial Sequence: Synthetic peptide
  XENP021588 vhCDR1
DYYMH

SEQ ID NO: 24578 - protein, 17 aa, Artificial Sequence
  Description of Artificial Sequence: Synthetic peptide
  XENP021588 vhCDR2
WIDPENGDTEYAPKFQG

SEQ ID NO: 24579 - protein, 9 aa, Artificial Sequence
  Description of Artificial Sequence: Synthetic peptide
  XENP021588 vhCDR3
RGVRQALDY

SEQ ID NO: 24580 - protein, 480 aa, Artificial Sequence; identical to SEQ ID NO: 23221
  Description of Artificial Sequence: Synthetic polypeptide
  XENP021588 2A11_H1_L2.97_Fab-1G6_L1.194_H1.279 scFv-Fc Heavy Chain

SEQ ID NO: 24581 - protein, 107 aa, Artificial Sequence; identical to SEQ ID NO: 10999
  Description of Artificial Sequence: Synthetic polypeptide
  VH of XENP021588

SEQ ID NO: 24582 - protein, 122 aa, Artificial Sequence; identical to SEQ ID NO: 10908
  Description of Artificial Sequence: Synthetic polypeptide
  VL of XENP021588

SEQ ID NO: 24583 - protein, 231 aa, Artificial Sequence; identical to SEQ ID NO: 21532
  Description of Artificial Sequence: Synthetic polypeptide
  Fc chain of XENP021588

SEQ ID NO: 24584 - protein, 11 aa, Artificial Sequence
  Description of Artificial Sequence: Synthetic peptide
  XENP021588 vhCDR1
RASQSVGNDVA

SEQ ID NO: 24585 - protein, 7 aa, Artificial Sequence
  Description of Artificial Sequence: Synthetic peptide
  XENP021588 vhCDR2
YASHRYT

SEQ ID NO: 24586 - protein, 9 aa, Artificial Sequence
  Description of Artificial Sequence: Synthetic peptide
  XENP021588 vhCDR3
QQDFSSPRT

SEQ ID NO: 24587 - protein, 5 aa, Artificial Sequence
  Description of Artificial Sequence: Synthetic peptide
  XENP021588 vlCDR1
NYWMN

SEQ ID NO: 24588 - protein, 19 aa, Artificial Sequence
  Description of Artificial Sequence: Synthetic peptide
  XENP021588 vlCDR2
EIRLYSNNYATHYAESVKG

SEQ ID NO: 24589 - protein, 11 aa, Artificial Sequence
  Description of Artificial Sequence: Synthetic peptide
  XENP021588 vlCDR3
YYGNYGGYFDV

SEQ ID NO: 24590 - protein, 214 aa, Artificial Sequence
  Description of Artificial Sequence: Synthetic polypeptide
  XENP021588 2A11_H1_L2.97_Fab-1G6_L1.194_H1.279 Light Chain
DIQMTQSPAFLSVTPGEKVTITCQASQDIGNYLNWFQQKPDQTPKLLIYYTSRLHSGVPSRFSGSGSGTDYTFTISSLEAEDAATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24591 - protein, 107 aa, Artificial Sequence
  Description of Artificial Sequence: Synthetic polypeptide
  VL of XENP021588
DIQMTQSPAFLSVTPGEKVTITCQASQDIGNYLNWFQQKPDQTPKLLIYYTSRLHSGVPSRFSGSGSGTDYTFTISSLEAEDAATYYCQQGNTLPYTFGGGTKVEIK

SEQ ID NO: 24592 - protein, 11 aa, Artificial Sequence
  Description of Artificial Sequence: Synthetic peptide
  XENP021588 vlCDR1
QASQDIGNYLN

SEQ ID NO: 24593 - protein, 7 aa, Artificial Sequence
  Description of Artificial Sequence: Synthetic peptide
  XENP021588 vlCDR2
YTSRLHS

SEQ ID NO: 24594 - protein, 9 aa, Artificial Sequence
  Description of Artificial Sequence: Synthetic peptide
  XENP021588 vlCDR3
QQGNTLPYT

SEQ ID NO: 24595 - protein, 447 aa, Artificial Sequence; identical to SEQ ID NO: 17235
  Description of Artificial Sequence: Synthetic polypeptide
  XENP021589 2A11_H1_L2.98_Fab-1G6_L1.194_H1.279 Fab-Fc Heavy Chain

SEQ ID NO: 24596 - protein, 118 aa, Artificial Sequence; identical to SEQ ID NO: 17236
  Description of Artificial Sequence: Synthetic polypeptide
  VH of XENP021589

SEQ ID NO: 24597 - protein, 5 aa, Artificial Sequence
  Description of Artificial Sequence: Synthetic peptide
  XENP021589 vhCDR1
DYYMH

SEQ ID NO: 24598 - protein, 17 aa, Artificial Sequence
  Description of Artificial Sequence: Synthetic peptide
  XENP021589 vhCDR2
WIDPENGDTEYAPKFQG

SEQ ID NO: 24599 - protein, 9 aa, Artificial Sequence
  Description of Artificial Sequence: Synthetic peptide
  XENP021589 vhCDR3
RGVRQALDY

SEQ ID NO: 24600 - protein, 480 aa, Artificial Sequence; identical to SEQ ID NO: 23221
  Description of Artificial Sequence: Synthetic polypeptide
  XENP021589 2A11_H1_L2.98_Fab-1G6_L1.194_H1.279 scFv-Fc Heavy Chain

SEQ ID NO: 24601 - protein, 107 aa, Artificial Sequence; identical to SEQ ID NO: 10999
  Description of Artificial Sequence: Synthetic polypeptide
  VH of XENP021589

SEQ ID NO: 24602 - protein, 122 aa, Artificial Sequence; identical to SEQ ID NO: 10908
  Description of Artificial Sequence: Synthetic polypeptide
  VL of XENP021589

SEQ ID NO: 24603 - protein, 231 aa, Artificial Sequence; identical to SEQ ID NO: 21532
  Description of Artificial Sequence: Synthetic polypeptide
  Fc chain of XENP021589

SEQ ID NO: 24604 - protein, 11 aa, Artificial Sequence
  Description of Artificial Sequence: Synthetic peptide
  XENP021589 vhCDR1
RASQSVGNDVA

SEQ ID NO: 24605 - protein, 7 aa, Artificial Sequence
  Description of Artificial Sequence: Synthetic peptide
  XENP021589 vhCDR2
YASHRYT

SEQ ID NO: 24606 - protein, 9 aa, Artificial Sequence
  Description of Artificial Sequence: Synthetic peptide
  XENP021589 vhCDR3
QQDFSSPRT

SEQ ID NO: 24607 - protein, 5 aa, Artificial Sequence
  Description of Artificial Sequence: Synthetic peptide
  XENP021589 vlCDR1
NYWMN

SEQ ID NO: 24608 - protein, 19 aa, Artificial Sequence
  Description of Artificial Sequence: Synthetic peptide
  XENP021589 vlCDR2
EIRLYSNNYATHYAESVKG

SEQ ID NO: 24609 - protein, 11 aa, Artificial Sequence
  Description of Artificial Sequence: Synthetic peptide
  XENP021589 vlCDR3
YYGNYGGYFDV

SEQ ID NO: 24610 - protein, 214 aa, Artificial Sequence
  Description of Artificial Sequence: Synthetic polypeptide
  XENP021589 2A11_H1_L2.98_Fab-1G6_L1.194_H1.279 Light Chain
DIQMTQSPAFLSVTPGEKVTITCQASQDIGNYLNWYQQKPGQTPKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24611 - protein, 107 aa, Artificial Sequence
  Description of Artificial Sequence: Synthetic polypeptide
  VL of XENP021589
DIQMTQSPAFLSVTPGEKVTITCQASQDIGNYLNWYQQKPGQTPKLLIYYTSRLHSGVPSRFSGSGSGTDYTFTISSLEAEDAATYFCQQGNTLPYTFGGGTKVEIK

SEQ ID NO: 24612 - protein, 11 aa, Artificial Sequence
  Description of Artificial Sequence: Synthetic peptide
  XENP021589 vlCDR1
QASQDIGNYLN

SEQ ID NO: 24613 - protein, 7 aa, Artificial Sequence
  Description of Artificial Sequence: Synthetic peptide
  XENP021589 vlCDR2
YTSRLHS

SEQ ID NO: 24614 - protein, 9 aa, Artificial Sequence
  Description of Artificial Sequence: Synthetic peptide
  XENP021589 vlCDR3
QQGNTLPYT

SEQ ID NO: 24615 - protein, 447 aa, Artificial Sequence; identical to SEQ ID NO: 17235
  Description of Artificial Sequence: Synthetic polypeptide
  XENP021590 2A11_H1_L2.99_Fab-1G6_L1.194_H1.279 Fab-Fc Heavy Chain

SEQ ID NO: 24616 - protein, 118 aa, Artificial Sequence; identical to SEQ ID NO: 17236
  Description of Artificial Sequence: Synthetic polypeptide
  VH of XENP021590

SEQ ID NO: 24617 - protein, 5 aa, Artificial Sequence
  Description of Artificial Sequence: Synthetic peptide
  XENP021590 vhCDR1
DYYMH

SEQ ID NO: 24618 - protein, 17 aa, Artificial Sequence
  Description of Artificial Sequence: Synthetic peptide
  XENP021590 vhCDR2
WIDPENGDTEYAPKFQG

SEQ ID NO: 24619 - protein, 9 aa, Artificial Sequence
  Description of Artificial Sequence: Synthetic peptide
  XENP021590 vhCDR3
RGVRQALDY

SEQ ID NO: 24620 - protein, 480 aa, Artificial Sequence; identical to SEQ ID NO: 23221
  Description of Artificial Sequence: Synthetic polypeptide
  XENP021590 2A11_H1_L2.99_Fab-1G6_L1.194_H1.279 scFv-Fc Heavy Chain

SEQ ID NO: 24621 - protein, 107 aa, Artificial Sequence; identical to SEQ ID NO: 10999
  Description of Artificial Sequence: Synthetic polypeptide
  VH of XENP021590

SEQ ID NO: 24622 - protein, 122 aa, Artificial Sequence; identical to SEQ ID NO: 10908
  Description of Artificial Sequence: Synthetic polypeptide
  VL of XENP021590

SEQ ID NO: 24623 - protein, 231 aa, Artificial Sequence; identical to SEQ ID NO: 21532
  Description of Artificial Sequence: Synthetic polypeptide
  Fc chain of XENP021590

SEQ ID NO: 24624 - protein, 11 aa, Artificial Sequence
  Description of Artificial Sequence: Synthetic peptide
  XENP021590 vhCDR1
RASQSVGNDVA

SEQ ID NO: 24625 - protein, 7 aa, Artificial Sequence
  Description of Artificial Sequence: Synthetic peptide
  XENP021590 vhCDR2
YASHRYT

SEQ ID NO: 24626 - protein, 9 aa, Artificial Sequence
  Description of Artificial Sequence: Synthetic peptide
  XENP021590 vhCDR3
QQDFSSPRT

SEQ ID NO: 24627 - protein, 5 aa, Artificial Sequence
  Description of Artificial Sequence: Synthetic peptide
  XENP021590 vlCDR1
NYWMN

SEQ ID NO: 24628 - protein, 19 aa, Artificial Sequence
  Description of Artificial Sequence: Synthetic peptide
  XENP021590 vlCDR2
EIRLYSNNYATHYAESVKG

SEQ ID NO: 24629 - protein, 11 aa, Artificial Sequence
  Description of Artificial Sequence: Synthetic peptide
  XENP021590 vlCDR3
YYGNYGGYFDV

SEQ ID NO: 24630 - protein, 214 aa, Artificial Sequence
  Description of Artificial Sequence: Synthetic polypeptide
  XENP021590 2A11_H1_L2.99_Fab-1G6_L1.194_H1.279 Light Chain
DIQMTQSPAFLSVTPGEKVTITCQASQDIGNYLNWYQQKPGQTPKLLIYYTSRLHSGVPSRFSGSGSGTDYTFTISSLEAEDAATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24631 - protein, 107 aa, Artificial Sequence
  Description of Artificial Sequence: Synthetic polypeptide
  VL of XENP021590
DIQMTQSPAFLSVTPGEKVTITCQASQDIGNYLNWYQQKPGQTPKLLIYYTSRLHSGVPSRFSGSGSGTDYTFTISSLEAEDAATYYCQQGNTLPYTFGGGTKVEIK

SEQ ID NO: 24632 - protein, 11 aa, Artificial Sequence
  Description of Artificial Sequence: Synthetic peptide
  XENP021590 vlCDR1
QASQDIGNYLN

SEQ ID NO: 24633 - protein, 7 aa, Artificial Sequence
  Description of Artificial Sequence: Synthetic peptide
  XENP021590 vlCDR2
YTSRLHS

SEQ ID NO: 24634 - protein, 9 aa, Artificial Sequence
  Description of Artificial Sequence: Synthetic peptide
  XENP021590 vlCDR3
QQGNTLPYT

SEQ ID NO: 24635 - protein, 447 aa, Artificial Sequence; identical to SEQ ID NO: 17235
  Description of Artificial Sequence: Synthetic polypeptide
  XENP021591 2A11_H1_L2.100_Fab-1G6_L1.194_H1.279 Fab-Fc Heavy Chain

SEQ ID NO: 24636 - protein, 118 aa, Artificial Sequence; identical to SEQ ID NO: 17236
  Description of Artificial Sequence: Synthetic polypeptide
  VH of XENP021591

SEQ ID NO: 24637 - protein, 5 aa, Artificial Sequence
  Description of Artificial Sequence: Synthetic peptide
  XENP021591 vhCDR1
DYYMH

SEQ ID NO: 24638 - protein, 17 aa, Artificial Sequence
  Description of Artificial Sequence: Synthetic peptide
  XENP021591 vhCDR2
WIDPENGDTEYAPKFQG

SEQ ID NO: 24639 - protein, 9 aa, Artificial Sequence
  Description of Artificial Sequence: Synthetic peptide
  XENP021591 vhCDR3
RGVRQALDY

SEQ ID NO: 24640 - protein, 480 aa, Artificial Sequence; identical to SEQ ID NO: 23221
  Description of Artificial Sequence: Synthetic polypeptide
  XENP021591 2A11_H1_L2.100_Fab-1G6_L1.194_H1.279 scFv-Fc Heavy Chain

SEQ ID NO: 24641 - protein, 107 aa, Artificial Sequence; identical to SEQ ID NO: 10999
  Description of Artificial Sequence: Synthetic polypeptide
  VH of XENP021591

SEQ ID NO: 24642 - protein, 122 aa, Artificial Sequence; identical to SEQ ID NO: 10908
  Description of Artificial Sequence: Synthetic polypeptide
  VL of XENP021591

SEQ ID NO: 24643 - protein, 231 aa, Artificial Sequence; identical to SEQ ID NO: 21532
  Description of Artificial Sequence: Synthetic polypeptide
  Fc chain of XENP021591

SEQ ID NO: 24644 - protein, 11 aa, Artificial Sequence
  Description of Artificial Sequence: Synthetic peptide
  XENP021591 vhCDR1
RASQSVGNDVA

SEQ ID NO: 24645 - protein, 7 aa, Artificial Sequence
  Description of Artificial Sequence: Synthetic peptide
  XENP021591 vhCDR2
YASHRYT

SEQ ID NO: 24646 - protein, 9 aa, Artificial Sequence
  Description of Artificial Sequence: Synthetic peptide
  XENP021591 vhCDR3
QQDFSSPRT

SEQ ID NO: 24647 - protein, 5 aa, Artificial Sequence
  Description of Artificial Sequence: Synthetic peptide
  XENP021591 vlCDR1
NYWMN

SEQ ID NO: 24648 - protein, 19 aa, Artificial Sequence
  Description of Artificial Sequence: Synthetic peptide
  XENP021591 vlCDR2
EIRLYSNNYATHYAESVKG

SEQ ID NO: 24649 - protein, 11 aa, Artificial Sequence
  Description of Artificial Sequence: Synthetic peptide
  XENP021591 vlCDR3
YYGNYGGYFDV

SEQ ID NO: 24650 - protein, 214 aa, Artificial Sequence
  Description of Artificial Sequence: Synthetic polypeptide
  XENP021591 2A11_H1_L2.100_Fab-1G6_L1.194_H1.279 Light Chain
DIQMTQSPAFLSVTPGEKVTITCQASQDIGNYLNWFQQKPGQTPKLLIYYTSRLHSGVPSRFSGSGSGTDYTFTISSLEAEDAATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24651 - protein, 107 aa, Artificial Sequence
  Description of Artificial Sequence: Synthetic polypeptide
  VL of XENP021591
DIQMTQSPAFLSVTPGEKVTITCQASQDIGNYLNWFQQKPGQTPKLLIYYTSRLHSGVPSRFSGSGSGTDYTFTISSLEAEDAATYYCQQGNTLPYTFGGGTKVEIK

SEQ ID NO: 24652 - protein, 11 aa, Artificial Sequence
  Description of Artificial Sequence: Synthetic peptide
  XENP021591 vlCDR1
QASQDIGNYLN

SEQ ID NO: 24653 - protein, 7 aa, Artificial Sequence
  Description of Artificial Sequence: Synthetic peptide
  XENP021591 vlCDR2
YTSRLHS

SEQ ID NO: 24654 - protein, 9 aa, Artificial Sequence
  Description of Artificial Sequence: Synthetic peptide
  XENP021591 vlCDR3
QQGNTLPYT

SEQ ID NO: 24655 - protein, 447 aa, Artificial Sequence; identical to SEQ ID NO: 17235
  Description of Artificial Sequence: Synthetic polypeptide
  XENP021592 2A11_H1_L2.101_Fab-1G6_L1.194_H1.279 Fab-Fc Heavy Chain

SEQ ID NO: 24656 - protein, 118 aa, Artificial Sequence; identical to SEQ ID NO: 17236
  Description of Artificial Sequence: Synthetic polypeptide
  VH of XENP021592

SEQ ID NO: 24657 - protein, 5 aa, Artificial Sequence
  Description of Artificial Sequence: Synthetic peptide
  XENP021592 vhCDR1
DYYMH

SEQ ID NO: 24658 - protein, 17 aa, Artificial Sequence
  Description of Artificial Sequence: Synthetic peptide
  XENP021592 vhCDR2
WIDPENGDTEYAPKFQG

SEQ ID NO: 24659 - protein, 9 aa, Artificial Sequence
  Description of Artificial Sequence: Synthetic peptide
  XENP021592 vhCDR3
RGVRQALDY

SEQ ID NO: 24660 - protein, 480 aa, Artificial Sequence; identical to SEQ ID NO: 23221
  Description of Artificial Sequence: Synthetic polypeptide
  XENP021592 2A11_H1_L2.101_Fab-1G6_L1.194_H1.279 scFv-Fc Heavy Chain

SEQ ID NO: 24661 - protein, 107 aa, Artificial Sequence; identical to SEQ ID NO: 10999
  Description of Artificial Sequence: Synthetic polypeptide
  VH of XENP021592

SEQ ID NO: 24662 - protein, 122 aa, Artificial Sequence; identical to SEQ ID NO: 10908
  Description of Artificial Sequence: Synthetic polypeptide
  VL of XENP021592

SEQ ID NO: 24663 - protein, 231 aa, Artificial Sequence; identical to SEQ ID NO: 21532
  Description of Artificial Sequence: Synthetic polypeptide
  Fc chain of XENP021592

SEQ ID NO: 24664 - protein, 11 aa, Artificial Sequence
  Description of Artificial Sequence: Synthetic peptide
  XENP021592 vhCDR1
RASQSVGNDVA

SEQ ID NO: 24665 - protein, 7 aa, Artificial Sequence
  Description of Artificial Sequence: Synthetic peptide
  XENP021592 vhCDR2
YASHRYT

SEQ ID NO: 24666 - protein, 9 aa, Artificial Sequence
  Description of Artificial Sequence: Synthetic peptide
  XENP021592 vhCDR3
QQDFSSPRT

SEQ ID NO: 24667 - protein, 5 aa, Artificial Sequence
  Description of Artificial Sequence: Synthetic peptide
  XENP021592 vlCDR1
NYWMN

SEQ ID NO: 24668 - protein, 19 aa, Artificial Sequence
  Description of Artificial Sequence: Synthetic peptide
  XENP021592 vlCDR2
EIRLYSNNYATHYAESVKG

SEQ ID NO: 24669 - protein, 11 aa, Artificial Sequence
  Description of Artificial Sequence: Synthetic peptide
  XENP021592 vlCDR3
YYGNYGGYFDV

SEQ ID NO: 24670 - protein, 214 aa, Artificial Sequence
  Description of Artificial Sequence: Synthetic polypeptide
  XENP021592 2A11_H1_L2.101_Fab-1G6_L1.194_H1.279 Light Chain
DIQMTQSPAFLSVTPGEKVTITCQASQDIGNYLNWYQQKPDQTVKLLIYYTSRLHSGVPSRFSGSGSGTDYTFTISSLEAEDAATYYCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24671 - protein, 107 aa, Artificial Sequence
  Description of Artificial Sequence: Synthetic polypeptide
  VL of XENP021592
DIQMTQSPAFLSVTPGEKVTITCQASQDIGNYLNWYQQKPDQTVKLLIYYTSRLHSGVPSRFSGSGSGTDYTFTISSLEAEDAATYYCQQGNTLPYTFGGGTKVEIK

SEQ ID NO: 24672 - protein, 11 aa, Artificial Sequence
  Description of Artificial Sequence: Synthetic peptide
  XENP021592 vlCDR1
QASQDIGNYLN

SEQ ID NO: 24673 - protein, 7 aa, Artificial Sequence
  Description of Artificial Sequence: Synthetic peptide
  XENP021592 vlCDR2
YTSRLHS

SEQ ID NO: 24674 - protein, 9 aa, Artificial Sequence
  Description of Artificial Sequence: Synthetic peptide
  XENP021592 vlCDR3
QQGNTLPYT

SEQ ID NO: 24675 - protein, 447 aa, Artificial Sequence; identical to SEQ ID NO: 17235
  Description of Artificial Sequence: Synthetic polypeptide
  XENP022123 2A11_H1_L2.122_Fab-1G6_L1.194_H1.279 Fab-Fc Heavy Chain

SEQ ID NO: 24676 - protein, 118 aa, Artificial Sequence; identical to SEQ ID NO: 17236
  Description of Artificial Sequence: Synthetic polypeptide
  VH of XENP022123

SEQ ID NO: 24677 - protein, 5 aa, Artificial Sequence
  Description of Artificial Sequence: Synthetic peptide
  XENP022123 vhCDR1
DYYMH

SEQ ID NO: 24678 - protein, 17 aa, Artificial Sequence
  Description of Artificial Sequence: Synthetic peptide
  XENP022123 vhCDR2
WIDPENGDTEYAPKFQG

SEQ ID NO: 24679 - protein, 9 aa, Artificial Sequence
  Description of Artificial Sequence: Synthetic peptide
  XENP022123 vhCDR3
RGVRQALDY

SEQ ID NO: 24680 - protein, 480 aa, Artificial Sequence; identical to SEQ ID NO: 23221
  Description of Artificial Sequence: Synthetic polypeptide
  XENP022123 2A11_H1_L2.122_Fab-1G6_L1.194_H1.279 scFv-Fc Heavy Chain

SEQ ID NO: 24681 - protein, 107 aa, Artificial Sequence; identical to SEQ ID NO: 10999
  Description of Artificial Sequence: Synthetic polypeptide
  VH of XENP022123

SEQ ID NO: 24682 - protein, 122 aa, Artificial Sequence; identical to SEQ ID NO: 10908
  Description of Artificial Sequence: Synthetic polypeptide
  VL of XENP022123

SEQ ID NO: 24683 - protein, 231 aa, Artificial Sequence; identical to SEQ ID NO: 21532
  Description of Artificial Sequence: Synthetic polypeptide
  Fc chain of XENP022123

SEQ ID NO: 24684 - protein, 11 aa, Artificial Sequence
  Description of Artificial Sequence: Synthetic peptide
  XENP022123 vhCDR1
RASQSVGNDVA

SEQ ID NO: 24685 - protein, 7 aa, Artificial Sequence
  Description of Artificial Sequence: Synthetic peptide
  XENP022123 vhCDR2
YASHRYT

SEQ ID NO: 24686 - protein, 9 aa, Artificial Sequence
  Description of Artificial Sequence: Synthetic peptide
  XENP022123 vhCDR3
QQDFSSPRT

SEQ ID NO: 24687 - protein, 5 aa, Artificial Sequence
  Description of Artificial Sequence: Synthetic peptide
  XENP022123 vlCDR1
NYWMN

SEQ ID NO: 24688 - protein, 19 aa, Artificial Sequence
  Description of Artificial Sequence: Synthetic peptide
  XENP022123 vlCDR2
EIRLYSNNYATHYAESVKG

SEQ ID NO: 24689 - protein, 11 aa, Artificial Sequence
  Description of Artificial Sequence: Synthetic peptide
  XENP022123 vlCDR3
YYGNYGGYFDV

SEQ ID NO: 24690 - protein, 214 aa, Artificial Sequence
  Description of Artificial Sequence: Synthetic polypeptide
  XENP022123 2A11_H1_L2.122_Fab-1G6_L1.194_H1.279 Light Chain
DIQMTQSPAFLSVTPGEKVTITCQASQDIGNYLNWFQQKPGQTPKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24691 - protein, 107 aa, Artificial Sequence
  Description of Artificial Sequence: Synthetic polypeptide
  VL of XENP022123
DIQMTQSPAFLSVTPGEKVTITCQASQDIGNYLNWFQQKPGQTPKLLIYYTSRLHSGVPSRFSGSGSGTDYTFTISSLEAEDAATYFCQQGNTLPYTFGGGTKVEIK

SEQ ID NO: 24692 - protein, 11 aa, Artificial Sequence
  Description of Artificial Sequence: Synthetic peptide
  XENP022123 vlCDR1
QASQDIGNYLN

SEQ ID NO: 24693 - protein, 7 aa, Artificial Sequence
  Description of Artificial Sequence: Synthetic peptide
  XENP022123 vlCDR2
YTSRLHS

SEQ ID NO: 24694 - protein, 9 aa, Artificial Sequence
  Description of Artificial Sequence: Synthetic peptide
  XENP022123 vlCDR3
QQGNTLPYT

SEQ ID NO: 24695 - protein, 447 aa, Artificial Sequence; identical to SEQ ID NO: 17235
  Description of Artificial Sequence: Synthetic polypeptide
  XENP022124 2A11_H1_L2.123_Fab-1G6_L1.194_H1.279 Fab-Fc Heavy Chain

SEQ ID NO: 24696 - protein, 118 aa, Artificial Sequence; identical to SEQ ID NO: 17236
  Description of Artificial Sequence: Synthetic polypeptide
  VH of XENP022124

SEQ ID NO: 24697 - protein, 5 aa, Artificial Sequence
  Description of Artificial Sequence: Synthetic peptide
  XENP022124 vhCDR1
DYYMH

SEQ ID NO: 24698 - protein, 17 aa, Artificial Sequence
  Description of Artificial Sequence: Synthetic peptide
  XENP022124 vhCDR2
WIDPENGDTEYAPKFQG

SEQ ID NO: 24699 - protein, 9 aa, Artificial Sequence
  Description of Artificial Sequence: Synthetic peptide
  XENP022124 vhCDR3
RGVRQALDY

SEQ ID NO: 24700 - protein, 480 aa, Artificial Sequence; identical to SEQ ID NO: 23221
  Description of Artificial Sequence: Synthetic polypeptide
  XENP022124 2A11_H1_L2.123_Fab-1G6_L1.194_H1.279 scFv-Fc Heavy Chain

SEQ ID NO: 24701 - protein, 107 aa, Artificial Sequence; identical to SEQ ID NO: 10999
  Description of Artificial Sequence: Synthetic polypeptide
  VH of XENP022124

SEQ ID NO: 24702 - protein, 122 aa, Artificial Sequence; identical to SEQ ID NO: 10908
  Description of Artificial Sequence: Synthetic polypeptide
  VL of XENP022124

SEQ ID NO: 24703 - protein, 231 aa, Artificial Sequence; identical to SEQ ID NO: 21532
  Description of Artificial Sequence: Synthetic polypeptide
  Fc chain of XENP022124

SEQ ID NO: 24704 - protein, 11 aa, Artificial Sequence
  Description of Artificial Sequence: Synthetic peptide
  XENP022124 vhCDR1
RASQSVGNDVA

SEQ ID NO: 24705 - protein, 7 aa, Artificial Sequence
  Description of Artificial Sequence: Synthetic peptide
  XENP022124 vhCDR2
YASHRYT

SEQ ID NO: 24706 - protein, 9 aa, Artificial Sequence
  Description of Artificial Sequence: Synthetic peptide
  XENP022124 vhCDR3
QQDFSSPRT

SEQ ID NO: 24707 - protein, 5 aa, Artificial Sequence
  Description of Artificial Sequence: Synthetic peptide
  XENP022124 vlCDR1
NYWMN

SEQ ID NO: 24708 - protein, 19 aa, Artificial Sequence
  Description of Artificial Sequence: Synthetic peptide
  XENP022124 vlCDR2
EIRLYSNNYATHYAESVKG

SEQ ID NO: 24709 - protein, 11 aa, Artificial Sequence
  Description of Artificial Sequence: Synthetic peptide
  XENP022124 vlCDR3
YYGNYGGYFDV

SEQ ID NO: 24710 - protein, 214 aa, Artificial Sequence
  Description of Artificial Sequence: Synthetic polypeptide
  XENP022124 2A11_H1_L2.123_Fab-1G6_L1.194_H1.279 Light Chain
DIQMTQSPAFLSVTPGEKVTITCQASQDIGNYLNWFQQKPGQSPKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24711 - protein, 107 aa, Artificial Sequence
  Description of Artificial Sequence: Synthetic polypeptide
  VL of XENP022124
DIQMTQSPAFLSVTPGEKVTITCQASQDIGNYLNWFQQKPGQSPKLLIYYTSRLHSGVPSRFSGSGSGTDYTFTISSLEAEDAATYFCQQGNTLPYTFGGGTKVEIK

SEQ ID NO: 24712 - protein, 11 aa, Artificial Sequence
  Description of Artificial Sequence: Synthetic peptide
  XENP022124 vlCDR1
QASQDIGNYLN

SEQ ID NO: 24713 - protein, 7 aa, Artificial Sequence
  Description of Artificial Sequence: Synthetic peptide
  XENP022124 vlCDR2
YTSRLHS

SEQ ID NO: 24714 - protein, 9 aa, Artificial Sequence
  Description of Artificial Sequence: Synthetic peptide
  XENP022124 vlCDR3
QQGNTLPYT

SEQ ID NO: 24715 - protein, 447 aa, Artificial Sequence; identical to SEQ ID NO: 17235
  Description of Artificial Sequence: Synthetic polypeptide
  XENP022125 2A11_H1_L2.124_Fab-1G6_L1.194_H1.279 Fab-Fc Heavy Chain

SEQ ID NO: 24716 - protein, 118 aa, Artificial Sequence; identical to SEQ ID NO: 17236
  Description of Artificial Sequence: Synthetic polypeptide
  VH of XENP022125

SEQ ID NO: 24717 - protein, 5 aa, Artificial Sequence
  Description of Artificial Sequence: Synthetic peptide
  XENP022125 vhCDR1
DYYMH

SEQ ID NO: 24718 - protein, 17 aa, Artificial Sequence
  Description of Artificial Sequence: Synthetic peptide
  XENP022125 vhCDR2
WIDPENGDTEYAPKFQG

SEQ ID NO: 24719 - protein, 9 aa, Artificial Sequence
  Description of Artificial Sequence: Synthetic peptide
  XENP022125 vhCDR3
RGVRQALDY

SEQ ID NO: 24720 - protein, 480 aa, Artificial Sequence; identical to SEQ ID NO: 23221
  Description of Artificial Sequence: Synthetic polypeptide
  XENP022125 2A11_H1_L2.124_Fab-1G6_L1.194_H1.279 scFv-Fc Heavy Chain

SEQ ID NO: 24721 - protein, 107 aa, Artificial Sequence; identical to SEQ ID NO: 10999
  Description of Artificial Sequence: Synthetic polypeptide
  VH of XENP022125

SEQ ID NO: 24722 - protein, 122 aa, Artificial Sequence; identical to SEQ ID NO: 10908
  Description of Artificial Sequence: Synthetic polypeptide
  VL of XENP022125

SEQ ID NO: 24723 - protein, 231 aa, Artificial Sequence; identical to SEQ ID NO: 21532
  Description of Artificial Sequence: Synthetic polypeptide
  Fc chain of XENP022125

SEQ ID NO: 24724 - protein, 11 aa, Artificial Sequence
  Description of Artificial Sequence: Synthetic peptide
  XENP022125 vhCDR1
RASQSVGNDVA

SEQ ID NO: 24725 - protein, 7 aa, Artificial Sequence
  Description of Artificial Sequence: Synthetic peptide
  XENP022125 vhCDR2
YASHRYT

SEQ ID NO: 24726 - protein, 9 aa, Artificial Sequence
  Description of Artificial Sequence: Synthetic peptide
  XENP022125 vhCDR3
QQDFSSPRT

SEQ ID NO: 24727 - protein, 5 aa, Artificial Sequence
  Description of Artificial Sequence: Synthetic peptide
  XENP022125 vlCDR1
NYWMN

SEQ ID NO: 24728 - protein, 19 aa, Artificial Sequence
  Description of Artificial Sequence: Synthetic peptide
  XENP022125 vlCDR2
EIRLYSNNYATHYAESVKG

SEQ ID NO: 24729 - protein, 11 aa, Artificial Sequence
  Description of Artificial Sequence: Synthetic peptide
  XENP022125 vlCDR3
YYGNYGGYFDV

SEQ ID NO: 24730 - protein, 214 aa, Artificial Sequence
  Description of Artificial Sequence: Synthetic polypeptide
  XENP022125 2A11_H1_L2.124_Fab-1G6_L1.194_H1.279 Light Chain
DIQMTQSPAFLSVTPGEKVTITCQASQDIGNYLNWFQQKPGKVPKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24731 - protein, 107 aa, Artificial Sequence
  Description of Artificial Sequence: Synthetic polypeptide
  VL of XENP022125
DIQMTQSPAFLSVTPGEKVTITCQASQDIGNYLNWFQQKPGKVPKLLIYYTSRLHSGVPSRFSGSGSGTDYTFTISSLEAEDAATYFCQQGNTLPYTFGGGTKVEIK

SEQ ID NO: 24732 - protein, 11 aa, Artificial Sequence
  Description of Artificial Sequence: Synthetic peptide
  XENP022125 vlCDR1
QASQDIGNYLN

SEQ ID NO: 24733 - protein, 7 aa, Artificial Sequence
  Description of Artificial Sequence: Synthetic peptide
  XENP022125 vlCDR2
YTSRLHS

SEQ ID NO: 24734 - protein, 9 aa, Artificial Sequence
  Description of Artificial Sequence: Synthetic peptide
  XENP022125 vlCDR3
QQGNTLPYT

SEQ ID NO: 24735 - protein, 447 aa, Artificial Sequence; identical to SEQ ID NO: 22064
  Description of Artificial Sequence: Synthetic polypeptide
  XENP022626 2A11_H1.125_L2.132_Fab-1G6_L1.194_H1.279 Fab-Fc Heavy Chain

SEQ ID NO: 24736 - protein, 118 aa, Artificial Sequence; identical to SEQ ID NO: 22065
  Description of Artificial Sequence: Synthetic polypeptide
  VH of XENP022626

SEQ ID NO: 24737 - protein, 5 aa, Artificial Sequence
  Description of Artificial Sequence: Synthetic peptide
  XENP022626 vhCDR1
HYFMH

SEQ ID NO: 24738 - protein, 17 aa, Artificial Sequence
  Description of Artificial Sequence: Synthetic peptide
  XENP022626 vhCDR2
WIDPYLGDTEYAPKFQG

SEQ ID NO: 24739 - protein, 9 aa, Artificial Sequence
  Description of Artificial Sequence: Synthetic peptide
  XENP022626 vhCDR3
RGVYQALDY

SEQ ID NO: 24740 - protein, 480 aa, Artificial Sequence; identical to SEQ ID NO: 23221
  Description of Artificial Sequence: Synthetic polypeptide
  XENP022626 2A11_H1.125_L2.132_Fab-1G6_L1.194_H1.279 scFv-Fc Heavy Chain

SEQ ID NO: 24741 - protein, 107 aa, Artificial Sequence; identical to SEQ ID NO: 10999
  Description of Artificial Sequence: Synthetic polypeptide
  VH of XENP022626

SEQ ID NO: 24742 - protein, 122 aa, Artificial Sequence; identical to SEQ ID NO: 10908
  Description of Artificial Sequence: Synthetic polypeptide
  VL of XENP022626

SEQ ID NO: 24743 - protein, 231 aa, Artificial Sequence; identical to SEQ ID NO: 21532
  Description of Artificial Sequence: Synthetic polypeptide
  Fc chain of XENP022626

SEQ ID NO: 24744 - protein, 11 aa, Artificial Sequence
  Description of Artificial Sequence: Synthetic peptide
  XENP022626 vhCDR1
RASQSVGNDVA

SEQ ID NO: 24745 - protein, 7 aa, Artificial Sequence
  Description of Artificial Sequence: Synthetic peptide
  XENP022626 vhCDR2
YASHRYT

SEQ ID NO: 24746 - protein, 9 aa, Artificial Sequence
  Description of Artificial Sequence: Synthetic peptide
  XENP022626 vhCDR3
QQDFSSPRT

SEQ ID NO: 24747 - protein, 5 aa, Artificial Sequence
  Description of Artificial Sequence: Synthetic peptide
  XENP022626 vlCDR1
NYWMN

SEQ ID NO: 24748 - protein, 19 aa, Artificial Sequence
  Description of Artificial Sequence: Synthetic peptide
  XENP022626 vlCDR2
EIRLYSNNYATHYAESVKG

SEQ ID NO: 24749 - protein, 11 aa, Artificial Sequence
  Description of Artificial Sequence: Synthetic peptide
  XENP022626 vlCDR3
YYGNYGGYFDV

SEQ ID NO: 24750 - protein, 214 aa, Artificial Sequence; identical to SEQ ID NO: 22219
  Description of Artificial Sequence: Synthetic polypeptide
  XENP022626 2A11_H1.125_L2.132_Fab-1G6_L1.194_H1.279 Light Chain

SEQ ID NO: 24751 - protein, 107 aa, Artificial Sequence; identical to SEQ ID NO: 22220
  Description of Artificial Sequence: Synthetic polypeptide
  VL of XENP022626

SEQ ID NO: 24752 - protein, 11 aa, Artificial Sequence
  Description of Artificial Sequence: Synthetic peptide
  XENP022626 vlCDR1
QASQDIGNYLN

SEQ ID NO: 24753 - protein, 7 aa, Artificial Sequence
  Description of Artificial Sequence: Synthetic peptide
  XENP022626 vlCDR2
FTSYLHS

SEQ ID NO: 24754 - protein, 9 aa, Artificial Sequence
  Description of Artificial Sequence: Synthetic peptide
  XENP022626 vlCDR3
QEGNTLPYT

SEQ ID NO: 24755 - protein, 447 aa, Artificial Sequence; identical to SEQ ID NO: 22084
  Description of Artificial Sequence: Synthetic polypeptide
  XENP022627 2A11_H1.144_L2.133_Fab-1G6_L1.194_H1.279 Fab-Fc Heavy Chain

SEQ ID NO: 24756 - protein, 118 aa, Artificial Sequence; identical to SEQ ID NO: 22085
  Description of Artificial Sequence: Synthetic polypeptide
  VH of XENP022627

SEQ ID NO: 24757 - protein, 5 aa, Artificial Sequence
  Description of Artificial Sequence: Synthetic peptide
  XENP022627 vhCDR1
DYFMH

SEQ ID NO: 24758 - protein, 17 aa, Artificial Sequence
  Description of Artificial Sequence: Synthetic peptide
  XENP022627 vhCDR2
WIDPELGDTEYAPKFQG

SEQ ID NO: 24759 - protein, 9 aa, Artificial Sequence
  Description of Artificial Sequence: Synthetic peptide
  XENP022627 vhCDR3
RGVYQALDY

SEQ ID NO: 24760 - protein, 480 aa, Artificial Sequence; identical to SEQ ID NO: 23221
  Description of Artificial Sequence: Synthetic polypeptide
  XENP022627 2A11_H1.144_L2.133_Fab-1G6_L1.194_H1.279 scFv-Fc Heavy Chain

SEQ ID NO: 24761 - protein, 107 aa, Artificial Sequence; identical to SEQ ID NO: 10999
  Description of Artificial Sequence: Synthetic polypeptide
  VH of XENP022627

SEQ ID NO: 24762 - protein, 122 aa, Artificial Sequence; identical to SEQ ID NO: 10908
  Description of Artificial Sequence: Synthetic polypeptide
  VL of XENP022627

SEQ ID NO: 24763 - protein, 231 aa, Artificial Sequence; identical to SEQ ID NO: 21532
  Description of Artificial Sequence: Synthetic polypeptide
  Fc chain of XENP022627

SEQ ID NO: 24764 - protein, 11 aa, Artificial Sequence
  Description of Artificial Sequence: Synthetic peptide
  XENP022627 vhCDR1
RASQSVGNDVA

SEQ ID NO: 24765 - protein, 7 aa, Artificial Sequence
  Description of Artificial Sequence: Synthetic peptide
  XENP022627 vhCDR2
YASHRYT

SEQ ID NO: 24766 - protein, 9 aa, Artificial Sequence
  Description of Artificial Sequence: Synthetic peptide
  XENP022627 vhCDR3
QQDFSSPRT

SEQ ID NO: 24767 - protein, 5 aa, Artificial Sequence
  Description of Artificial Sequence: Synthetic peptide
  XENP022627 vlCDR1
NYWMN

SEQ ID NO: 24768 - protein, 19 aa, Artificial Sequence
  Description of Artificial Sequence: Synthetic peptide
  XENP022627 vlCDR2
EIRLYSNNYATHYAESVKG

SEQ ID NO: 24769 - protein, 11 aa, Artificial Sequence
  Description of Artificial Sequence: Synthetic peptide
  XENP022627 vlCDR3
YYGNYGGYFDV

SEQ ID NO: 24770 - protein, 214 aa, Artificial Sequence; identical to SEQ ID NO: 22199
  Description of Artificial Sequence: Synthetic polypeptide
  XENP022627 2A11_H1.144_L2.133_Fab-1G6_L1.194_H1.279 Light Chain

SEQ ID NO: 24771 - protein, 107 aa, Artificial Sequence; identical to SEQ ID NO: 22200
  Description of Artificial Sequence: Synthetic polypeptide
  VL of XENP022627

SEQ ID NO: 24772 - protein, 11 aa, Artificial Sequence
  Description of Artificial Sequence: Synthetic peptide
  XENP022627 vlCDR1
QASQDIGNYLN

SEQ ID NO: 24773 - protein, 7 aa, Artificial Sequence
  Description of Artificial Sequence: Synthetic peptide
  XENP022627 vlCDR2
FTSYLHS

SEQ ID NO: 24774 - protein, 9 aa, Artificial Sequence
  Description of Artificial Sequence: Synthetic peptide
  XENP022627 vlCDR3
QEGNTLPYT

SEQ ID NO: 24775 - protein, 447 aa, Artificial Sequence; identical to SEQ ID NO: 22064
  Description of Artificial Sequence: Synthetic polypeptide
  XENP022628 2A11_H1.125_L2.113_Fab-1G6_L1.194_H1.279 Fab-Fc Heavy Chain

SEQ ID NO: 24776 - protein, 118 aa, Artificial Sequence; identical to SEQ ID NO: 22065
  Description of Artificial Sequence: Synthetic polypeptide
  VH of XENP022628

SEQ ID NO: 24777 - protein, 5 aa, Artificial Sequence
  Description of Artificial Sequence: Synthetic peptide
  XENP022628 vhCDR1
HYFMH

SEQ ID NO: 24778 - protein, 17 aa, Artificial Sequence
  Description of Artificial Sequence: Synthetic peptide
  XENP022628 vhCDR2
WIDPYLGDTEYAPKFQG

SEQ ID NO: 24779 - protein, 9 aa, Artificial Sequence
  Description of Artificial Sequence: Synthetic peptide
  XENP022628 vhCDR3
RGVYQALDY

SEQ ID NO: 24780 - protein, 480 aa, Artificial Sequence; identical to SEQ ID NO: 23221
  Description of Artificial Sequence: Synthetic polypeptide
  XENP022628 2A11_H1.125_L2.113_Fab-1G6_L1.194_H1.279 scFv-Fc Heavy Chain

SEQ ID NO: 24781 - protein, 107 aa, Artificial Sequence; identical to SEQ ID NO: 10999
  Description of Artificial Sequence: Synthetic polypeptide
  VH of XENP022628

SEQ ID NO: 24782 - protein, 122 aa, Artificial Sequence; identical to SEQ ID NO: 10908
  Description of Artificial Sequence: Synthetic polypeptide
  VL of XENP022628

SEQ ID NO: 24783 - protein, 231 aa, Artificial Sequence; identical to SEQ ID NO: 21532
  Description of Artificial Sequence: Synthetic polypeptide
  Fc chain of XENP022628

SEQ ID NO: 24784 - protein, 11 aa, Artificial Sequence
  Description of Artificial Sequence: Synthetic peptide
  XENP022628 vhCDR1
RASQSVGNDVA

SEQ ID NO: 24785 - protein, 7 aa, Artificial Sequence
  Description of Artificial Sequence: Synthetic peptide
  XENP022628 vhCDR2
YASHRYT

SEQ ID NO: 24786 - protein, 9 aa, Artificial Sequence
  Description of Artificial Sequence: Synthetic peptide
  XENP022628 vhCDR3
QQDFSSPRT

SEQ ID NO: 24787 - protein, 5 aa, Artificial Sequence
  Description of Artificial Sequence: Synthetic peptide
  XENP022628 vlCDR1
NYWMN

SEQ ID NO: 24788 - protein, 19 aa, Artificial Sequence
  Description of Artificial Sequence: Synthetic peptide
  XENP022628 vlCDR2
EIRLYSNNYATHYAESVKG

SEQ ID NO: 24789 - protein, 11 aa, Artificial Sequence
  Description of Artificial Sequence: Synthetic peptide
  XENP022628 vlCDR3
YYGNYGGYFDV

SEQ ID NO: 24790 - protein, 214 aa, Artificial Sequence; identical to SEQ ID NO: 22079
  Description of Artificial Sequence: Synthetic polypeptide
  XENP022628 2A11_H1.125_L2.113_Fab-1G6_L1.194_H1.279 Light Chain

SEQ ID NO: 24791 - protein, 107 aa, Artificial Sequence; identical to SEQ ID NO: 22080
  Description of Artificial Sequence: Synthetic polypeptide
  VL of XENP022628

SEQ ID NO: 24792 - protein, 11 aa, Artificial Sequence
  Description of Artificial Sequence: Synthetic peptide
  XENP022628 vlCDR1
QASQDIGNYLN

SEQ ID NO: 24793 - protein, 7 aa, Artificial Sequence
  Description of Artificial Sequence: Synthetic peptide
  XENP022628 vlCDR2
FTSYLHS

SEQ ID NO: 24794 - protein, 9 aa, Artificial Sequence
  Description of Artificial Sequence: Synthetic peptide
  XENP022628 vlCDR3
QQGNTLPYT

SEQ ID NO: 24795 - protein, 447 aa, Artificial Sequence; identical to SEQ ID NO: 22084
  Description of Artificial Sequence: Synthetic polypeptide
  XENP022629 2A11_H1.144_L2.113_Fab-1G6_L1.194_H1.279 Fab-Fc Heavy Chain

SEQ ID NO: 24796 - protein, 118 aa, Artificial Sequence; identical to SEQ ID NO: 22085
  Description of Artificial Sequence: Synthetic polypeptide
  VH of XENP022629

SEQ ID NO: 24797 - protein, 5 aa, Artificial Sequence
  Description of Artificial Sequence: Synthetic peptide
  XENP022629 vhCDR1
DYFMH

SEQ ID NO: 24798 - protein, 17 aa, Artificial Sequence
  Description of Artificial Sequence: Synthetic peptide
  XENP022629 vhCDR2
WIDPELGDTEYAPKFQG

SEQ ID NO: 24799 - protein, 9 aa, Artificial Sequence
  Description of Artificial Sequence: Synthetic peptide
  XENP022629 vhCDR3
RGVYQALDY

SEQ ID NO: 24800 - protein, 480 aa, Artificial Sequence; identical to SEQ ID NO: 23221
  Description of Artificial Sequence: Synthetic polypeptide
  XENP022629 2A11_H1.144_L2.113_Fab-1G6_L1.194_H1.279 scFv-Fc Heavy Chain

SEQ ID NO: 24801 - protein, 107 aa, Artificial Sequence; identical to SEQ ID NO: 10999
  Description of Artificial Sequence: Synthetic polypeptide
  VH of XENP022629

SEQ ID NO: 24802 - protein, 122 aa, Artificial Sequence; identical to SEQ ID NO: 10908
  Description of Artificial Sequence: Synthetic polypeptide
  VL of XENP022629

SEQ ID NO: 24803 - protein, 231 aa, Artificial Sequence; identical to SEQ ID NO: 21532
  Description of Artificial Sequence: Synthetic polypeptide
  Fc chain of XENP022629

SEQ ID NO: 24804 - protein, 11 aa, Artificial Sequence
  Description of Artificial Sequence: Synthetic peptide
  XENP022629 vhCDR1
RASQSVGNDVA

SEQ ID NO: 24805 - protein, 7 aa, Artificial Sequence
  Description of Artificial Sequence: Synthetic peptide
  XENP022629 vhCDR2
YASHRYT

SEQ ID NO: 24806 - protein, 9 aa, Artificial Sequence
  Description of Artificial Sequence: Synthetic peptide
  XENP022629 vhCDR3
QQDFSSPRT

SEQ ID NO: 24807 - protein, 5 aa, Artificial Sequence
  Description of Artificial Sequence: Synthetic peptide
  XENP022629 vlCDR1
NYWMN

SEQ ID NO: 24808 - protein, 19 aa, Artificial Sequence
  Description of Artificial Sequence: Synthetic peptide
  XENP022629 vlCDR2
EIRLYSNNYATHYAESVKG

SEQ ID NO: 24809 - protein, 11 aa, Artificial Sequence
  Description of Artificial Sequence: Synthetic peptide
  XENP022629 vlCDR3
YYGNYGGYFDV

SEQ ID NO: 24810 - protein, 214 aa, Artificial Sequence; identical to SEQ ID NO: 22079
  Description of Artificial Sequence: Synthetic polypeptide
  XENP022629 2A11_H1.144_L2.113_Fab-1G6_L1.194_H1.279 Light Chain

SEQ ID NO: 24811 - protein, 107 aa, Artificial Sequence; identical to SEQ ID NO: 22080
  Description of Artificial Sequence: Synthetic polypeptide
  VL of XENP022629

SEQ ID NO: 24812 - protein, 11 aa, Artificial Sequence
  Description of Artificial Sequence: Synthetic peptide
  XENP022629 vlCDR1
QASQDIGNYLN

SEQ ID NO: 24813 - protein, 7 aa, Artificial Sequence
  Description of Artificial Sequence: Synthetic peptide
  XENP022629 vlCDR2
FTSYLHS

SEQ ID NO: 24814 - protein, 9 aa, Artificial Sequence
  Description of Artificial Sequence: Synthetic peptide
  XENP022629 vlCDR3
QQGNTLPYT

SEQ ID NO: 24815 - protein, 447 aa, Artificial Sequence; identical to SEQ ID NO: 22084
  Description of Artificial Sequence: Synthetic polypeptide
  XENP022631 2A11_H1.144_L2.137_Fab-1G6_L1.194_H1.279 Fab-Fc Heavy Chain

SEQ ID NO: 24816 - protein, 118 aa, Artificial Sequence; identical to SEQ ID NO: 22085
  Description of Artificial Sequence: Synthetic polypeptide
  VH of XENP022631

SEQ ID NO: 24817 - protein, 5 aa, Artificial Sequence
  Description of Artificial Sequence: Synthetic peptide
  XENP022631 vhCDR1
DYFMH

SEQ ID NO: 24818 - protein, 17 aa, Artificial Sequence
  Description of Artificial Sequence: Synthetic peptide
  XENP022631 vhCDR2
WIDPELGDTEYAPKFQG

SEQ ID NO: 24819 - protein, 9 aa, Artificial Sequence
  Description of Artificial Sequence: Synthetic peptide
  XENP022631 vhCDR3
RGVYQALDY

SEQ ID NO: 24820 - protein, 480 aa, Artificial Sequence; identical to SEQ ID NO: 23221
  Description of Artificial Sequence: Synthetic polypeptide
  XENP022631 2A11_H1.144_L2.137_Fab-1G6_L1.194_H1.279 scFv-Fc Heavy Chain

SEQ ID NO: 24821 - protein, 107 aa, Artificial Sequence; identical to SEQ ID NO: 10999
  Description of Artificial Sequence: Synthetic polypeptide
  VH of XENP022631

SEQ ID NO: 24822 - protein, 122 aa, Artificial Sequence; identical to SEQ ID NO: 10908
  Description of Artificial Sequence: Synthetic polypeptide
  VL of XENP022631

SEQ ID NO: 24823 - protein, 231 aa, Artificial Sequence; identical to SEQ ID NO: 21532
  Description of Artificial Sequence: Synthetic polypeptide
  Fc chain of XENP022631

SEQ ID NO: 24824 - protein, 11 aa, Artificial Sequence
  Description of Artificial Sequence: Synthetic peptide
  XENP022631 vhCDR1
RASQSVGNDVA

SEQ ID NO: 24825 - protein, 7 aa, Artificial Sequence
  Description of Artificial Sequence: Synthetic peptide
  XENP022631 vhCDR2
YASHRYT

SEQ ID NO: 24826 - protein, 9 aa, Artificial Sequence
  Description of Artificial Sequence: Synthetic peptide
  XENP022631 vhCDR3
QQDFSSPRT

SEQ ID NO: 24827 - protein, 5 aa, Artificial Sequence
  Description of Artificial Sequence: Synthetic peptide
  XENP022631 vlCDR1
NYWMN

SEQ ID NO: 24828 - protein, 19 aa, Artificial Sequence
  Description of Artificial Sequence: Synthetic peptide
  XENP022631 vlCDR2
EIRLYSNNYATHYAESVKG

SEQ ID NO: 24829 - protein, 11 aa, Artificial Sequence
  Description of Artificial Sequence: Synthetic peptide
  XENP022631 vlCDR3
YYGNYGGYFDV

SEQ ID NO: 24830 - protein, 214 aa, Artificial Sequence; identical to SEQ ID NO: 22239
  Description of Artificial Sequence: Synthetic polypeptide
  XENP022631 2A11_H1.144_L2.137_Fab-1G6_L1.194_H1.279 Light Chain

SEQ ID NO: 24831 - protein, 107 aa, Artificial Sequence; identical to SEQ ID NO: 22240
  Description of Artificial Sequence: Synthetic polypeptide
  VL of XENP022631

SEQ ID NO: 24832 - protein, 11 aa, Artificial Sequence
  Description of Artificial Sequence: Synthetic peptide
  XENP022631 vlCDR1
QASQDIGNYLN

SEQ ID NO: 24833 - protein, 7 aa, Artificial Sequence
  Description of Artificial Sequence: Synthetic peptide
  XENP022631 vlCDR2
FTSYLHS

SEQ ID NO: 24834 - protein, 9 aa, Artificial Sequence
  Description of Artificial Sequence: Synthetic peptide
  XENP022631 vlCDR3
QEGNTLPYT

SEQ ID NO: 24835 - protein, 447 aa, Artificial Sequence; identical to SEQ ID NO: 22064
  Description of Artificial Sequence: Synthetic polypeptide
  XENP022668 2A11_H1.125_L2.126_Fab-1G6_L1.194_H1.279 Fab-Fc Heavy Chain

SEQ ID NO: 24836 - protein, 118 aa, Artificial Sequence; identical to SEQ ID NO: 22065
  Description of Artificial Sequence: Synthetic polypeptide
  VH of XENP022668

SEQ ID NO: 24837 - protein, 5 aa, Artificial Sequence
  Description of Artificial Sequence: Synthetic peptide
  XENP022668 vhCDR1
HYFMH

SEQ ID NO: 24838 - protein, 17 aa, Artificial Sequence
  Description of Artificial Sequence: Synthetic peptide
  XENP022668 vhCDR2
WIDPYLGDTEYAPKFQG

SEQ ID NO: 24839 - protein, 9 aa, Artificial Sequence
  Description of Artificial Sequence: Synthetic peptide
  XENP022668 vhCDR3
RGVYQALDY

SEQ ID NO: 24840 - protein, 480 aa, Artificial Sequence; identical to SEQ ID NO: 23221
  Description of Artificial Sequence: Synthetic polypeptide
  XENP022668 2A11_H1.125_L2.126_Fab-1G6_L1.194_H1.279 scFv-Fc Heavy Chain

SEQ ID NO: 24841 - protein, 107 aa, Artificial Sequence; identical to SEQ ID NO: 10999
  Description of Artificial Sequence: Synthetic polypeptide
  VH of XENP022668

SEQ ID NO: 24842 - protein, 122 aa, Artificial Sequence; identical to SEQ ID NO: 10908
  Description of Artificial Sequence: Synthetic polypeptide
  VL of XENP022668

SEQ ID NO: 24843 - protein, 231 aa, Artificial Sequence; identical to SEQ ID NO: 21532
  Description of Artificial Sequence: Synthetic polypeptide
  Fc chain of XENP022668

SEQ ID NO: 24844 - protein, 11 aa, Artificial Sequence
  Description of Artificial Sequence: Synthetic peptide
  XENP022668 vhCDR1
RASQSVGNDVA

SEQ ID NO: 24845 - protein, 7 aa, Artificial Sequence
  Description of Artificial Sequence: Synthetic peptide
  XENP022668 vhCDR2
YASHRYT

SEQ ID NO: 24846 - protein, 9 aa, Artificial Sequence
  Description of Artificial Sequence: Synthetic peptide
  XENP022668 vhCDR3
QQDFSSPRT

SEQ ID NO: 24847 - protein, 5 aa, Artificial Sequence
  Description of Artificial Sequence: Synthetic peptide
  XENP022668 vlCDR1
NYWMN

SEQ ID NO: 24848 - protein, 19 aa, Artificial Sequence
  Description of Artificial Sequence: Synthetic peptide
  XENP022668 vlCDR2
EIRLYSNNYATHYAESVKG

SEQ ID NO: 24849 - protein, 11 aa, Artificial Sequence
  Description of Artificial Sequence: Synthetic peptide
  XENP022668 vlCDR3
YYGNYGGYFDV

SEQ ID NO: 24850 - protein, 214 aa, Artificial Sequence; identical to SEQ ID NO: 22259
  Description of Artificial Sequence: Synthetic polypeptide
  XENP022668 2A11_H1.125_L2.126_Fab-1G6_L1.194_H1.279 Light Chain

SEQ ID NO: 24851 - protein, 107 aa, Artificial Sequence; identical to SEQ ID NO: 22260
  Description of Artificial Sequence: Synthetic polypeptide
  VL of XENP022668

SEQ ID NO: 24852 - protein, 11 aa, Artificial Sequence
  Description of Artificial Sequence: Synthetic peptide
  XENP022668 vlCDR1
QASQDIGNYLN

SEQ ID NO: 24853 - protein, 7 aa, Artificial Sequence
  Description of Artificial Sequence: Synthetic peptide
  XENP022668 vlCDR2
FTSYLHS

SEQ ID NO: 24854 - protein, 9 aa, Artificial Sequence
  Description of Artificial Sequence: Synthetic peptide
  XENP022668 vlCDR3
QEGNTLPYT

SEQ ID NO: 24855 - protein, 447 aa, Artificial Sequence; identical to SEQ ID NO: 22064
  Description of Artificial Sequence: Synthetic polypeptide
  XENP022669 2A11_H1.125_L2.142_Fab-1G6_L1.194_H1.279 Fab-Fc Heavy Chain

SEQ ID NO: 24856 - protein, 118 aa, Artificial Sequence; identical to SEQ ID NO: 22065
  Description of Artificial Sequence: Synthetic polypeptide
  VH of XENP022669

SEQ ID NO: 24857 - protein, 5 aa, Artificial Sequence
  Description of Artificial Sequence: Synthetic peptide
  XENP022669 vhCDR1
HYFMH

SEQ ID NO: 24858 - protein, 17 aa, Artificial Sequence
  Description of Artificial Sequence: Synthetic peptide
  XENP022669 vhCDR2
WIDPYLGDTEYAPKFQG

SEQ ID NO: 24859 - protein, 9 aa, Artificial Sequence
  Description of Artificial Sequence: Synthetic peptide
  XENP022669 vhCDR3
RGVYQALDY

SEQ ID NO: 24860 - protein, 480 aa, Artificial Sequence; identical to SEQ ID NO: 23221
  Description of Artificial Sequence: Synthetic polypeptide
  XENP022669 2A11_H1.125_L2.142_Fab-1G6_L1.194_H1.279 scFv-Fc Heavy Chain

SEQ ID NO: 24861 - protein, 107 aa, Artificial Sequence; identical to SEQ ID NO: 10999
  Description of Artificial Sequence: Synthetic polypeptide
  VH of XENP022669

SEQ ID NO: 24862 - protein, 122 aa, Artificial Sequence; identical to SEQ ID NO: 10908
  Description of Artificial Sequence: Synthetic polypeptide
  VL of XENP022669

SEQ ID NO: 24863 - protein, 231 aa, Artificial Sequence; identical to SEQ ID NO: 21532
  Description of Artificial Sequence: Synthetic polypeptide
  Fc chain of XENP022669

SEQ ID NO: 24864 - protein, 11 aa, Artificial Sequence
  Description of Artificial Sequence: Synthetic peptide
  XENP022669 vhCDR1
RASQSVGNDVA

SEQ ID NO: 24865 - protein, 7 aa, Artificial Sequence
  Description of Artificial Sequence: Synthetic peptide
  XENP022669 vhCDR2
YASHRYT

SEQ ID NO: 24866 - protein, 9 aa, Artificial Sequence
  Description of Artificial Sequence: Synthetic peptide
  XENP022669 vhCDR3
QQDFSSPRT

SEQ ID NO: 24867 - protein, 5 aa, Artificial Sequence
  Description of Artificial Sequence: Synthetic peptide
  XENP022669 vlCDR1
NYWMN

SEQ ID NO: 24868 - protein, 19 aa, Artificial Sequence
  Description of Artificial Sequence: Synthetic peptide
  XENP022669 vlCDR2
EIRLYSNNYATHYAESVKG

SEQ ID NO: 24869 - protein, 11 aa, Artificial Sequence
  Description of Artificial Sequence: Synthetic peptide
  XENP022669 vlCDR3
YYGNYGGYFDV

SEQ ID NO: 24870 - protein, 214 aa, Artificial Sequence; identical to SEQ ID NO: 22279
  Description of Artificial Sequence: Synthetic polypeptide
  XENP022669 2A11_H1.125_L2.142_Fab-1G6_L1.194_H1.279 Light Chain

SEQ ID NO: 24871 - protein, 107 aa, Artificial Sequence; identical to SEQ ID NO: 22280
  Description of Artificial Sequence: Synthetic polypeptide
  VL of XENP022669

SEQ ID NO: 24872 - protein, 11 aa, Artificial Sequence
  Description of Artificial Sequence: Synthetic peptide
  XENP022669 vlCDR1
QASQDIGNYLN

SEQ ID NO: 24873 - protein, 7 aa, Artificial Sequence
  Description of Artificial Sequence: Synthetic peptide
  XENP022669 vlCDR2
FTSYLHS

SEQ ID NO: 24874 - protein, 9 aa, Artificial Sequence
  Description of Artificial Sequence: Synthetic peptide
  XENP022669 vlCDR3
QQGNTLPYT

SEQ ID NO: 24875 - protein, 447 aa, Artificial Sequence; identical to SEQ ID NO: 22084
  Description of Artificial Sequence: Synthetic polypeptide
  XENP022670 2A11_H1.144_L2.132_Fab-1G6_L1.194_H1.279 Fab-Fc Heavy Chain

SEQ ID NO: 24876 - protein, 118 aa, Artificial Sequence; identical to SEQ ID NO: 22085
  Description of Artificial Sequence: Synthetic polypeptide
  VH of XENP022670

SEQ ID NO: 24877 - protein, 5 aa, Artificial Sequence
  Description of Artificial Sequence: Synthetic peptide
  XENP022670 vhCDR1
DYFMH

SEQ ID NO: 24878 - protein, 17 aa, Artificial Sequence
  Description of Artificial Sequence: Synthetic peptide
  XENP022670 vhCDR2
WIDPELGDTEYAPKFQG

SEQ ID NO: 24879 - protein, 9 aa, Artificial Sequence
  Description of Artificial Sequence: Synthetic peptide
  XENP022670 vhCDR3
RGVYQALDY

SEQ ID NO: 24880 - protein, 480 aa, Artificial Sequence; identical to SEQ ID NO: 23221
  Description of Artificial Sequence: Synthetic polypeptide
  XENP022670 2A11_H1.144_L2.132_Fab-1G6_L1.194_H1.279 scFv-Fc Heavy Chain

SEQ ID NO: 24881 - protein, 107 aa, Artificial Sequence; identical to SEQ ID NO: 10999
  Description of Artificial Sequence: Synthetic polypeptide
  VH of XENP022670

SEQ ID NO: 24882 - protein, 122 aa, Artificial Sequence; identical to SEQ ID NO: 10908
  Description of Artificial Sequence: Synthetic polypeptide
  VL of XENP022670

SEQ ID NO: 24883 - protein, 231 aa, Artificial Sequence; identical to SEQ ID NO: 21532
  Description of Artificial Sequence: Synthetic polypeptide
  Fc chain of XENP022670

SEQ ID NO: 24884 - protein, 11 aa, Artificial Sequence
  Description of Artificial Sequence: Synthetic peptide
  XENP022670 vhCDR1
RASQSVGNDVA

SEQ ID NO: 24885 - protein, 7 aa, Artificial Sequence
  Description of Artificial Sequence: Synthetic peptide
  XENP022670 vhCDR2
YASHRYT

SEQ ID NO: 24886 - protein, 9 aa, Artificial Sequence
  Description of Artificial Sequence: Synthetic peptide
  XENP022670 vhCDR3
QQDFSSPRT

SEQ ID NO: 24887 - protein, 5 aa, Artificial Sequence
  Description of Artificial Sequence: Synthetic peptide
  XENP022670 vlCDR1
NYWMN

SEQ ID NO: 24888 - protein, 19 aa, Artificial Sequence
  Description of Artificial Sequence: Synthetic peptide
  XENP022670 vlCDR2
EIRLYSNNYATHYAESVKG

SEQ ID NO: 24889 - protein, 11 aa, Artificial Sequence
  Description of Artificial Sequence: Synthetic peptide
  XENP022670 vlCDR3
YYGNYGGYFDV

SEQ ID NO: 24890 - protein, 214 aa, Artificial Sequence; identical to SEQ ID NO: 22219
  Description of Artificial Sequence: Synthetic polypeptide
  XENP022670 2A11_H1.144_L2.132_Fab-1G6_L1.194_H1.279 Light Chain

SEQ ID NO: 24891 - protein, 107 aa, Artificial Sequence; identical to SEQ ID NO: 22220
  Description of Artificial Sequence: Synthetic polypeptide
  VL of XENP022670

SEQ ID NO: 24892 - protein, 11 aa, Artificial Sequence
  Description of Artificial Sequence: Synthetic peptide
  XENP022670 vlCDR1
QASQDIGNYLN

SEQ ID NO: 24893 - protein, 7 aa, Artificial Sequence
  Description of Artificial Sequence: Synthetic peptide
  XENP022670 vlCDR2
FTSYLHS

SEQ ID NO: 24894 - protein, 9 aa, Artificial Sequence
  Description of Artificial Sequence: Synthetic peptide
  XENP022670 vlCDR3
QEGNTLPYT

SEQ ID NO: 24895 - protein, 447 aa, Artificial Sequence; identical to SEQ ID NO: 22084
  Description of Artificial Sequence: Synthetic polypeptide
  XENP022671 2A11_H1.144_L2.126_Fab-1G6_L1.194_H1.279 Fab-Fc Heavy Chain

SEQ ID NO: 24896 - protein, 118 aa, Artificial Sequence; identical to SEQ ID NO: 22085
  Description of Artificial Sequence: Synthetic polypeptide
  VH of XENP022671

SEQ ID NO: 24897 - protein, 5 aa, Artificial Sequence
  Description of Artificial Sequence: Synthetic peptide
  XENP022671 vhCDR1
DYFMH

SEQ ID NO: 24898 - protein, 17 aa, Artificial Sequence
  Description of Artificial Sequence: Synthetic peptide
  XENP022671 vhCDR2
WIDPELGDTEYAPKFQG

SEQ ID NO: 24899 - protein, 9 aa, Artificial Sequence
  Description of Artificial Sequence: Synthetic peptide
  XENP022671 vhCDR3
RGVYQALDY

SEQ ID NO: 24900 - protein, 480 aa, Artificial Sequence; identical to SEQ ID NO: 23221
  Description of Artificial Sequence: Synthetic polypeptide
  XENP022671 2A11_H1.144_L2.126_Fab-1G6_L1.194_H1.279 scFv-Fc Heavy Chain

SEQ ID NO: 24901 - protein, 107 aa, Artificial Sequence; identical to SEQ ID NO: 10999
  Description of Artificial Sequence: Synthetic polypeptide
  VH of XENP022671

SEQ ID NO: 24902 - protein, 122 aa, Artificial Sequence; identical to SEQ ID NO: 10908
  Description of Artificial Sequence: Synthetic polypeptide
  VL of XENP022671

SEQ ID NO: 24903 - protein, 231 aa, Artificial Sequence; identical to SEQ ID NO: 21532
  Description of Artificial Sequence: Synthetic polypeptide
  Fc chain of XENP022671

SEQ ID NO: 24904 - protein, 11 aa, Artificial Sequence
  Description of Artificial Sequence: Synthetic peptide
  XENP022671 vhCDR1
RASQSVGNDVA

SEQ ID NO: 24905 - protein, 7 aa, Artificial Sequence
  Description of Artificial Sequence: Synthetic peptide
  XENP022671 vhCDR2
YASHRYT

SEQ ID NO: 24906 - protein, 9 aa, Artificial Sequence
  Description of Artificial Sequence: Synthetic peptide
  XENP022671 vhCDR3
QQDFSSPRT

SEQ ID NO: 24907 - protein, 5 aa, Artificial Sequence
  Description of Artificial Sequence: Synthetic peptide
  XENP022671 vlCDR1
NYWMN

SEQ ID NO: 24908 - protein, 19 aa, Artificial Sequence
  Description of Artificial Sequence: Synthetic peptide
  XENP022671 vlCDR2
EIRLYSNNYATHYAESVKG

SEQ ID NO: 24909 - protein, 11 aa, Artificial Sequence
  Description of Artificial Sequence: Synthetic peptide
  XENP022671 vlCDR3
YYGNYGGYFDV

SEQ ID NO: 24910 - protein, 214 aa, Artificial Sequence; identical to SEQ ID NO: 22259
  Description of Artificial Sequence: Synthetic polypeptide
  XENP022671 2A11_H1.144_L2.126_Fab-1G6_L1.194_H1.279 Light Chain

SEQ ID NO: 24911 - protein, 107 aa, Artificial Sequence; identical to SEQ ID NO: 22260
  Description of Artificial Sequence: Synthetic polypeptide
  VL of XENP022671

SEQ ID NO: 24912 - protein, 11 aa, Artificial Sequence
  Description of Artificial Sequence: Synthetic peptide
  XENP022671 vlCDR1
QASQDIGNYLN

SEQ ID NO: 24913 - protein, 7 aa, Artificial Sequence
  Description of Artificial Sequence: Synthetic peptide
  XENP022671 vlCDR2
FTSYLHS

SEQ ID NO: 24914 - protein, 9 aa, Artificial Sequence
  Description of Artificial Sequence: Synthetic peptide
  XENP022671 vlCDR3
QEGNTLPYT

SEQ ID NO: 24915 - protein, 447 aa, Artificial Sequence; identical to SEQ ID NO: 22084
  Description of Artificial Sequence: Synthetic polypeptide
  XENP022672 2A11_H1.144_L2.142_Fab-1G6_L1.194_H1.279 Fab-Fc Heavy Chain

SEQ ID NO: 24916 - protein, 118 aa, Artificial Sequence; identical to SEQ ID NO: 22085
  Description of Artificial Sequence: Synthetic polypeptide
  VH of XENP022672

SEQ ID NO: 24917 - protein, 5 aa, Artificial Sequence
  Description of Artificial Sequence: Synthetic peptide
  XENP022672 vhCDR1
DYFMH

SEQ ID NO: 24918 - protein, 17 aa, Artificial Sequence
  Description of Artificial Sequence: Synthetic peptide
  XENP022672 vhCDR2
WIDPELGDTEYAPKFQG

SEQ ID NO: 24919 - protein, 9 aa, Artificial Sequence
  Description of Artificial Sequence: Synthetic peptide
  XENP022672 vhCDR3
RGVYQALDY

SEQ ID NO: 24920 - protein, 480 aa, Artificial Sequence; identical to SEQ ID NO: 23221
  Description of Artificial Sequence: Synthetic polypeptide
  XENP022672 2A11_H1.144_L2.142_Fab-1G6_L1.194_H1.279 scFv-Fc Heavy Chain

SEQ ID NO: 24921 - protein, 107 aa, Artificial Sequence; identical to SEQ ID NO: 10999
  Description of Artificial Sequence: Synthetic polypeptide
  VH of XENP022672

SEQ ID NO: 24922 - protein, 122 aa, Artificial Sequence; identical to SEQ ID NO: 10908
  Description of Artificial Sequence: Synthetic polypeptide
  VL of XENP022672

SEQ ID NO: 24923 - protein, 231 aa, Artificial Sequence; identical to SEQ ID NO: 21532
  Description of Artificial Sequence: Synthetic polypeptide
  Fc chain of XENP022672

SEQ ID NO: 24924 - protein, 11 aa, Artificial Sequence
  Description of Artificial Sequence: Synthetic peptide
  XENP022672 vhCDR1
RASQSVGNDVA

SEQ ID NO: 24925 - protein, 7 aa, Artificial Sequence
  Description of Artificial Sequence: Synthetic peptide
  XENP022672 vhCDR2
YASHRYT

SEQ ID NO: 24926 - protein, 9 aa, Artificial Sequence
  Description of Artificial Sequence: Synthetic peptide
  XENP022672 vhCDR3
QQDFSSPRT

SEQ ID NO: 24927 - protein, 5 aa, Artificial Sequence
  Description of Artificial Sequence: Synthetic peptide
  XENP022672 vlCDR1
NYWMN

SEQ ID NO: 24928 - protein, 19 aa, Artificial Sequence
  Description of Artificial Sequence: Synthetic peptide
  XENP022672 vlCDR2
EIRLYSNNYATHYAESVKG

SEQ ID NO: 24929 - protein, 11 aa, Artificial Sequence
  Description of Artificial Sequence: Synthetic peptide
  XENP022672 vlCDR3
YYGNYGGYFDV

SEQ ID NO: 24930 - protein, 214 aa, Artificial Sequence; identical to SEQ ID NO: 22279
  Description of Artificial Sequence: Synthetic polypeptide
  XENP022672 2A11_H1.144_L2.142_Fab-1G6_L1.194_H1.279 Light Chain

SEQ ID NO: 24931 - protein, 107 aa, Artificial Sequence; identical to SEQ ID NO: 22280
  Description of Artificial Sequence: Synthetic polypeptide
  VL of XENP022672

SEQ ID NO: 24932 - protein, 11 aa, Artificial Sequence
  Description of Artificial Sequence: Synthetic peptide
  XENP022672 vlCDR1
QASQDIGNYLN

SEQ ID NO: 24933 - protein, 7 aa, Artificial Sequence
  Description of Artificial Sequence: Synthetic peptide
  XENP022672 vlCDR2
FTSYLHS

SEQ ID NO: 24934 - protein, 9 aa, Artificial Sequence
  Description of Artificial Sequence: Synthetic peptide
  XENP022672 vlCDR3
QQGNTLPYT

SEQ ID NO: 24935 - protein, 450 aa, Artificial Sequence; identical to SEQ ID NO: 17625
  Description of Artificial Sequence: Synthetic polypeptide
  XENP020038 7G8_H2L2_Fab-1G6_H1.279_L1.194 Fab-Fc Heavy Chain

SEQ ID NO: 24936 - protein, 121 aa, Artificial Sequence; identical to SEQ ID NO: 17626
  Description of Artificial Sequence: Synthetic polypeptide
  VH of XENP020038

SEQ ID NO: 24937 - protein, 5 aa, Artificial Sequence
  Description of Artificial Sequence: Synthetic peptide
  XENP020038 vhCDR1
DAWMD

SEQ ID NO: 24938 - protein, 19 aa, Artificial Sequence
  Description of Artificial Sequence: Synthetic peptide
  XENP020038 vhCDR2
EIRTKANNHATYYAESVKG

SEQ ID NO: 24939 - protein, 10 aa, Artificial Sequence
  Description of Artificial Sequence: Synthetic peptide
  XENP020038 vhCDR3
LANWDWYFDV

SEQ ID NO: 24940 - protein, 480 aa, Artificial Sequence; identical to SEQ ID NO: 23401
  Description of Artificial Sequence: Synthetic polypeptide
  XENP020038 7G8_H2L2_Fab-1G6_H1.279_L1.194 scFv-Fc Heavy Chain

SEQ ID NO: 24941 - protein, 122 aa, Artificial Sequence; identical to SEQ ID NO: 10908
  Description of Artificial Sequence: Synthetic polypeptide
  VH of XENP020038

SEQ ID NO: 24942 - protein, 338 aa, Artificial Sequence
  Description of Artificial Sequence: Synthetic polypeptide
  VL of XENP020038
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24943 - protein, 5 aa, Artificial Sequence
  Description of Artificial Sequence: Synthetic peptide
  XENP020038 vhCDR1
NYWMN

SEQ ID NO: 24944 - protein, 19 aa, Artificial Sequence
  Description of Artificial Sequence: Synthetic peptide
  XENP020038 vhCDR2
EIRLYSNNYATHYAESVKG

SEQ ID NO: 24945 - protein, 11 aa, Artificial Sequence
  Description of Artificial Sequence: Synthetic peptide
  XENP020038 vhCDR3
YYGNYGGYFDV

SEQ ID NO: 24946 - protein, 11 aa, Artificial Sequence
  Description of Artificial Sequence: Synthetic peptide
  XENP020038 vlCDR1
RASQSVGNDVA

SEQ ID NO: 24947 - protein, 7 aa, Artificial Sequence
  Description of Artificial Sequence: Synthetic peptide
  XENP020038 vlCDR2
YASHRYT

SEQ ID NO: 24948 - protein, 9 aa, Artificial Sequence
  Description of Artificial Sequence: Synthetic peptide
  XENP020038 vlCDR3
QQDFSSPRT

SEQ ID NO: 24949 - protein, 218 aa, Artificial Sequence; identical to SEQ ID NO: 17610
  Description of Artificial Sequence: Synthetic polypeptide
  XENP020038 7G8_H2L2_Fab-1G6_H1.279_L1.194 Light Chain

SEQ ID NO: 24950 - protein, 111 aa, Artificial Sequence; identical to SEQ ID NO: 17611
  Description of Artificial Sequence: Synthetic polypeptide
  VL of XENP020038

SEQ ID NO: 24951 - protein, 15 aa, Artificial Sequence
  Description of Artificial Sequence: Synthetic peptide
  XENP020038 vlCDR1
RASQSVDYDGDSYMN

SEQ ID NO: 24952 - protein, 7 aa, Artificial Sequence
  Description of Artificial Sequence: Synthetic peptide
  XENP020038 vlCDR2
AASNLES

SEQ ID NO: 24953 - protein, 9 aa, Artificial Sequence
  Description of Artificial Sequence: Synthetic peptide
  XENP020038 vlCDR3
QQSNEDPFT

SEQ ID NO: 24954 - protein, 450 aa, Artificial Sequence; identical to SEQ ID NO: 22324
  Description of Artificial Sequence: Synthetic polypeptide
  XENP022521 7G8_H3.18_L1.11-1G6_L1.194_H1.279 Fab-Fc Heavy Chain

SEQ ID NO: 24955 - protein, 121 aa, Artificial Sequence; identical to SEQ ID NO: 22325
  Description of Artificial Sequence: Synthetic polypeptide
  VH of XENP022521

SEQ ID NO: 24956 - protein, 5 aa, Artificial Sequence
  Description of Artificial Sequence: Synthetic peptide
  XENP022521 vhCDR1
DAWMD

SEQ ID NO: 24957 - protein, 19 aa, Artificial Sequence
  Description of Artificial Sequence: Synthetic peptide
  XENP022521 vhCDR2
EISTKANNHATYYAESVKG

SEQ ID NO: 24958 - protein, 10 aa, Artificial Sequence
  Description of Artificial Sequence: Synthetic peptide
  XENP022521 vhCDR3
LATWDWYFDV

SEQ ID NO: 24959 - protein, 480 aa, Artificial Sequence; identical to SEQ ID NO: 23221
  Description of Artificial Sequence: Synthetic polypeptide
  XENP022521 7G8_H3.18_L1.11-1G6_L1.194_H1.279 scFv-Fc Heavy Chain

SEQ ID NO: 24960 - protein, 107 aa, Artificial Sequence; identical to SEQ ID NO: 10999
  Description of Artificial Sequence: Synthetic polypeptide
  VH of XENP022521

SEQ ID NO: 24961 - protein, 122 aa, Artificial Sequence; identical to SEQ ID NO: 10908
  Description of Artificial Sequence: Synthetic polypeptide
  VL of XENP022521

SEQ ID NO: 24962 - protein, 231 aa, Artificial Sequence; identical to SEQ ID NO: 21532
  Description of Artificial Sequence: Synthetic polypeptide
  Fc chain of XENP022521

SEQ ID NO: 24963 - protein, 11 aa, Artificial Sequence
  Description of Artificial Sequence: Synthetic peptide
  XENP022521 vhCDR1
RASQSVGNDVA

SEQ ID NO: 24964 - protein, 7 aa, Artificial Sequence
  Description of Artificial Sequence: Synthetic peptide
  XENP022521 vhCDR2
YASHRYT

SEQ ID NO: 24965 - protein, 9 aa, Artificial Sequence
  Description of Artificial Sequence: Synthetic peptide
  XENP022521 vhCDR3
QQDFSSPRT

SEQ ID NO: 24966 - protein, 5 aa, Artificial Sequence
  Description of Artificial Sequence: Synthetic peptide
  XENP022521 vlCDR1
NYWMN

SEQ ID NO: 24967 - protein, 19 aa, Artificial Sequence
  Description of Artificial Sequence: Synthetic peptide
  XENP022521 vlCDR2
EIRLYSNNYATHYAESVKG

SEQ ID NO: 24968 - protein, 11 aa, Artificial Sequence
  Description of Artificial Sequence: Synthetic peptide
  XENP022521 vlCDR3
YYGNYGGYFDV

SEQ ID NO: 24969 - protein, 218 aa, Artificial Sequence; identical to SEQ ID NO: 22359
  Description of Artificial Sequence: Synthetic polypeptide
  XENP022521 7G8_H3.18_L1.11-1G6_L1.194_H1.279 Light Chain

SEQ ID NO: 24970 - protein, 111 aa, Artificial Sequence; identical to SEQ ID NO: 22360
  Description of Artificial Sequence: Synthetic polypeptide
  VL of XENP022521

SEQ ID NO: 24971 - protein, 15 aa, Artificial Sequence
  Description of Artificial Sequence: Synthetic peptide
  XENP022521 vlCDR1
RASQSVDYDGDSYMN

SEQ ID NO: 24972 - protein, 7 aa, Artificial Sequence
  Description of Artificial Sequence: Synthetic peptide
  XENP022521 vlCDR2
AASELES

SEQ ID NO: 24973 - protein, 9 aa, Artificial Sequence
  Description of Artificial Sequence: Synthetic peptide
  XENP022521 vlCDR3
QQSNEDPFT

SEQ ID NO: 24974 - protein, 450 aa, Artificial Sequence; identical to SEQ ID NO: 22424
  Description of Artificial Sequence: Synthetic polypeptide
  XENP022522 7G8_H3.28_L1.13-1G6_L1.194_H1.279 Fab-Fc Heavy Chain

SEQ ID NO: 24975 - protein, 121 aa, Artificial Sequence; identical to SEQ ID NO: 22425
  Description of Artificial Sequence: Synthetic polypeptide
  VH of XENP022522

SEQ ID NO: 24976 - protein, 5 aa, Artificial Sequence
  Description of Artificial Sequence: Synthetic peptide
  XENP022522 vhCDR1
DAWMD

SEQ ID NO: 24977 - protein, 19 aa, Artificial Sequence
  Description of Artificial Sequence: Synthetic peptide
  XENP022522 vhCDR2
EISTKAYNHATYYAESVKG

SEQ ID NO: 24978 - protein, 10 aa, Artificial Sequence
  Description of Artificial Sequence: Synthetic peptide
  XENP022522 vhCDR3
LATWDWYFDV

SEQ ID NO: 24979 - protein, 480 aa, Artificial Sequence; identical to SEQ ID NO: 23221
  Description of Artificial Sequence: Synthetic polypeptide
  XENP022522 7G8_H3.28_L1.13-1G6_L1.194_H1.279 scFv-Fc Heavy Chain

SEQ ID NO: 24980 - protein, 107 aa, Artificial Sequence; identical to SEQ ID NO: 10999
  Description of Artificial Sequence: Synthetic polypeptide
  VH of XENP022522

SEQ ID NO: 24981 - protein, 122 aa, Artificial Sequence; identical to SEQ ID NO: 10908
  Description of Artificial Sequence: Synthetic polypeptide
  VL of XENP022522

SEQ ID NO: 24982 - protein, 231 aa, Artificial Sequence; identical to SEQ ID NO: 21532
  Description of Artificial Sequence: Synthetic polypeptide
  Fc chain of XENP022522

SEQ ID NO: 24983 - protein, 11 aa, Artificial Sequence
  Description of Artificial Sequence: Synthetic peptide
  XENP022522 vhCDR1
RASQSVGNDVA

SEQ ID NO: 24984 - protein, 7 aa, Artificial Sequence
  Description of Artificial Sequence: Synthetic peptide
  XENP022522 vhCDR2
YASHRYT

SEQ ID NO: 24985 - protein, 9 aa, Artificial Sequence
  Description of Artificial Sequence: Synthetic peptide
  XENP022522 vhCDR3
QQDFSSPRT

SEQ ID NO: 24986 - protein, 5 aa, Artificial Sequence
  Description of Artificial Sequence: Synthetic peptide
  XENP022522 vlCDR1
NYWMN

SEQ ID NO: 24987 - protein, 19 aa, Artificial Sequence
  Description of Artificial Sequence: Synthetic peptide
  XENP022522 vlCDR2
EIRLYSNNYATHYAESVKG

SEQ ID NO: 24988 - protein, 11 aa, Artificial Sequence
  Description of Artificial Sequence: Synthetic peptide
  XENP022522 vlCDR3
YYGNYGGYFDV

SEQ ID NO: 24989 - protein, 218 aa, Artificial Sequence; identical to SEQ ID NO: 22419
  Description of Artificial Sequence: Synthetic polypeptide
  XENP022522 7G8_H3.28_L1.13-1G6_L1.194_H1.279 Light Chain

SEQ ID NO: 24990 - protein, 111 aa, Artificial Sequence; identical to SEQ ID NO: 22420
  Description of Artificial Sequence: Synthetic polypeptide
  VL of XENP022522

SEQ ID NO: 24991 - protein, 15 aa, Artificial Sequence
  Description of Artificial Sequence: Synthetic peptide
  XENP022522 vlCDR1
RASQSVDHDGDSYMN

SEQ ID NO: 24992 - protein, 7 aa, Artificial Sequence
  Description of Artificial Sequence: Synthetic peptide
  XENP022522 vlCDR2
AASELES

SEQ ID NO: 24993 - protein, 9 aa, Artificial Sequence
  Description of Artificial Sequence: Synthetic peptide
  XENP022522 vlCDR3
QQSNEDPFT

SEQ ID NO: 24994 - protein, 450 aa, Artificial Sequence; identical to SEQ ID NO: 22484
  Description of Artificial Sequence: Synthetic polypeptide
  XENP022565 7G8_H3.30_L1.11-1G6_L1.194_H1.279 Fab-Fc Heavy Chain

SEQ ID NO: 24995 - protein, 121 aa, Artificial Sequence; identical to SEQ ID NO: 22485
  Description of Artificial Sequence: Synthetic polypeptide
  VH of XENP022565

SEQ ID NO: 24996 - protein, 5 aa, Artificial Sequence
  Description of Artificial Sequence: Synthetic peptide
  XENP022565 vhCDR1
DAWMS

SEQ ID NO: 24997 - protein, 19 aa, Artificial Sequence
  Description of Artificial Sequence: Synthetic peptide
  XENP022565 vhCDR2
EISTKANNHATYYAESVKG

SEQ ID NO: 24998 - protein, 10 aa, Artificial Sequence
  Description of Artificial Sequence: Synthetic peptide
  XENP022565 vhCDR3
LATWDWYFDV

SEQ ID NO: 24999 - protein, 480 aa, Artificial Sequence; identical to SEQ ID NO: 23221
  Description of Artificial Sequence: Synthetic polypeptide
  XENP022565 7G8_H3.30_L1.11-1G6_L1.194_H1.279 scFv-Fc Heavy Chain

SEQ ID NO: 25000 - protein, 107 aa, Artificial Sequence; identical to SEQ ID NO: 10999
  Description of Artificial Sequence: Synthetic polypeptide
  VH of XENP022565

SEQ ID NO: 25001 - protein, 122 aa, Artificial Sequence; identical to SEQ ID NO: 10908
  Description of Artificial Sequence: Synthetic polypeptide
  VL of XENP022565

SEQ ID NO: 25002 - protein, 231 aa, Artificial Sequence; identical to SEQ ID NO: 21532
  Description of Artificial Sequence: Synthetic polypeptide
  Fc chain of XENP022565

SEQ ID NO: 25003 - protein, 11 aa, Artificial Sequence
  Description of Artificial Sequence: Synthetic peptide
  XENP022565 vhCDR1
RASQSVGNDVA

SEQ ID NO: 25004 - protein, 7 aa, Artificial Sequence
  Description of Artificial Sequence: Synthetic peptide
  XENP022565 vhCDR2
YASHRYT

SEQ ID NO: 25005 - protein, 9 aa, Artificial Sequence
  Description of Artificial Sequence: Synthetic peptide
  XENP022565 vhCDR3
QQDFSSPRT

SEQ ID NO: 25006 - protein, 5 aa, Artificial Sequence
  Description of Artificial Sequence: Synthetic peptide
  XENP022565 vlCDR1
NYWMN

SEQ ID NO: 25007 - protein, 19 aa, Artificial Sequence
  Description of Artificial Sequence: Synthetic peptide
  XENP022565 vlCDR2
EIRLYSNNYATHYAESVKG

SEQ ID NO: 25008 - protein, 11 aa, Artificial Sequence
  Description of Artificial Sequence: Synthetic peptide
  XENP022565 vlCDR3
YYGNYGGYFDV

SEQ ID NO: 25009 - protein, 218 aa, Artificial Sequence; identical to SEQ ID NO: 22359
  Description of Artificial Sequence: Synthetic polypeptide
  XENP022565 7G8_H3.30_L1.11-1G6_L1.194_H1.279 Light Chain

SEQ ID NO: 25010 - protein, 111 aa, Artificial Sequence; identical to SEQ ID NO: 22360
  Description of Artificial Sequence: Synthetic polypeptide
  VL of XENP022565

SEQ ID NO: 25011 - protein, 15 aa, Artificial Sequence
  Description of Artificial Sequence: Synthetic peptide
  XENP022565 vlCDR1
RASQSVDYDGDSYMN

SEQ ID NO: 25012 - protein, 7 aa, Artificial Sequence
  Description of Artificial Sequence: Synthetic peptide
  XENP022565 vlCDR2
AASELES

SEQ ID NO: 25013 - protein, 9 aa, Artificial Sequence
  Description of Artificial Sequence: Synthetic peptide
  XENP022565 vlCDR3
QQSNEDPFT

SEQ ID NO: 25014 - protein, 450 aa, Artificial Sequence; identical to SEQ ID NO: 22504
  Description of Artificial Sequence: Synthetic polypeptide
  XENP022566 7G8_H3.33_L1.11-1G6_L1.194_H1.279 Fab-Fc Heavy Chain

SEQ ID NO: 25015 - protein, 121 aa, Artificial Sequence; identical to SEQ ID NO: 22505
  Description of Artificial Sequence: Synthetic polypeptide
  VH of XENP022566

SEQ ID NO: 25016 - protein, 5 aa, Artificial Sequence
  Description of Artificial Sequence: Synthetic peptide
  XENP022566 vhCDR1
DAWMG

SEQ ID NO: 25017 - protein, 19 aa, Artificial Sequence
  Description of Artificial Sequence: Synthetic peptide
  XENP022566 vhCDR2
EISTKANNHATYYAESVKG

SEQ ID NO: 25018 - protein, 10 aa, Artificial Sequence
  Description of Artificial Sequence: Synthetic peptide
  XENP022566 vhCDR3
LATWDWYFDV

SEQ ID NO: 25019 - protein, 480 aa, Artificial Sequence; identical to SEQ ID NO: 23221
  Description of Artificial Sequence: Synthetic polypeptide
  XENP022566 7G8_H3.33_L1.11-1G6_L1.194_H1.279 scFv-Fc Heavy Chain

SEQ ID NO: 25020 - protein, 107 aa, Artificial Sequence; identical to SEQ ID NO: 10999
  Description of Artificial Sequence: Synthetic polypeptide
  VH of XENP022566

SEQ ID NO: 25021 - protein, 122 aa, Artificial Sequence; identical to SEQ ID NO: 10908
  Description of Artificial Sequence: Synthetic polypeptide
  VL of XENP022566

SEQ ID NO: 25022 - protein, 231 aa, Artificial Sequence; identical to SEQ ID NO: 21532
  Description of Artificial Sequence: Synthetic polypeptide
  Fc chain of XENP022566

SEQ ID NO: 25023 - protein, 11 aa, Artificial Sequence
  Description of Artificial Sequence: Synthetic peptide
  XENP022566 vhCDR1
RASQSVGNDVA

SEQ ID NO: 25024 - protein, 7 aa, Artificial Sequence
  Description of Artificial Sequence: Synthetic peptide
  XENP022566 vhCDR2
YASHRYT

SEQ ID NO: 25025 - protein, 9 aa, Artificial Sequence
  Description of Artificial Sequence: Synthetic peptide
  XENP022566 vhCDR3
QQDFSSPRT

SEQ ID NO: 25026 - protein, 5 aa, Artificial Sequence
  Description of Artificial Sequence: Synthetic peptide
  XENP022566 vlCDR1
NYWMN

SEQ ID NO: 25027 - protein, 19 aa, Artificial Sequence
  Description of Artificial Sequence: Synthetic peptide
  XENP022566 vlCDR2
EIRLYSNNYATHYAESVKG

SEQ ID NO: 25028 - protein, 11 aa, Artificial Sequence
  Description of Artificial Sequence: Synthetic peptide
  XENP022566 vlCDR3
YYGNYGGYFDV

SEQ ID NO: 25029 - protein, 218 aa, Artificial Sequence; identical to SEQ ID NO: 22359
  Description of Artificial Sequence: Synthetic polypeptide
  XENP022566 7G8_H3.33_L1.11-1G6_L1.194_H1.279 Light Chain

SEQ ID NO: 25030 - protein, 111 aa, Artificial Sequence; identical to SEQ ID NO: 22360
  Description of Artificial Sequence: Synthetic polypeptide
  VL of XENP022566

SEQ ID NO: 25031 - protein, 15 aa, Artificial Sequence
  Description of Artificial Sequence: Synthetic peptide
  XENP022566 vlCDR1
RASQSVDYDGDSYMN

SEQ ID NO: 25032 - protein, 7 aa, Artificial Sequence
  Description of Artificial Sequence: Synthetic peptide
  XENP022566 vlCDR2
AASELES

SEQ ID NO: 25033 - protein, 9 aa, Artificial Sequence
  Description of Artificial Sequence: Synthetic peptide
  XENP022566 vlCDR3
QQSNEDPFT

SEQ ID NO: 25034 - protein, 450 aa, Artificial Sequence; identical to SEQ ID NO: 22324
  Description of Artificial Sequence: Synthetic polypeptide
  XENP022567 7G8_H3.18_L1.30-1G6_L1.194_H1.279 Fab-Fc Heavy Chain

SEQ ID NO: 25035 - protein, 121 aa, Artificial Sequence; identical to SEQ ID NO: 22325
  Description of Artificial Sequence: Synthetic polypeptide
  VH of XENP022567

SEQ ID NO: 25036 - protein, 5 aa, Artificial Sequence
  Description of Artificial Sequence: Synthetic peptide
  XENP022567 vhCDR1
DAWMD

SEQ ID NO: 25037 - protein, 19 aa, Artificial Sequence
  Description of Artificial Sequence: Synthetic peptide
  XENP022567 vhCDR2
EISTKANNHATYYAESVKG

SEQ ID NO: 25038 - protein, 10 aa, Artificial Sequence
  Description of Artificial Sequence: Synthetic peptide
  XENP022567 vhCDR3
LATWDWYFDV

SEQ ID NO: 25039 - protein, 480 aa, Artificial Sequence; identical to SEQ ID NO: 23221
  Description of Artificial Sequence: Synthetic polypeptide
  XENP022567 7G8_H3.18_L1.30-1G6_L1.194_H1.279 scFv-Fc Heavy Chain

SEQ ID NO: 25040 - protein, 107 aa, Artificial Sequence; identical to SEQ ID NO: 10999
  Description of Artificial Sequence: Synthetic polypeptide
  VH of XENP022567

SEQ ID NO: 25041 - protein, 122 aa, Artificial Sequence; identical to SEQ ID NO: 10908
  Description of Artificial Sequence: Synthetic polypeptide
  VL of XENP022567

SEQ ID NO: 25042 - protein, 231 aa, Artificial Sequence; identical to SEQ ID NO: 21532
  Description of Artificial Sequence: Synthetic polypeptide
  Fc chain of XENP022567

SEQ ID NO: 25043 - protein, 11 aa, Artificial Sequence
  Description of Artificial Sequence: Synthetic peptide
  XENP022567 vhCDR1
RASQSVGNDVA

SEQ ID NO: 25044 - protein, 7 aa, Artificial Sequence
  Description of Artificial Sequence: Synthetic peptide
  XENP022567 vhCDR2
YASHRYT

SEQ ID NO: 25045 - protein, 9 aa, Artificial Sequence
  Description of Artificial Sequence: Synthetic peptide
  XENP022567 vhCDR3
QQDFSSPRT

SEQ ID NO: 25046 - protein, 5 aa, Artificial Sequence
  Description of Artificial Sequence: Synthetic peptide
  XENP022567 vlCDR1
NYWMN

SEQ ID NO: 25047 - protein, 19 aa, Artificial Sequence
  Description of Artificial Sequence: Synthetic peptide
  XENP022567 vlCDR2
EIRLYSNNYATHYAESVKG

SEQ ID NO: 25048 - protein, 11 aa, Artificial Sequence
  Description of Artificial Sequence: Synthetic peptide
  XENP022567 vlCDR3
YYGNYGGYFDV

SEQ ID NO: 25049 - protein, 218 aa, Artificial Sequence; identical to SEQ ID NO: 22539
  Description of Artificial Sequence: Synthetic polypeptide
  XENP022567 7G8_H3.18_L1.30-1G6_L1.194_H1.279 Light Chain

SEQ ID NO: 25050 - protein, 111 aa, Artificial Sequence; identical to SEQ ID NO: 22540
  Description of Artificial Sequence: Synthetic polypeptide
  VL of XENP022567

SEQ ID NO: 25051 - protein, 15 aa, Artificial Sequence
  Description of Artificial Sequence: Synthetic peptide
  XENP022567 vlCDR1
RASQSVDYDGDSYMN

SEQ ID NO: 25052 - protein, 7 aa, Artificial Sequence
  Description of Artificial Sequence: Synthetic peptide
  XENP022567 vlCDR2
AASELES

SEQ ID NO: 25053 - protein, 9 aa, Artificial Sequence
  Description of Artificial Sequence: Synthetic peptide
  XENP022567 vlCDR3
QQSNEDPFT

SEQ ID NO: 25054 - protein, 450 aa, Artificial Sequence; identical to SEQ ID NO: 22484
  Description of Artificial Sequence: Synthetic polypeptide
  XENP022568 7G8_H3.30_L1.30-1G6_L1.194_H1.279 Fab-Fc Heavy Chain

SEQ ID NO: 25055 - protein, 121 aa, Artificial Sequence; identical to SEQ ID NO: 22485
  Description of Artificial Sequence: Synthetic polypeptide
  VH of XENP022568

SEQ ID NO: 25056 - protein, 5 aa, Artificial Sequence
  Description of Artificial Sequence: Synthetic peptide
  XENP022568 vhCDR1
DAWMS

SEQ ID NO: 25057 - protein, 19 aa, Artificial Sequence
  Description of Artificial Sequence: Synthetic peptide
  XENP022568 vhCDR2
EISTKANNHATYYAESVKG

SEQ ID NO: 25058 - protein, 10 aa, Artificial Sequence
  Description of Artificial Sequence: Synthetic peptide
  XENP022568 vhCDR3
LATWDWYFDV

SEQ ID NO: 25059 - protein, 480 aa, Artificial Sequence; identical to SEQ ID NO: 23221
  Description of Artificial Sequence: Synthetic polypeptide
  XENP022568 7G8_H3.30_L1.30-1G6_L1.194_H1.279 scFv-Fc Heavy Chain

SEQ ID NO: 25060 - protein, 107 aa, Artificial Sequence; identical to SEQ ID NO: 10999
  Description of Artificial Sequence: Synthetic polypeptide
  VH of XENP022568

SEQ ID NO: 25061 - protein, 122 aa, Artificial Sequence; identical to SEQ ID NO: 10908
  Description of Artificial Sequence: Synthetic polypeptide
  VL of XENP022568

SEQ ID NO: 25062 - protein, 231 aa, Artificial Sequence; identical to SEQ ID NO: 21532
  Description of Artificial Sequence: Synthetic polypeptide
  Fc chain of XENP022568

SEQ ID NO: 25063 - protein, 11 aa, Artificial Sequence
  Description of Artificial Sequence: Synthetic peptide
  XENP022568 vhCDR1
RASQSVGNDVA

SEQ ID NO: 25064 - protein, 7 aa, Artificial Sequence
  Description of Artificial Sequence: Synthetic peptide
  XENP022568 vhCDR2
YASHRYT

SEQ ID NO: 25065 - protein, 9 aa, Artificial Sequence
  Description of Artificial Sequence: Synthetic peptide
  XENP022568 vhCDR3
QQDFSSPRT

SEQ ID NO: 25066 - protein, 5 aa, Artificial Sequence
  Description of Artificial Sequence: Synthetic peptide
  XENP022568 vlCDR1
NYWMN

SEQ ID NO: 25067 - protein, 19 aa, Artificial Sequence
  Description of Artificial Sequence: Synthetic peptide
  XENP022568 vlCDR2
EIRLYSNNYATHYAESVKG

SEQ ID NO: 25068 - protein, 11 aa, Artificial Sequence
  Description of Artificial Sequence: Synthetic peptide
  XENP022568 vlCDR3
YYGNYGGYFDV

SEQ ID NO: 25069 - protein, 218 aa, Artificial Sequence; identical to SEQ ID NO: 22539
  Description of Artificial Sequence: Synthetic polypeptide
  XENP022568 7G8_H3.30_L1.30-1G6_L1.194_H1.279 Light Chain

SEQ ID NO: 25070 - protein, 111 aa, Artificial Sequence; identical to SEQ ID NO: 22540
  Description of Artificial Sequence: Synthetic polypeptide
  VL of XENP022568

SEQ ID NO: 25071 - protein, 15 aa, Artificial Sequence
  Description of Artificial Sequence: Synthetic peptide
  XENP022568 vlCDR1
RASQSVDYDGDSYMN

SEQ ID NO: 25072 - protein, 7 aa, Artificial Sequence
  Description of Artificial Sequence: Synthetic peptide
  XENP022568 vlCDR2
AASELES

SEQ ID NO: 25073 - protein, 9 aa, Artificial Sequence
  Description of Artificial Sequence: Synthetic peptide
  XENP022568 vlCDR3
QQSNEDPFT

SEQ ID NO: 25074 - protein, 450 aa, Artificial Sequence; identical to SEQ ID NO: 22504
  Description of Artificial Sequence: Synthetic polypeptide
  XENP022569 7G8_H3.33_L1.30-1G6_L1.194_H1.279 Fab-Fc Heavy Chain

SEQ ID NO: 25075 - protein, 121 aa, Artificial Sequence; identical to SEQ ID NO: 22505
  Description of Artificial Sequence: Synthetic polypeptide
  VH of XENP022569

SEQ ID NO: 25076 - protein, 5 aa, Artificial Sequence
  Description of Artificial Sequence: Synthetic peptide
  XENP022569 vhCDR1
DAWMG

SEQ ID NO: 25077 - protein, 19 aa, Artificial Sequence
  Description of Artificial Sequence: Synthetic peptide
  XENP022569 vhCDR2
EISTKANNHATYYAESVKG

SEQ ID NO: 25078 - protein, 10 aa, Artificial Sequence
  Description of Artificial Sequence: Synthetic peptide
  XENP022569 vhCDR3
LATWDWYFDV

SEQ ID NO: 25079 - protein, 480 aa, Artificial Sequence; identical to SEQ ID NO: 23221
  Description of Artificial Sequence: Synthetic polypeptide
  XENP022569 7G8_H3.33_L1.30-1G6_L1.194_H1.279 scFv-Fc Heavy Chain

SEQ ID NO: 25080 - protein, 107 aa, Artificial Sequence; identical to SEQ ID NO: 10999
  Description of Artificial Sequence: Synthetic polypeptide
  VH of XENP022569

SEQ ID NO: 25081 - protein, 122 aa, Artificial Sequence; identical to SEQ ID NO: 10908
  Description of Artificial Sequence: Synthetic polypeptide
  VL of XENP022569

SEQ ID NO: 25082 - protein, 231 aa, Artificial Sequence; identical to SEQ ID NO: 21532
  Description of Artificial Sequence: Synthetic polypeptide
  Fc chain of XENP022569

SEQ ID NO: 25083 - protein, 11 aa, Artificial Sequence
  Description of Artificial Sequence: Synthetic peptide
  XENP022569 vhCDR1
RASQSVGNDVA

SEQ ID NO: 25084 - protein, 7 aa, Artificial Sequence
  Description of Artificial Sequence: Synthetic peptide
  XENP022569 vhCDR2
YASHRYT

SEQ ID NO: 25085 - protein, 9 aa, Artificial Sequence
  Description of Artificial Sequence: Synthetic peptide
  XENP022569 vhCDR3
QQDFSSPRT

SEQ ID NO: 25086 - protein, 5 aa, Artificial Sequence
  Description of Artificial Sequence: Synthetic peptide
  XENP022569 vlCDR1
NYWMN

SEQ ID NO: 25087 - protein, 19 aa, Artificial Sequence
  Description of Artificial Sequence: Synthetic peptide
  XENP022569 vlCDR2
EIRLYSNNYATHYAESVKG

SEQ ID NO: 25088 - protein, 11 aa, Artificial Sequence
  Description of Artificial Sequence: Synthetic peptide
  XENP022569 vlCDR3
YYGNYGGYFDV

SEQ ID NO: 25089 - protein, 218 aa, Artificial Sequence; identical to SEQ ID NO: 22539
  Description of Artificial Sequence: Synthetic polypeptide
  XENP022569 7G8_H3.33_L1.30-1G6_L1.194_H1.279 Light Chain

SEQ ID NO: 25090 - protein, 111 aa, Artificial Sequence; identical to SEQ ID NO: 22540
  Description of Artificial Sequence: Synthetic polypeptide
  VL of XENP022569

SEQ ID NO: 25091 - protein, 15 aa, Artificial Sequence
  Description of Artificial Sequence: Synthetic peptide
  XENP022569 vlCDR1
RASQSVDYDGDSYMN

SEQ ID NO: 25092 - protein, 7 aa, Artificial Sequence
  Description of Artificial Sequence: Synthetic peptide
  XENP022569 vlCDR2
AASELES

SEQ ID NO: 25093 - protein, 9 aa, Artificial Sequence
  Description of Artificial Sequence: Synthetic peptide
  XENP022569 vlCDR3
QQSNEDPFT

SEQ ID NO: 25094 - protein, 450 aa, Artificial Sequence; identical to SEQ ID NO: 22484
  Description of Artificial Sequence: Synthetic polypeptide
  XENP022604 7G8_H3.30_L1.34-1G6_L1.194_H1.279 Fab-Fc Heavy Chain

SEQ ID NO: 25095 - protein, 121 aa, Artificial Sequence; identical to SEQ ID NO: 22485
  Description of Artificial Sequence: Synthetic polypeptide
  VH of XENP022604

SEQ ID NO: 25096 - protein, 5 aa, Artificial Sequence
  Description of Artificial Sequence: Synthetic peptide
  XENP022604 vhCDR1
DAWMS

SEQ ID NO: 25097 - protein, 19 aa, Artificial Sequence
  Description of Artificial Sequence: Synthetic peptide
  XENP022604 vhCDR2
EISTKANNHATYYAESVKG

SEQ ID NO: 25098 - protein, 10 aa, Artificial Sequence
  Description of Artificial Sequence: Synthetic peptide
  XENP022604 vhCDR3
LATWDWYFDV

SEQ ID NO: 25099 - protein, 480 aa, Artificial Sequence; identical to SEQ ID NO: 23221
  Description of Artificial Sequence: Synthetic polypeptide
  XENP022604 7G8_H3.30_L1.34-1G6_L1.194_H1.279 scFv-Fc Heavy Chain

SEQ ID NO: 25100 - protein, 107 aa, Artificial Sequence; identical to SEQ ID NO: 10999
  Description of Artificial Sequence: Synthetic polypeptide
  VH of XENP022604

SEQ ID NO: 25101 - protein, 122 aa, Artificial Sequence; identical to SEQ ID NO: 10908
  Description of Artificial Sequence: Synthetic polypeptide
  VL of XENP022604

SEQ ID NO: 25102 - protein, 231 aa, Artificial Sequence; identical to SEQ ID NO: 21532
  Description of Artificial Sequence: Synthetic polypeptide
  Fc chain of XENP022604

SEQ ID NO: 25103 - protein, 11 aa, Artificial Sequence
  Description of Artificial Sequence: Synthetic peptide
  XENP022604 vhCDR1
RASQSVGNDVA

SEQ ID NO: 25104 - protein, 7 aa, Artificial Sequence
  Description of Artificial Sequence: Synthetic peptide
  XENP022604 vhCDR2
YASHRYT

SEQ ID NO: 25105 - protein, 9 aa, Artificial Sequence
  Description of Artificial Sequence: Synthetic peptide
  XENP022604 vhCDR3
QQDFSSPRT

SEQ ID NO: 25106 - protein, 5 aa, Artificial Sequence
  Description of Artificial Sequence: Synthetic peptide
  XENP022604 vlCDR1
NYWMN

SEQ ID NO: 25107 - protein, 19 aa, Artificial Sequence
  Description of Artificial Sequence: Synthetic peptide
  XENP022604 vlCDR2
EIRLYSNNYATHYAESVKG

SEQ ID NO: 25108 - protein, 11 aa, Artificial Sequence
  Description of Artificial Sequence: Synthetic peptide
  XENP022604 vlCDR3
YYGNYGGYFDV

SEQ ID NO: 25109 - protein, 218 aa, Artificial Sequence; identical to SEQ ID NO: 22599
  Description of Artificial Sequence: Synthetic polypeptide
  XENP022604 7G8_H3.30_L1.34-1G6_L1.194_H1.279 Light Chain

SEQ ID NO: 25110 - protein, 111 aa, Artificial Sequence; identical to SEQ ID NO: 22600
  Description of Artificial Sequence: Synthetic polypeptide
  VL of XENP022604

SEQ ID NO: 25111 - protein, 15 aa, Artificial Sequence
  Description of Artificial Sequence: Synthetic peptide
  XENP022604 vlCDR1
RASQSVDYDGDSYMN

SEQ ID NO: 25112 - protein, 7 aa, Artificial Sequence
  Description of Artificial Sequence: Synthetic peptide
  XENP022604 vlCDR2
AASELES

SEQ ID NO: 25113 - protein, 9 aa, Artificial Sequence
  Description of Artificial Sequence: Synthetic peptide
  XENP022604 vlCDR3
QQSNEDPFT

SEQ ID NO: 25114 - protein, 450 aa, Artificial Sequence; identical to SEQ ID NO: 22484
  Description of Artificial Sequence: Synthetic polypeptide
  XENP022605 7G8_H3.30_L1.36-1G6_L1.194_H1.279 Fab-Fc Heavy Chain

SEQ ID NO: 25115 - protein, 121 aa, Artificial Sequence; identical to SEQ ID NO: 22485
  Description of Artificial Sequence: Synthetic polypeptide
  VH of XENP022605

SEQ ID NO: 25116 - protein, 5 aa, Artificial Sequence
  Description of Artificial Sequence: Synthetic peptide
  XENP022605 vhCDR1
DAWMS

SEQ ID NO: 25117 - protein, 19 aa, Artificial Sequence
  Description of Artificial Sequence: Synthetic peptide
  XENP022605 vhCDR2
EISTKANNHATYYAESVKG

SEQ ID NO: 25118 - protein, 10 aa, Artificial Sequence
  Description of Artificial Sequence: Synthetic peptide
  XENP022605 vhCDR3
LATWDWYFDV

SEQ ID NO: 25119 - protein, 480 aa, Artificial Sequence; identical to SEQ ID NO: 23221
  Description of Artificial Sequence: Synthetic polypeptide
  XENP022605 7G8_H3.30_L1.36-1G6_L1.194_H1.279 scFv-Fc Heavy Chain

SEQ ID NO: 25120 - protein, 107 aa, Artificial Sequence; identical to SEQ ID NO: 10999
  Description of Artificial Sequence: Synthetic polypeptide
  VH of XENP022605

SEQ ID NO: 25121 - protein, 122 aa, Artificial Sequence; identical to SEQ ID NO: 10908
  Description of Artificial Sequence: Synthetic polypeptide
  VL of XENP022605

SEQ ID NO: 25122 - protein, 231 aa, Artificial Sequence; identical to SEQ ID NO: 21532
  Description of Artificial Sequence: Synthetic polypeptide
  Fc chain of XENP022605

SEQ ID NO: 25123 - protein, 11 aa, Artificial Sequence
  Description of Artificial Sequence: Synthetic peptide
  XENP022605 vhCDR1
RASQSVGNDVA

SEQ ID NO: 25124 - protein, 7 aa, Artificial Sequence
  Description of Artificial Sequence: Synthetic peptide
  XENP022605 vhCDR2
YASHRYT

SEQ ID NO: 25125 - protein, 9 aa, Artificial Sequence
  Description of Artificial Sequence: Synthetic peptide
  XENP022605 vhCDR3
QQDFSSPRT

SEQ ID NO: 25126 - protein, 5 aa, Artificial Sequence
  Description of Artificial Sequence: Synthetic peptide
  XENP022605 vlCDR1
NYWMN

SEQ ID NO: 25127 - protein, 19 aa, Artificial Sequence
  Description of Artificial Sequence: Synthetic peptide
  XENP022605 vlCDR2
EIRLYSNNYATHYAESVKG

SEQ ID NO: 25128 - protein, 11 aa, Artificial Sequence
  Description of Artificial Sequence: Synthetic peptide
  XENP022605 vlCDR3
YYGNYGGYFDV

SEQ ID NO: 25129 - protein, 218 aa, Artificial Sequence; identical to SEQ ID NO: 22619
  Description of Artificial Sequence: Synthetic polypeptide
  XENP022605 7G8_H3.30_L1.36-1G6_L1.194_H1.279 Light Chain

SEQ ID NO: 25130 - protein, 111 aa, Artificial Sequence; identical to SEQ ID NO: 22620
  Description of Artificial Sequence: Synthetic polypeptide
  VL of XENP022605

SEQ ID NO: 25131 - protein, 15 aa, Artificial Sequence
  Description of Artificial Sequence: Synthetic peptide
  XENP022605 vlCDR1
RASQSVDHDGDSYMN

SEQ ID NO: 25132 - protein, 7 aa, Artificial Sequence
  Description of Artificial Sequence: Synthetic peptide
  XENP022605 vlCDR2
AASELES

SEQ ID NO: 25133 - protein, 9 aa, Artificial Sequence
  Description of Artificial Sequence: Synthetic peptide
  XENP022605 vlCDR3
QQSNEDPFT

SEQ ID NO: 25134 - protein, 448 aa, Artificial Sequence
  Description of Artificial Sequence: Synthetic polypeptide
  XENP019184 10A7_H0L0-nivolumab_H0.1_L0 Fab-Fc Heavy Chain
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 25135 - protein, 119 aa, Artificial Sequence; identical to SEQ ID NO: 21505
  Description of Artificial Sequence: Synthetic polypeptide
  VH of XENP019184

SEQ ID NO: 25136 - protein, 5 aa, Artificial Sequence
  Description of Artificial Sequence: Synthetic peptide
  XENP019184 vhCDR1
SFTMH

SEQ ID NO: 25137 - protein, 17 aa, Artificial Sequence
  Description of Artificial Sequence: Synthetic peptide
  XENP019184 vhCDR2
FIRSGSGIVFYADAVRG

SEQ ID NO: 25138 - protein, 10 aa, Artificial Sequence
  Description of Artificial Sequence: Synthetic peptide
  XENP019184 vhCDR3
RPLGHNTFDS

SEQ ID NO: 25139 - protein, 471 aa, Artificial Sequence; identical to SEQ ID NO: 22749
  Description of Artificial Sequence: Synthetic polypeptide
  XENP019184 10A7_H0L0-nivolumab_H0.1_L0 scFv-Fc Heavy Chain

SEQ ID NO: 25140 - protein, 113 aa, Artificial Sequence; identical to SEQ ID NO: 6210
  Description of Artificial Sequence: Synthetic polypeptide
  VH of XENP019184

SEQ ID NO: 25141 - protein, 107 aa, Artificial Sequence [sequence omitted]

SEQ ID NO: 25142 - protein, 231 aa, Artificial Sequence; identical to SEQ ID NO: 21532
  Description of Artificial Sequence: Synthetic polypeptide
  Fc chain of XENP019184

SEQ ID NO: 25143 - protein, 5 aa, Artificial Sequence
  Description of Artificial Sequence: Synthetic peptide
  XENP019184 vhCDR1
NSGMH

SEQ ID NO: 25144 - protein, 17 aa, Artificial Sequence
  Description of Artificial Sequence: Synthetic peptide
  XENP019184 vhCDR2
VIWYDGSKRYYADSVKG

SEQ ID NO: 25145 - protein, 4 aa, Artificial Sequence
  Description of Artificial Sequence: Synthetic peptide
  XENP019184 vhCDR3
NDDY

SEQ ID NO: 25146 - protein, 11 aa, Artificial Sequence
  Description of Artificial Sequence: Synthetic peptide
  XENP019184 vlCDR1
RASQSVSSYLA

SEQ ID NO: 25147 - protein, 7 aa, Artificial Sequence
  Description of Artificial Sequence: Synthetic peptide
  XENP019184 vlCDR2
DASNRAT

SEQ ID NO: 25148 - protein, 9 aa, Artificial Sequence
  Description of Artificial Sequence: Synthetic peptide
  XENP019184 vlCDR3
QQSSNWPRT

SEQ ID NO: 25149 - protein, 220 aa, Artificial Sequence; identical to SEQ ID NO: 21509
  Description of Artificial Sequence: Synthetic polypeptide
  XENP019184 10A7_H0L0-nivolumab_H0.1_L0 Light Chain

SEQ ID NO: 25150 - protein, 113 aa, Artificial Sequence; identical to SEQ ID NO: 21510
  Description of Artificial Sequence: Synthetic polypeptide
  VL of XENP019184

SEQ ID NO: 25151 - protein, 17 aa, Artificial Sequence
  Description of Artificial Sequence: Synthetic peptide
  XENP019184 vlCDR1
KSSQSLYYSGVKENLLA

SEQ ID NO: 25152 - protein, 7 aa, Artificial Sequence
  Description of Artificial Sequence: Synthetic peptide
  XENP019184 vlCDR2
YASIRFT

SEQ ID NO: 25153 - protein, 9 aa, Artificial Sequence
  Description of Artificial Sequence: Synthetic peptide
  XENP019184 vlCDR3
QQGINNPLT

SEQ ID NO: 25154 - protein, 448 aa, Artificial Sequence
  Description of Artificial Sequence: Synthetic polypeptide
  XENP019185 1F4_H0L0-nivolumab_H0.1_L0 Fab-Fc Heavy Chain
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 25155 - protein, 119 aa, Artificial Sequence; identical to SEQ ID NO: 21515
  Description of Artificial Sequence: Synthetic polypeptide
  VH of XENP019185

SEQ ID NO: 25156 - protein, 5 aa, Artificial Sequence
  Description of Artificial Sequence: Synthetic peptide
  XENP019185 vhCDR1
GHLMN

SEQ ID NO: 25157 - protein, 17 aa, Artificial Sequence
  Description of Artificial Sequence: Synthetic peptide
  XENP019185 vhCDR2
LIIPYNGGTSYNQKFKG

SEQ ID NO: 25158 - protein, 10 aa, Artificial Sequence
  Description of Artificial Sequence: Synthetic peptide
  XENP019185 vhCDR3
GLRGFYAMDY

SEQ ID NO: 25159 - protein, 471 aa, Artificial Sequence; identical to SEQ ID NO: 22749
  Description of Artificial Sequence: Synthetic polypeptide
  XENP019185 1F4_H0L0-nivolumab_H0.1_L0 scFv-Fc Heavy Chain

SEQ ID NO: 25160 - protein, 113 aa, Artificial Sequence; identical to SEQ ID NO: 6210
  Description of Artificial Sequence: Synthetic polypeptide
  VH of XENP019185

SEQ ID NO: 25161 - protein, 107 aa, Artificial Sequence [sequence omitted]

SEQ ID NO: 25162 - protein, 231 aa, Artificial Sequence; identical to SEQ ID NO: 21532
  Description of Artificial Sequence: Synthetic polypeptide
  Fc chain of XENP019185

SEQ ID NO: 25163 - protein, 5 aa, Artificial Sequence
  Description of Artificial Sequence: Synthetic peptide
  XENP019185 vhCDR1
NSGMH

SEQ ID NO: 25164 - protein, 17 aa, Artificial Sequence
  Description of Artificial Sequence: Synthetic peptide
  XENP019185 vhCDR2
VIWYDGSKRYYADSVKG

SEQ ID NO: 25165 - protein, 4 aa, Artificial Sequence
  Description of Artificial Sequence: Synthetic peptide
  XENP019185 vhCDR3
NDDY

SEQ ID NO: 25166 - protein, 11 aa, Artificial Sequence
  Description of Artificial Sequence: Synthetic peptide
  XENP019185 vlCDR1
RASQSVSSYLA

SEQ ID NO: 25167 - protein, 7 aa, Artificial Sequence
  Description of Artificial Sequence: Synthetic peptide
  XENP019185 vlCDR2
DASNRAT

SEQ ID NO: 25168 - protein, 9 aa, Artificial Sequence
  Description of Artificial Sequence: Synthetic peptide
  XENP019185 vlCDR3
QQSSNWPRT

SEQ ID NO: 25169 - protein, 219 aa, Artificial Sequence; identical to SEQ ID NO: 21519
  Description of Artificial Sequence: Synthetic polypeptide
  XENP019185 1F4_H0L0-nivolumab_H0.1_L0 Light Chain

SEQ ID NO: 25170 - protein, 112 aa, Artificial Sequence; identical to SEQ ID NO: 21520
  Description of Artificial Sequence: Synthetic polypeptide
  VL of XENP019185

SEQ ID NO: 25171 - protein, 16 aa, Artificial Sequence
  Description of Artificial Sequence: Synthetic peptide
  XENP019185 vlCDR1
RSSQSLVNSYGNTFLS

SEQ ID NO: 25172 - protein, 7 aa, Artificial Sequence
  Description of Artificial Sequence: Synthetic peptide
  XENP019185 vlCDR2
GISNRFS

SEQ ID NO: 25173 - protein, 9 aa, Artificial Sequence
  Description of Artificial Sequence: Synthetic peptide
  XENP019185 vlCDR3
LQGTHQPPT

SEQ ID NO: 25174 - protein, 446 aa, Artificial Sequence
  Description of Artificial Sequence: Synthetic polypeptide
  XENP016340 mAb8213_H0L0-nivolumab_H0.1_L0 Fab-Fc Heavy Chain
QVQLVQSGAEVKKPGASVKVSCKASGYTFTSYWMHWVRQAPGQGLEWMGEINPSNGRTNYNEKFKTRVTITADTSTSTAYMELSSLRSEDTAVYYCARGYYLYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 25175 - protein, 117 aa, Artificial Sequence; identical to SEQ ID NO: 20766
  Description of Artificial Sequence: Synthetic polypeptide
  VH of XENP016340

SEQ ID NO: 25176 - protein, 5 aa, Artificial Sequence
  Description of Artificial Sequence: Synthetic peptide
  XENP016340 vhCDR1
SYWMH

SEQ ID NO: 25177 - protein, 17 aa, Artificial Sequence
  Description of Artificial Sequence: Synthetic peptide
  XENP016340 vhCDR2
EINPSNGRTNYNEKFKT

SEQ ID NO: 25178 - protein, 8 aa, Artificial Sequence
  Description of Artificial Sequence: Synthetic peptide
  XENP016340 vhCDR3
GYYLYFDY

SEQ ID NO: 25179 - protein, 471 aa, Artificial Sequence; identical to SEQ ID NO: 22749
  Description of Artificial Sequence: Synthetic polypeptide
  XENP016340 mAb8213_H0L0-nivolumab_H0.1_L0 scFv-Fc Heavy Chain

SEQ ID NO: 25180 - protein, 113 aa, Artificial Sequence; identical to SEQ ID NO: 6210
  Description of Artificial Sequence: Synthetic polypeptide
  VH of XENP016340

SEQ ID NO: 25181 - protein, 107 aa, Artificial Sequence [sequence omitted]

SEQ ID NO: 25182 - protein, 231 aa, Artificial Sequence; identical to SEQ ID NO: 21532
  Description of Artificial Sequence: Synthetic polypeptide
  Fc chain of XENP016340

SEQ ID NO: 25183 - protein, 5 aa, Artificial Sequence
  Description of Artificial Sequence: Synthetic peptide
  XENP016340 vhCDR1
NSGMH

SEQ ID NO: 25184 - protein, 17 aa, Artificial Sequence
  Description of Artificial Sequence: Synthetic peptide
  XENP016340 vhCDR2
VIWYDGSKRYYADSVKG

SEQ ID NO: 25185 - protein, 4 aa, Artificial Sequence
  Description of Artificial Sequence: Synthetic peptide
  XENP016340 vhCDR3
NDDY

SEQ ID NO: 25186 - protein, 11 aa, Artificial Sequence
  Description of Artificial Sequence: Synthetic peptide
  XENP016340 vlCDR1
RASQSVSSYLA

SEQ ID NO: 25187 - protein, 7 aa, Artificial Sequence
  Description of Artificial Sequence: Synthetic peptide
  XENP016340 vlCDR2
DASNRAT

SEQ ID NO: 25188 - protein, 9 aa, Artificial Sequence
  Description of Artificial Sequence: Synthetic peptide
  XENP016340 vlCDR3
QQSSNWPRT

SEQ ID NO: 25189 - protein, 214 aa, Artificial Sequence; identical to SEQ ID NO: 20770
  Description of Artificial Sequence: Synthetic polypeptide
  XENP016340 mAb8213_H0L0-nivolumab_H0.1_L0 Light Chain

SEQ ID NO: 25190 - protein, 107 aa, Artificial Sequence; identical to SEQ ID NO: 20771
  Description of Artificial Sequence: Synthetic polypeptide
  VL of XENP016340

SEQ ID NO: 25191 - protein, 11 aa, Artificial Sequence
  Description of Artificial Sequence: Synthetic peptide
  XENP016340 vlCDR1
HASQGIRINIG

SEQ ID NO: 25192 - protein, 7 aa, Artificial Sequence
  Description of Artificial Sequence: Synthetic peptide
  XENP016340 vlCDR2
HGTNLED

SEQ ID NO: 25193 - protein, 9 aa, Artificial Sequence
  Description of Artificial Sequence: Synthetic peptide
  XENP016340 vlCDR3
VQYGQFPWT

SEQ ID NO: 25194 - protein, 223 aa, Artificial Sequence
  Description of Artificial Sequence: Synthetic polypeptide
  XENP020847 2A11_H1L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25195 - protein, 118 aa, Artificial Sequence; identical to SEQ ID NO: 17236
  Description of Artificial Sequence: Synthetic polypeptide
  VH of XENP020847

SEQ ID NO: 25196 - protein, 5 aa, Artificial Sequence
  Description of Artificial Sequence: Synthetic peptide
  XENP020847 vhCDR1
DYYMH

SEQ ID NO: 25197 - protein, 17 aa, Artificial Sequence
  Description of Artificial Sequence: Synthetic peptide
  XENP020847 vhCDR2
WIDPENGDTEYAPKFQG

SEQ ID NO: 25198 - protein, 9 aa, Artificial Sequence
  Description of Artificial Sequence: Synthetic peptide
  XENP020847 vhCDR3
RGVRQALDY

SEQ ID NO: 25199 - protein, 214 aa, Artificial Sequence; identical to SEQ ID NO: 17250
  Description of Artificial Sequence: Synthetic polypeptide
  XENP020847 2A11_H1L2_Fab Light Chain

SEQ ID NO: 25200 - protein, 107 aa, Artificial Sequence; identical to SEQ ID NO: 17251
  Description of Artificial Sequence: Synthetic polypeptide
  VL of XENP020847

SEQ ID NO: 25201 - protein, 11 aa, Artificial Sequence
  Description of Artificial Sequence: Synthetic peptide
  XENP020847 vlCDR1
QASQDIGNYLN

SEQ ID NO: 25202 - protein, 7 aa, Artificial Sequence
  Description of Artificial Sequence: Synthetic peptide
  XENP020847 vlCDR2
YTSRLHS

SEQ ID NO: 25203 - protein, 9 aa, Artificial Sequence
  Description of Artificial Sequence: Synthetic peptide
  XENP020847 vlCDR3
QQGNTLPYT

SEQ ID NO: 25204 - protein, 223 aa, Artificial Sequence
  Description of Artificial Sequence: Synthetic polypeptide
  XENP021073 2A11_H0L0_Fab Heavy Chain
EVQLQQSGAELVRSGASVKLSCTASGFNIKDYYMHWVKQRPEQGLEWIGWIDPENGDTEYAPKFQGKATMTADTSSNTAYLQLSSLTSEDTAVYYCYARGVRQALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25205 - protein, 118 aa, Artificial Sequence; identical to SEQ ID NO: 17226
  Description of Artificial Sequence: Synthetic polypeptide
  VH of XENP021073

SEQ ID NO: 25206 - protein, 5 aa, Artificial Sequence
  Description of Artificial Sequence: Synthetic peptide
  XENP021073 vhCDR1
DYYMH

SEQ ID NO: 25207 - protein, 17 aa, Artificial Sequence
  Description of Artificial Sequence: Synthetic peptide
  XENP021073 vhCDR2
WIDPENGDTEYAPKFQG

SEQ ID NO: 25208 - protein, 9 aa, Artificial Sequence
  Description of Artificial Sequence: Synthetic peptide
  XENP021073 vhCDR3
RGVRQALDY

SEQ ID NO: 25209 - protein, 214 aa, Artificial Sequence; identical to SEQ ID NO: 17230
  Description of Artificial Sequence: Synthetic polypeptide
  XENP021073 2A11_H0L0_Fab Light Chain

SEQ ID NO: 25210 - protein, 107 aa, Artificial Sequence; identical to SEQ ID NO: 17231
  Description of Artificial Sequence: Synthetic polypeptide
  VL of XENP021073

SEQ ID NO: 25211 - protein, 11 aa, Artificial Sequence
  Description of Artificial Sequence: Synthetic peptide
  XENP021073 vlCDR1
RASQDIGNYLN

SEQ ID NO: 25212 - protein, 7 aa, Artificial Sequence
  Description of Artificial Sequence: Synthetic peptide
  XENP021073 vlCDR2
YTSRLHS

SEQ ID NO: 25213 - protein, 9 aa, Artificial Sequence
  Description of Artificial Sequence: Synthetic peptide
  XENP021073 vlCDR3
QQGNTLPYT

SEQ ID NO: 25214 - protein, 223 aa, Artificial Sequence
  Description of Artificial Sequence: Synthetic polypeptide
  XENP021228 2A11_H1.1_L2_Fab Heavy Chain
EVQLVQSGAEVKKPGATVKISCKASGYNIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25215 - protein, 118 aa, Artificial Sequence
  Description of Artificial Sequence: Synthetic polypeptide
  VH of XENP021228
EVQLVQSGAEVKKPGATVKISCKASGYNIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25216 - protein, 5 aa, Artificial Sequence
  Description of Artificial Sequence: Synthetic peptide
  XENP021228 vhCDR1
DYYMH

SEQ ID NO: 25217 - protein, 17 aa, Artificial Sequence
  Description of Artificial Sequence: Synthetic peptide
  XENP021228 vhCDR2
WIDPENGDTEYAPKFQG

SEQ ID NO: 25218 - protein, 9 aa, Artificial Sequence
  Description of Artificial Sequence: Synthetic peptide
  XENP021228 vhCDR3
RGVRQALDY

SEQ ID NO: 25219 - protein, 214 aa, Artificial Sequence; identical to SEQ ID NO: 17250
  Description of Artificial Sequence: Synthetic polypeptide
  XENP021228 2A11_H1.1_L2_Fab Light Chain

SEQ ID NO: 25220 - protein, 107 aa, Artificial Sequence; identical to SEQ ID NO: 17251
  Description of Artificial Sequence: Synthetic polypeptide
  VL of XENP021228

SEQ ID NO: 25221 - protein, 11 aa, Artificial Sequence
  Description of Artificial Sequence: Synthetic peptide
  XENP021228 vlCDR1
QASQDIGNYLN

SEQ ID NO: 25222 - protein, 7 aa, Artificial Sequence
  Description of Artificial Sequence: Synthetic peptide
  XENP021228 vlCDR2
YTSRLHS

SEQ ID NO: 25223 - protein, 9 aa, Artificial Sequence
  Description of Artificial Sequence: Synthetic peptide
  XENP021228 vlCDR3
QQGNTLPYT

SEQ ID NO: 25224 - protein, 223 aa, Artificial Sequence
  Description of Artificial Sequence: Synthetic polypeptide
  XENP021229 2A11_H1.2_L2_Fab Heavy Chain
EVQLVQSGAEVKKPGATVKISCKASGFDIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25225 - protein, 118 aa, Artificial Sequence
  Description of Artificial Sequence: Synthetic polypeptide
  VH of XENP021229
EVQLVQSGAEVKKPGATVKISCKASGFDIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25226 - protein, 5 aa, Artificial Sequence
  Description of Artificial Sequence: Synthetic peptide
  XENP021229 vhCDR1
DYYMH

SEQ ID NO: 25227 - protein, 17 aa, Artificial Sequence
  Description of Artificial Sequence: Synthetic peptide
  XENP021229 vhCDR2
WIDPENGDTEYAPKFQG

SEQ ID NO: 25228 - protein, 9 aa, Artificial Sequence
  Description of Artificial Sequence: Synthetic peptide
  XENP021229 vhCDR3
RGVRQALDY

SEQ ID NO: 25229 - protein, 214 aa, Artificial Sequence; identical to SEQ ID NO: 17250
  Description of Artificial Sequence: Synthetic polypeptide
  XENP021229 2A11_H1.2_L2_Fab Light Chain

SEQ ID NO: 25230 - protein, 107 aa, Artificial Sequence; identical to SEQ ID NO: 17251
  Description of Artificial Sequence: Synthetic polypeptide
  VL of XENP021229

SEQ ID NO: 25231 - protein, 11 aa, Artificial Sequence
  Description of Artificial Sequence: Synthetic peptide
  XENP021229 vlCDR1
QASQDIGNYLN

SEQ ID NO: 25232 - protein, 7 aa, Artificial Sequence
  Description of Artificial Sequence: Synthetic peptide
  XENP021229 vlCDR2
YTSRLHS

SEQ ID NO: 25233 - protein, 9 aa, Artificial Sequence
  Description of Artificial Sequence: Synthetic peptide
  XENP021229 vlCDR3
QQGNTLPYT

SEQ ID NO: 25234 - protein, 223 aa, Artificial Sequence
  Description of Artificial Sequence: Synthetic polypeptide
  XENP021230 2A11_H1.3_L2_Fab Heavy Chain
EVQLVQSGAEVKKPGATVKISCKASGFHIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25235 - protein, 118 aa, Artificial Sequence
  Description of Artificial Sequence: Synthetic polypeptide
  VH of XENP021230
EVQLVQSGAEVKKPGATVKISCKASGFHIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25236 - protein, 5 aa, Artificial Sequence
  Description of Artificial Sequence: Synthetic peptide
  XENP021230 vhCDR1
DYYMH

SEQ ID NO: 25237 - protein, 17 aa, Artificial Sequence
  Description of Artificial Sequence: Synthetic peptide
  XENP021230 vhCDR2
WIDPENGDTEYAPKFQG

SEQ ID NO: 25238 - protein, 9 aa, Artificial Sequence
  Description of Artificial Sequence: Synthetic peptide
  XENP021230 vhCDR3
RGVRQALDY

SEQ ID NO: 25239 - protein, 214 aa, Artificial Sequence; identical to SEQ ID NO: 17250
  Description of Artificial Sequence: Synthetic polypeptide
  XENP021230 2A11_H1.3_L2_Fab Light Chain

SEQ ID NO: 25240 - protein, 107 aa, Artificial Sequence; identical to SEQ ID NO: 17251
  Description of Artificial Sequence: Synthetic polypeptide
  VL of XENP021230

SEQ ID NO: 25241 - protein, 11 aa, Artificial Sequence
  Description of Artificial Sequence: Synthetic peptide
  XENP021230 vlCDR1
QASQDIGNYLN

SEQ ID NO: 25242 - protein, 7 aa, Artificial Sequence
  Description of Artificial Sequence: Synthetic peptide
  XENP021230 vlCDR2
YTSRLHS

SEQ ID NO: 25243 - protein, 9 aa, Artificial Sequence
  Description of Artificial Sequence: Synthetic peptide
  XENP021230 vlCDR3
QQGNTLPYT

SEQ ID NO: 25244 - protein, 223 aa, Artificial Sequence
  Description of Artificial Sequence: Synthetic polypeptide
  XENP021231 2A11_H1.4_L2_Fab Heavy Chain
EVQLVQSGAEVKKPGATVKISCKASGFEIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25245 - protein, 118 aa, Artificial Sequence
  Description of Artificial Sequence: Synthetic polypeptide
  VH of XENP021231
EVQLVQSGAEVKKPGATVKISCKASGFEIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25246 - protein, 5 aa, Artificial Sequence
  Description of Artificial Sequence: Synthetic peptide
  XENP021231 vhCDR1
DYYMH

SEQ ID NO: 25247 - protein, 17 aa, Artificial Sequence
  Description of Artificial Sequence: Synthetic peptide
  XENP021231 vhCDR2
WIDPENGDTEYAPKFQG

SEQ ID NO: 25248 - protein, 9 aa, Artificial Sequence
  Description of Artificial Sequence: Synthetic peptide
  XENP021231 vhCDR3
RGVRQALDY

SEQ ID NO: 25249 - protein, 214 aa, Artificial Sequence; identical to SEQ ID NO: 17250
  Description of Artificial Sequence: Synthetic polypeptide
  XENP021231 2A11_H1.4_L2_Fab Light Chain

SEQ ID NO: 25250 - protein, 107 aa, Artificial Sequence; identical to SEQ ID NO: 17251
  Description of Artificial Sequence: Synthetic polypeptide
  VL of XENP021231

SEQ ID NO: 25251 - protein, 11 aa, Artificial Sequence
  Description of Artificial Sequence: Synthetic peptide
  XENP021231 vlCDR1
QASQDIGNYLN

SEQ ID NO: 25252 - protein, 7 aa, Artificial Sequence
  Description of Artificial Sequence: Synthetic peptide
  XENP021231 vlCDR2
YTSRLHS

SEQ ID NO: 25253 - protein, 9 aa, Artificial Sequence
  Description of Artificial Sequence: Synthetic peptide
  XENP021231 vlCDR3
QQGNTLPYT

SEQ ID NO: 25254 - protein, 223 aa, Artificial Sequence
  Description of Artificial Sequence: Synthetic polypeptide
  XENP021232 2A11_H1.5_L2_Fab Heavy Chain
EVQLVQSGAEVKKPGATVKISCKASGFQIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25255 - protein, 118 aa, Artificial Sequence
  Description of Artificial Sequence: Synthetic polypeptide
  VH of XENP021232
EVQLVQSGAEVKKPGATVKISCKASGFQIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25256 - protein, 5 aa, Artificial Sequence
  Description of Artificial Sequence: Synthetic peptide
  XENP021232 vhCDR1
DYYMH

SEQ ID NO: 25257 - protein, 17 aa, Artificial Sequence
  Description of Artificial Sequence: Synthetic peptide
  XENP021232 vhCDR2
WIDPENGDTEYAPKFQG

SEQ ID NO: 25258 - protein, 9 aa, Artificial Sequence
  Description of Artificial Sequence: Synthetic peptide
  XENP021232 vhCDR3
RGVRQALDY

SEQ ID NO: 25259 - protein, 214 aa, Artificial Sequence; identical to SEQ ID NO: 17250
  Description of Artificial Sequence: Synthetic polypeptide
  XENP021232 2A11_H1.5_L2_Fab Light Chain

SEQ ID NO: 25260 - protein, 107 aa, Artificial Sequence; identical to SEQ ID NO: 17251
  Description of Artificial Sequence: Synthetic polypeptide
  VL of XENP021232

SEQ ID NO: 25261 - protein, 11 aa, Artificial Sequence
  Description of Artificial Sequence: Synthetic peptide
  XENP021232 vlCDR1
QASQDIGNYLN

SEQ ID NO: 25262 - protein, 7 aa, Artificial Sequence
  Description of Artificial Sequence: Synthetic peptide
  XENP021232 vlCDR2
YTSRLHS

SEQ ID NO: 25263 - protein, 9 aa, Artificial Sequence
  Description of Artificial Sequence: Synthetic peptide
  XENP021232 vlCDR3
QQGNTLPYT

SEQ ID NO: 25264 - protein, 223 aa, Artificial Sequence
  Description of Artificial Sequence: Synthetic polypeptide
  XENP021233 2A11_H1.6_L2_Fab Heavy Chain
EVQLVQSGAEVKKPGATVKISCKASGFAIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25265 - protein, 118 aa, Artificial Sequence
  Description of Artificial Sequence: Synthetic polypeptide
  VH of XENP021233
EVQLVQSGAEVKKPGATVKISCKASGFAIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25266 - protein, 5 aa, Artificial Sequence
  Description of Artificial Sequence: Synthetic peptide
  XENP021233 vhCDR1
DYYMH

SEQ ID NO: 25267 - protein, 17 aa, Artificial Sequence
  Description of Artificial Sequence: Synthetic peptide
  XENP021233 vhCDR2
WIDPENGDTEYAPKFQG

SEQ ID NO: 25268 - protein, 9 aa, Artificial Sequence
  Description of Artificial Sequence: Synthetic peptide
  XENP021233 vhCDR3
RGVRQALDY

SEQ ID NO: 25269 - protein, 214 aa, Artificial Sequence; identical to SEQ ID NO: 17250
  Description of Artificial Sequence: Synthetic polypeptide
  XENP021233 2A11_H1.6_L2_Fab Light Chain

SEQ ID NO: 25270 - protein, 107 aa, Artificial Sequence; identical to SEQ ID NO: 17251
  Description of Artificial Sequence: Synthetic polypeptide
  VL of XENP021233

SEQ ID NO: 25271 - protein, 11 aa, Artificial Sequence
  Description of Artificial Sequence: Synthetic peptide
  XENP021233 vlCDR1
QASQDIGNYLN

SEQ ID NO: 25272 - protein, 7 aa, Artificial Sequence
  Description of Artificial Sequence: Synthetic peptide
  XENP021233 vlCDR2
YTSRLHS

SEQ ID NO: 25273 - protein, 9 aa, Artificial Sequence
  Description of Artificial Sequence: Synthetic peptide
  XENP021233 vlCDR3
QQGNTLPYT

SEQ ID NO: 25274 - protein, 223 aa, Artificial Sequence
  Description of Artificial Sequence: Synthetic polypeptide
  XENP021234 2A11_H1.7_L2_Fab Heavy Chain
EVQLVQSGAEVKKPGATVKISCKASGFLIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25275 - protein, 118 aa, Artificial Sequence
  Description of Artificial Sequence: Synthetic polypeptide
  VH of XENP021234
EVQLVQSGAEVKKPGATVKISCKASGFLIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25276 - protein, 5 aa, Artificial Sequence
  Description of Artificial Sequence: Synthetic peptide
  XENP021234 vhCDR1
DYYMH

SEQ ID NO: 25277 - protein, 17 aa, Artificial Sequence
  Description of Artificial Sequence: Synthetic peptide
  XENP021234 vhCDR2
WIDPENGDTEYAPKFQG

SEQ ID NO: 25278 - protein, 9 aa, Artificial Sequence
  Description of Artificial Sequence: Synthetic peptide
  XENP021234 vhCDR3
RGVRQALDY

SEQ ID NO: 25279 - protein, 214 aa, Artificial Sequence; identical to SEQ ID NO: 17250
  Description of Artificial Sequence: Synthetic polypeptide
  XENP021234 2A11_H1.7_L2_Fab Light Chain

SEQ ID NO: 25280 - protein, 107 aa, Artificial Sequence; identical to SEQ ID NO: 17251
  Description of Artificial Sequence: Synthetic polypeptide
  VL of XENP021234

SEQ ID NO: 25281 - protein, 11 aa, Artificial Sequence
  Description of Artificial Sequence: Synthetic peptide
  XENP021234 vlCDR1
QASQDIGNYLN

SEQ ID NO: 25282 - protein, 7 aa, Artificial Sequence
  Description of Artificial Sequence: Synthetic peptide
  XENP021234 vlCDR2
YTSRLHS

SEQ ID NO: 25283 - protein, 9 aa, Artificial Sequence
  Description of Artificial Sequence: Synthetic peptide
  XENP021234 vlCDR3
QQGNTLPYT

SEQ ID NO: 25284 - protein, 223 aa, Artificial Sequence
  Description of Artificial Sequence: Synthetic polypeptide
  XENP021235 2A11_H1.8_L2_Fab Heavy Chain
EVQLVQSGAEVKKPGATVKISCKASGFTIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25285 - protein, 118 aa, Artificial Sequence
  Description of Artificial Sequence: Synthetic polypeptide
  VH of XENP021235
EVQLVQSGAEVKKPGATVKISCKASGFTIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25286 - protein, 5 aa, Artificial Sequence
  Description of Artificial Sequence: Synthetic peptide
  XENP021235 vhCDR1
DYYMH

SEQ ID NO: 25287 - protein, 17 aa, Artificial Sequence
  Description of Artificial Sequence: Synthetic peptide
  XENP021235 vhCDR2
WIDPENGDTEYAPKFQG

SEQ ID NO: 25288 - protein, 9 aa, Artificial Sequence
  Description of Artificial Sequence: Synthetic peptide
  XENP021235 vhCDR3
RGVRQALDY

SEQ ID NO: 25289 - protein, 214 aa, Artificial Sequence; identical to SEQ ID NO: 17250
  Description of Artificial Sequence: Synthetic polypeptide
  XENP021235 2A11_H1.8_L2_Fab Light Chain

SEQ ID NO: 25290 - protein, 107 aa, Artificial Sequence; identical to SEQ ID NO: 17251
  Description of Artificial Sequence: Synthetic polypeptide
  VL of XENP021235

SEQ ID NO: 25291 - protein, 11 aa, Artificial Sequence
  Description of Artificial Sequence: Synthetic peptide
  XENP021235 vlCDR1
QASQDIGNYLN

SEQ ID NO: 25292 - protein, 7 aa, Artificial Sequence
  Description of Artificial Sequence: Synthetic peptide
  XENP021235 vlCDR2
YTSRLHS

SEQ ID NO: 25293 - protein, 9 aa, Artificial Sequence
  Description of Artificial Sequence: Synthetic peptide
  XENP021235 vlCDR3
QQGNTLPYT

SEQ ID NO: 25294 - protein, 223 aa, Artificial Sequence
  Description of Artificial Sequence: Synthetic polypeptide
  XENP021236 2A11_H1.9_L2_Fab Heavy Chain
EVQLVQSGAEVKKPGATVKISCKASGFKIKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25295 - protein, 118 aa, Artificial Sequence
  Description of Artificial Sequence: Synthetic polypeptide
  VH of XENP021236
EVQLVQSGAEVKKPGATVKISCKASGFKIKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25296 - protein, 5 aa, Artificial Sequence
  Description of Artificial Sequence: Synthetic peptide
  XENP021236 vhCDR1
DYYMH

SEQ ID NO: 25297 - protein, 17 aa, Artificial Sequence
  Description of Artificial Sequence: Synthetic peptide
  XENP021236 vhCDR2
WIDPENGDTEYAPKFQG

SEQ ID NO: 25298 - protein, 9 aa, Artificial Sequence
  Description of Artificial Sequence: Synthetic peptide
  XENP021236 vhCDR3
RGVRQALDY

SEQ ID NO: 25299 - protein, 214 aa, Artificial Sequence; identical to SEQ ID NO: 17250
  Description of Artificial Sequence: Synthetic polypeptide
  XENP021236 2A11_H1.9_L2_Fab Light Chain

SEQ ID NO: 25300 - protein, 107 aa, Artificial Sequence; identical to SEQ ID NO: 17251
  Description of Artificial Sequence: Synthetic polypeptide
  VL of XENP021236

SEQ ID NO: 25301 - protein, 11 aa, Artificial Sequence
  Description of Artificial Sequence: Synthetic peptide
  XENP021236 vlCDR1
QASQDIGNYLN

SEQ ID NO: 25302 - protein, 7 aa, Artificial Sequence
  Description of Artificial Sequence: Synthetic peptide
  XENP021236 vlCDR2
YTSRLHS

SEQ ID NO: 25303 - protein, 9 aa, Artificial Sequence
  Description of Artificial Sequence: Synthetic peptide
  XENP021236 vlCDR3
QQGNTLPYT

SEQ ID NO: 25304 - protein, 223 aa, Artificial Sequence
  Description of Artificial Sequence: Synthetic polypeptide
  XENP021237 2A11_H1.10_L2_Fab Heavy Chain
EVQLVQSGAEVKKPGATVKISCKASGFNVKDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25305 - protein, 118 aa, Artificial Sequence
  Description of Artificial Sequence: Synthetic polypeptide
  VH of XENP021237
EVQLVQSGAEVKKPGATVKISCKASGFNVKDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25306 - protein, 5 aa, Artificial Sequence
  Description of Artificial Sequence: Synthetic peptide
  XENP021237 vhCDR1
DYYMH

SEQ ID NO: 25307 - protein, 17 aa, Artificial Sequence
  Description of Artificial Sequence: Synthetic peptide
  XENP021237 vhCDR2
WIDPENGDTEYAPKFQG

SEQ ID NO: 25308 - protein, 9 aa, Artificial Sequence
  Description of Artificial Sequence: Synthetic peptide
  XENP021237 vhCDR3
RGVRQALDY

SEQ ID NO: 25309 - protein, 214 aa, Artificial Sequence; identical to SEQ ID NO: 17250
  Description of Artificial Sequence: Synthetic polypeptide
  XENP021237 2A11_H1.10_L2_Fab Light Chain

SEQ ID NO: 25310 - protein, 107 aa, Artificial Sequence; identical to SEQ ID NO: 17251
  Description of Artificial Sequence: Synthetic polypeptide
  VL of XENP021237

SEQ ID NO: 25311 - protein, 11 aa, Artificial Sequence
  Description of Artificial Sequence: Synthetic peptide
  XENP021237 vlCDR1
QASQDIGNYLN

SEQ ID NO: 25312 - protein, 7 aa, Artificial Sequence
  Description of Artificial Sequence: Synthetic peptide
  XENP021237 vlCDR2
YTSRLHS

SEQ ID NO: 25313 - protein, 9 aa, Artificial Sequence
  Description of Artificial Sequence: Synthetic peptide
  XENP021237 vlCDR3
QQGNTLPYT

SEQ ID NO: 25314 - protein, 223 aa, Artificial Sequence
  Description of Artificial Sequence: Synthetic polypeptide
  XENP021238 2A11_H1.11_L2_Fab Heavy Chain
EVQLVQSGAEVKKPGATVKISCKASGFNIRDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25315 - protein, 118 aa, Artificial Sequence
  Description of Artificial Sequence: Synthetic polypeptide
  VH of XENP021238
EVQLVQSGAEVKKPGATVKISCKASGFNIRDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25316 - protein, 5 aa, Artificial Sequence
  Description of Artificial Sequence: Synthetic peptide
  XENP021238 vhCDR1
DYYMH

SEQ ID NO: 25317 - protein, 17 aa, Artificial Sequence
  Description of Artificial Sequence: Synthetic peptide
  XENP021238 vhCDR2
WIDPENGDTEYAPKFQG

SEQ ID NO: 25318 - protein, 9 aa, Artificial Sequence
  Description of Artificial Sequence: Synthetic peptide
  XENP021238 vhCDR3
RGVRQALDY

SEQ ID NO: 25319 - protein, 214 aa, Artificial Sequence; identical to SEQ ID NO: 17250
  Description of Artificial Sequence: Synthetic polypeptide
  XENP021238 2A11_H1.11_L2_Fab Light Chain

SEQ ID NO: 25320 - protein, 107 aa, Artificial Sequence; identical to SEQ ID NO: 17251
  Description of Artificial Sequence: Synthetic polypeptide
  VL of XENP021238

SEQ ID NO: 25321 - protein, 11 aa, Artificial Sequence
  Description of Artificial Sequence: Synthetic peptide
  XENP021238 vlCDR1
QASQDIGNYLN

SEQ ID NO: 25322 - protein, 7 aa, Artificial Sequence
  Description of Artificial Sequence: Synthetic peptide
  XENP021238 vlCDR2
YTSRLHS

SEQ ID NO: 25323 - protein, 9 aa, Artificial Sequence
  Description of Artificial Sequence: Synthetic peptide
  XENP021238 vlCDR3
QQGNTLPYT

SEQ ID NO: 25324 - protein, 223 aa, Artificial Sequence
  Description of Artificial Sequence: Synthetic polypeptide
  XENP021239 2A11_H1.12_L2_Fab Heavy Chain
EVQLVQSGAEVKKPGATVKISCKASGFNIEDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25325 - protein, 118 aa, Artificial Sequence
  Description of Artificial Sequence: Synthetic polypeptide
  VH of XENP021239
EVQLVQSGAEVKKPGATVKISCKASGFNIEDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25326 - protein, 5 aa, Artificial Sequence
  Description of Artificial Sequence: Synthetic peptide
  XENP021239 vhCDR1
DYYMH

SEQ ID NO: 25327 - protein, 17 aa, Artificial Sequence
  Description of Artificial Sequence: Synthetic peptide
  XENP021239 vhCDR2
WIDPENGDTEYAPKFQG

SEQ ID NO: 25328 - protein, 9 aa, Artificial Sequence
  Description of Artificial Sequence: Synthetic peptide
  XENP021239 vhCDR3
RGVRQALDY

SEQ ID NO: 25329 - protein, 214 aa, Artificial Sequence; identical to SEQ ID NO: 17250
  Description of Artificial Sequence: Synthetic polypeptide
  XENP021239 2A11_H1.12_L2_Fab Light Chain

SEQ ID NO: 25330 - protein, 107 aa, Artificial Sequence; identical to SEQ ID NO: 17251
  Description of Artificial Sequence: Synthetic polypeptide
  VL of XENP021239

SEQ ID NO: 25331 - protein, 11 aa, Artificial Sequence
  Description of Artificial Sequence: Synthetic peptide
  XENP021239 vlCDR1
QASQDIGNYLN

SEQ ID NO: 25332 - protein, 7 aa, Artificial Sequence
  Description of Artificial Sequence: Synthetic peptide
  XENP021239 vlCDR2
YTSRLHS

SEQ ID NO: 25333 - protein, 9 aa, Artificial Sequence
  Description of Artificial Sequence: Synthetic peptide
  XENP021239 vlCDR3
QQGNTLPYT

SEQ ID NO: 25334 - protein, 223 aa, Artificial Sequence
  Description of Artificial Sequence: Synthetic polypeptide
  XENP021240 2A11_H1.13_L2_Fab Heavy Chain
EVQLVQSGAEVKKPGATVKISCKASGFNIHDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25335 - protein, 118 aa, Artificial Sequence
  Description of Artificial Sequence: Synthetic polypeptide
  VH of XENP021240
EVQLVQSGAEVKKPGATVKISCKASGFNIHDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25336 - protein, 5 aa, Artificial Sequence
  Description of Artificial Sequence: Synthetic peptide
  XENP021240 vhCDR1
DYYMH

SEQ ID NO: 25337 - protein, 17 aa, Artificial Sequence
  Description of Artificial Sequence: Synthetic peptide
  XENP021240 vhCDR2
WIDPENGDTEYAPKFQG

SEQ ID NO: 25338 - protein, 9 aa, Artificial Sequence
  Description of Artificial Sequence: Synthetic peptide
  XENP021240 vhCDR3
RGVRQALDY

SEQ ID NO: 25339 - protein, 214 aa, Artificial Sequence; identical to SEQ ID NO: 17250
  Description of Artificial Sequence: Synthetic polypeptide
  XENP021240 2A11_H1.13_L2_Fab Light Chain

SEQ ID NO: 25340 - protein, 107 aa, Artificial Sequence; identical to SEQ ID NO: 17251
  Description of Artificial Sequence: Synthetic polypeptide
  VL of XENP021240

SEQ ID NO: 25341 - protein, 11 aa, Artificial Sequence
  Description of Artificial Sequence: Synthetic peptide
  XENP021240 vlCDR1
QASQDIGNYLN

SEQ ID NO: 25342 - protein, 7 aa, Artificial Sequence
  Description of Artificial Sequence: Synthetic peptide
  XENP021240 vlCDR2
YTSRLHS

SEQ ID NO: 25343 - protein, 9 aa, Artificial Sequence
  Description of Artificial Sequence: Synthetic peptide
  XENP021240 vlCDR3
QQGNTLPYT

SEQ ID NO: 25344 - protein, 223 aa, Artificial Sequence
  Description of Artificial Sequence: Synthetic polypeptide
  XENP021241 2A11_H1.14_L2_Fab Heavy Chain
EVQLVQSGAEVKKPGATVKISCKASGFNILDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25345 - protein, 118 aa, Artificial Sequence
  Description of Artificial Sequence: Synthetic polypeptide
  VH of XENP021241
EVQLVQSGAEVKKPGATVKISCKASGFNILDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25346 - protein, 5 aa, Artificial Sequence
  Description of Artificial Sequence: Synthetic peptide
  XENP021241 vhCDR1
DYYMH

SEQ ID NO: 25347 - protein, 17 aa, Artificial Sequence
  Description of Artificial Sequence: Synthetic peptide
  XENP021241 vhCDR2
WIDPENGDTEYAPKFQG

SEQ ID NO: 25348 - protein, 9 aa, Artificial Sequence
  Description of Artificial Sequence: Synthetic peptide
  XENP021241 vhCDR3
RGVRQALDY

SEQ ID NO: 25349 - protein, 214 aa, Artificial Sequence; identical to SEQ ID NO: 17250
  Description of Artificial Sequence: Synthetic polypeptide
  XENP021241 2A11_H1.14_L2_Fab Light Chain

SEQ ID NO: 25350 - protein, 107 aa, Artificial Sequence; identical to SEQ ID NO: 17251
  Description of Artificial Sequence: Synthetic polypeptide
  VL of XENP021241

SEQ ID NO: 25351 - protein, 11 aa, Artificial Sequence
  Description of Artificial Sequence: Synthetic peptide
  XENP021241 vlCDR1
QASQDIGNYLN

SEQ ID NO: 25352 - protein, 7 aa, Artificial Sequence
  Description of Artificial Sequence: Synthetic peptide
  XENP021241 vlCDR2
YTSRLHS

SEQ ID NO: 25353 - protein, 9 aa, Artificial Sequence
  Description of Artificial Sequence: Synthetic peptide
  XENP021241 vlCDR3
QQGNTLPYT

SEQ ID NO: 25354 - protein, 223 aa, Artificial Sequence
  Description of Artificial Sequence: Synthetic polypeptide
  XENP021242 2A11_H1.15_L2_Fab Heavy Chain
EVQLVQSGAEVKKPGATVKISCKASGFNIDDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25355 - protein, 118 aa, Artificial Sequence
  Description of Artificial Sequence: Synthetic polypeptide
  VH of XENP021242
EVQLVQSGAEVKKPGATVKISCKASGFNIDDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25356 - protein, 5 aa, Artificial Sequence
  Description of Artificial Sequence: Synthetic peptide
  XENP021242 vhCDR1
DYYMH

SEQ ID NO: 25357 - protein, 17 aa, Artificial Sequence
  Description of Artificial Sequence: Synthetic peptide
  XENP021242 vhCDR2
WIDPENGDTEYAPKFQG

SEQ ID NO: 25358 - protein, 9 aa, Artificial Sequence
  Description of Artificial Sequence: Synthetic peptide
  XENP021242 vhCDR3
RGVRQALDY

SEQ ID NO: 25359 - protein, 214 aa, Artificial Sequence; identical to SEQ ID NO: 17250
  Description of Artificial Sequence: Synthetic polypeptide
  XENP021242 2A11_H1.15_L2_Fab Light Chain

SEQ ID NO: 25360 - protein, 107 aa, Artificial Sequence; identical to SEQ ID NO: 17251
  Description of Artificial Sequence: Synthetic polypeptide
  VL of XENP021242

SEQ ID NO: 25361 - protein, 11 aa, Artificial Sequence
  Description of Artificial Sequence: Synthetic peptide
  XENP021242 vlCDR1
QASQDIGNYLN

SEQ ID NO: 25362 - protein, 7 aa, Artificial Sequence
  Description of Artificial Sequence: Synthetic peptide
  XENP021242 vlCDR2
YTSRLHS

SEQ ID NO: 25363 - protein, 9 aa, Artificial Sequence
  Description of Artificial Sequence: Synthetic peptide
  XENP021242 vlCDR3
QQGNTLPYT

SEQ ID NO: 25364 - protein, 223 aa, Artificial Sequence
  Description of Artificial Sequence: Synthetic polypeptide
  XENP021243 2A11_H1.16_L2_Fab Heavy Chain
EVQLVQSGAEVKKPGATVKISCKASGFNIADYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25365 - protein, 118 aa, Artificial Sequence
  Description of Artificial Sequence: Synthetic polypeptide
  VH of XENP021243
EVQLVQSGAEVKKPGATVKISCKASGFNIADYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25366 - protein, 5 aa, Artificial Sequence
  Description of Artificial Sequence: Synthetic peptide
  XENP021243 vhCDR1
DYYMH

SEQ ID NO: 25367 - protein, 17 aa, Artificial Sequence
  Description of Artificial Sequence: Synthetic peptide
  XENP021243 vhCDR2
WIDPENGDTEYAPKFQG

SEQ ID NO: 25368 - protein, 9 aa, Artificial Sequence
  Description of Artificial Sequence: Synthetic peptide
  XENP021243 vhCDR3
RGVRQALDY

SEQ ID NO: 25369 - protein, 214 aa, Artificial Sequence; identical to SEQ ID NO: 17250
  Description of Artificial Sequence: Synthetic polypeptide
  XENP021243 2A11_H1.16_L2_Fab Light Chain

SEQ ID NO: 25370 - protein, 107 aa, Artificial Sequence; identical to SEQ ID NO: 17251
  Description of Artificial Sequence: Synthetic polypeptide
  VL of XENP021243

SEQ ID NO: 25371 - protein, 11 aa, Artificial Sequence
  Description of Artificial Sequence: Synthetic peptide
  XENP021243 vlCDR1
QASQDIGNYLN

SEQ ID NO: 25372 - protein, 7 aa, Artificial Sequence
  Description of Artificial Sequence: Synthetic peptide
  XENP021243 vlCDR2
YTSRLHS

SEQ ID NO: 25373 - protein, 9 aa, Artificial Sequence
  Description of Artificial Sequence: Synthetic peptide
  XENP021243 vlCDR3
QQGNTLPYT

SEQ ID NO: 25374 - protein, 223 aa, Artificial Sequence
  Description of Artificial Sequence: Synthetic polypeptide
  XENP021244 2A11_H1.17_L2_Fab Heavy Chain
EVQLVQSGAEVKKPGATVKISCKASGFNIGDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25375 - protein, 118 aa, Artificial Sequence
  Description of Artificial Sequence: Synthetic polypeptide
  VH of XENP021244
EVQLVQSGAEVKKPGATVKISCKASGFNIGDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25376 - protein, 5 aa, Artificial Sequence
  Description of Artificial Sequence: Synthetic peptide
  XENP021244 vhCDR1
DYYMH

SEQ ID NO: 25377 - protein, 17 aa, Artificial Sequence
  Description of Artificial Sequence: Synthetic peptide
  XENP021244 vhCDR2
WIDPENGDTEYAPKFQG

SEQ ID NO: 25378 - protein, 9 aa, Artificial Sequence
  Description of Artificial Sequence: Synthetic peptide
  XENP021244 vhCDR3
RGVRQALDY

SEQ ID NO: 25379 - protein, 214 aa, Artificial Sequence; identical to SEQ ID NO: 17250
  Description of Artificial Sequence: Synthetic polypeptide
  XENP021244 2A11_H1.17_L2_Fab Light Chain

SEQ ID NO: 25380 - protein, 107 aa, Artificial Sequence; identical to SEQ ID NO: 17251
  Description of Artificial Sequence: Synthetic polypeptide
  VL of XENP021244

SEQ ID NO: 25381 - protein, 11 aa, Artificial Sequence
  Description of Artificial Sequence: Synthetic peptide
  XENP021244 vlCDR1
QASQDIGNYLN

SEQ ID NO: 25382 - protein, 7 aa, Artificial Sequence
  Description of Artificial Sequence: Synthetic peptide
  XENP021244 vlCDR2
YTSRLHS

SEQ ID NO: 25383 - protein, 9 aa, Artificial Sequence
  Description of Artificial Sequence: Synthetic peptide
  XENP021244 vlCDR3
QQGNTLPYT

SEQ ID NO: 25384 - protein, 223 aa, Artificial Sequence
  Description of Artificial Sequence: Synthetic polypeptide
  XENP021245 2A11_H1.18_L2_Fab Heavy Chain
EVQLVQSGAEVKKPGATVKISCKASGFNIYDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25385 - protein, 118 aa, Artificial Sequence
  Description of Artificial Sequence: Synthetic polypeptide
  VH of XENP021245
EVQLVQSGAEVKKPGATVKISCKASGFNIYDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25386 - protein, 5 aa, Artificial Sequence
  Description of Artificial Sequence: Synthetic peptide
  XENP021245 vhCDR1
DYYMH

SEQ ID NO: 25387 - protein, 17 aa, Artificial Sequence
  Description of Artificial Sequence: Synthetic peptide
  XENP021245 vhCDR2
WIDPENGDTEYAPKFQG

SEQ ID NO: 25388 - protein, 9 aa, Artificial Sequence
  Description of Artificial Sequence: Synthetic peptide
  XENP021245 vhCDR3
RGVRQALDY

SEQ ID NO: 25389 - protein, 214 aa, Artificial Sequence; identical to SEQ ID NO: 17250
  Description of Artificial Sequence: Synthetic polypeptide
  XENP021245 2A11_H1.18_L2_Fab Light Chain

SEQ ID NO: 25390 - protein, 107 aa, Artificial Sequence; identical to SEQ ID NO: 17251
  Description of Artificial Sequence: Synthetic polypeptide
  VL of XENP021245

SEQ ID NO: 25391 - protein, 11 aa, Artificial Sequence
  Description of Artificial Sequence: Synthetic peptide
  XENP021245 vlCDR1
QASQDIGNYLN

SEQ ID NO: 25392 - protein, 7 aa, Artificial Sequence
  Description of Artificial Sequence: Synthetic peptide
  XENP021245 vlCDR2
YTSRLHS

SEQ ID NO: 25393 - protein, 9 aa, Artificial Sequence
  Description of Artificial Sequence: Synthetic peptide
  XENP021245 vlCDR3
QQGNTLPYT

SEQ ID NO: 25394 - protein, 223 aa, Artificial Sequence
  Description of Artificial Sequence: Synthetic polypeptide
  XENP021246 2A11_H1.19_L2_Fab Heavy Chain
EVQLVQSGAEVKKPGATVKISCKASGFNIIDYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25395 - protein, 118 aa, Artificial Sequence
  Description of Artificial Sequence: Synthetic polypeptide
  VH of XENP021246
EVQLVQSGAEVKKPGATVKISCKASGFNIIDYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25396 - protein, 5 aa, Artificial Sequence
  Description of Artificial Sequence: Synthetic peptide
  XENP021246 vhCDR1
DYYMH

SEQ ID NO: 25397 - protein, 17 aa, Artificial Sequence
  Description of Artificial Sequence: Synthetic peptide
  XENP021246 vhCDR2
WIDPENGDTEYAPKFQG

SEQ ID NO: 25398 - protein, 9 aa, Artificial Sequence
  Description of Artificial Sequence: Synthetic peptide
  XENP021246 vhCDR3
RGVRQALDY

SEQ ID NO: 25399 - protein, 214 aa, Artificial Sequence; identical to SEQ ID NO: 17250
  Description of Artificial Sequence: Synthetic polypeptide
  XENP021246 2A11_H1.19_L2_Fab Light Chain

SEQ ID NO: 25400 - protein, 107 aa, Artificial Sequence; identical to SEQ ID NO: 17251
  Description of Artificial Sequence: Synthetic polypeptide
  VL of XENP021246

SEQ ID NO: 25401 - protein, 11 aa, Artificial Sequence
  Description of Artificial Sequence: Synthetic peptide
  XENP021246 vlCDR1
QASQDIGNYLN

SEQ ID NO: 25402 - protein, 7 aa, Artificial Sequence
  Description of Artificial Sequence: Synthetic peptide
  XENP021246 vlCDR2
YTSRLHS

SEQ ID NO: 25403 - protein, 9 aa, Artificial Sequence
  Description of Artificial Sequence: Synthetic peptide
  XENP021246 vlCDR3
QQGNTLPYT

SEQ ID NO: 25404 - protein, 223 aa, Artificial Sequence
  Description of Artificial Sequence: Synthetic polypeptide
  XENP021247 2A11_H1.20_L2_Fab Heavy Chain
EVQLVQSGAEVKKPGATVKISCKASGFNIKNYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25405 - protein, 118 aa, Artificial Sequence
  Description of Artificial Sequence: Synthetic polypeptide
  VH of XENP021247
EVQLVQSGAEVKKPGATVKISCKASGFNIKNYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25406 - protein, 5 aa, Artificial Sequence
  Description of Artificial Sequence: Synthetic peptide
  XENP021247 vhCDR1
NYYMH

SEQ ID NO: 25407 - protein, 17 aa, Artificial Sequence
  Description of Artificial Sequence: Synthetic peptide
  XENP021247 vhCDR2
WIDPENGDTEYAPKFQG

SEQ ID NO: 25408 - protein, 9 aa, Artificial Sequence
  Description of Artificial Sequence: Synthetic peptide
  XENP021247 vhCDR3
RGVRQALDY

SEQ ID NO: 25409 - protein, 214 aa, Artificial Sequence; identical to SEQ ID NO: 17250
  Description of Artificial Sequence: Synthetic polypeptide
  XENP021247 2A11_H1.20_L2_Fab Light Chain

SEQ ID NO: 25410 - protein, 107 aa, Artificial Sequence; identical to SEQ ID NO: 17251
  Description of Artificial Sequence: Synthetic polypeptide
  VL of XENP021247

SEQ ID NO: 25411 - protein, 11 aa, Artificial Sequence
  Description of Artificial Sequence: Synthetic peptide
  XENP021247 vlCDR1
QASQDIGNYLN

SEQ ID NO: 25412 - protein, 7 aa, Artificial Sequence
  Description of Artificial Sequence: Synthetic peptide
  XENP021247 vlCDR2
YTSRLHS

SEQ ID NO: 25413 - protein, 9 aa, Artificial Sequence
  Description of Artificial Sequence: Synthetic peptide
  XENP021247 vlCDR3
QQGNTLPYT

SEQ ID NO: 25414 - protein, 223 aa, Artificial Sequence
  Description of Artificial Sequence: Synthetic polypeptide
  XENP021248 2A11_H1.21_L2_Fab Heavy Chain
EVQLVQSGAEVKKPGATVKISCKASGFNIKEYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25415 - protein, 118 aa, Artificial Sequence
  Description of Artificial Sequence: Synthetic polypeptide
  VH of XENP021248
EVQLVQSGAEVKKPGATVKISCKASGFNIKEYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25416 - protein, 5 aa, Artificial Sequence
  Description of Artificial Sequence: Synthetic peptide
  XENP021248 vhCDR1
EYYMH

SEQ ID NO: 25417 - protein, 17 aa, Artificial Sequence
  Description of Artificial Sequence: Synthetic peptide
  XENP021248 vhCDR2
WIDPENGDTEYAPKFQG

SEQ ID NO: 25418 - protein, 9 aa, Artificial Sequence
  Description of Artificial Sequence: Synthetic peptide
  XENP021248 vhCDR3
RGVRQALDY

SEQ ID NO: 25419 - protein, 214 aa, Artificial Sequence; identical to SEQ ID NO: 17250
  Description of Artificial Sequence: Synthetic polypeptide
  XENP021248 2A11_H1.21_L2_Fab Light Chain

SEQ ID NO: 25420 - protein, 107 aa, Artificial Sequence; identical to SEQ ID NO: 17251
  Description of Artificial Sequence: Synthetic polypeptide
  VL of XENP021248

SEQ ID NO: 25421 - protein, 11 aa, Artificial Sequence
  Description of Artificial Sequence: Synthetic peptide
  XENP021248 vlCDR1
QASQDIGNYLN

SEQ ID NO: 25422 - protein, 7 aa, Artificial Sequence
  Description of Artificial Sequence: Synthetic peptide
  XENP021248 vlCDR2
YTSRLHS

SEQ ID NO: 25423 - protein, 9 aa, Artificial Sequence
  Description of Artificial Sequence: Synthetic peptide
  XENP021248 vlCDR3
QQGNTLPYT

SEQ ID NO: 25424 - protein, 223 aa, Artificial Sequence
  Description of Artificial Sequence: Synthetic polypeptide
  XENP021249 2A11_H1.22_L2_Fab Heavy Chain
EVQLVQSGAEVKKPGATVKISCKASGFNIKHYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25425 - protein, 118 aa, Artificial Sequence
  Description of Artificial Sequence: Synthetic polypeptide
  VH of XENP021249
EVQLVQSGAEVKKPGATVKISCKASGFNIKHYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25426 - protein, 5 aa, Artificial Sequence
  Description of Artificial Sequence: Synthetic peptide
  XENP021249 vhCDR1
HYYMH

SEQ ID NO: 25427 - protein, 17 aa, Artificial Sequence
  Description of Artificial Sequence: Synthetic peptide
  XENP021249 vhCDR2
WIDPENGDTEYAPKFQG

SEQ ID NO: 25428 - protein, 9 aa, Artificial Sequence
  Description of Artificial Sequence: Synthetic peptide
  XENP021249 vhCDR3
RGVRQALDY

SEQ ID NO: 25429 - protein, 214 aa, Artificial Sequence; identical to SEQ ID NO: 17250
  Description of Artificial Sequence: Synthetic polypeptide
  XENP021249 2A11_H1.22_L2_Fab Light Chain

SEQ ID NO: 25430 - protein, 107 aa, Artificial Sequence; identical to SEQ ID NO: 17251
  Description of Artificial Sequence: Synthetic polypeptide
  VL of XENP021249

SEQ ID NO: 25431 - protein, 11 aa, Artificial Sequence
  Description of Artificial Sequence: Synthetic peptide
  XENP021249 vlCDR1
QASQDIGNYLN

SEQ ID NO: 25432 - protein, 7 aa, Artificial Sequence
  Description of Artificial Sequence: Synthetic peptide
  XENP021249 vlCDR2
YTSRLHS

SEQ ID NO: 25433 - protein, 9 aa, Artificial Sequence
  Description of Artificial Sequence: Synthetic peptide
  XENP021249 vlCDR3
QQGNTLPYT

SEQ ID NO: 25434 - protein, 223 aa, Artificial Sequence
  Description of Artificial Sequence: Synthetic polypeptide
  XENP021250 2A11_H1.23_L2_Fab Heavy Chain
EVQLVQSGAEVKKPGATVKISCKASGFNIKSYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25435 - protein, 118 aa, Artificial Sequence
  Description of Artificial Sequence: Synthetic polypeptide
  VH of XENP021250
EVQLVQSGAEVKKPGATVKISCKASGFNIKSYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25436 - protein, 5 aa, Artificial Sequence
  Description of Artificial Sequence: Synthetic peptide
  XENP021250 vhCDR1
SYYMH

SEQ ID NO: 25437 - protein, 17 aa, Artificial Sequence
  Description of Artificial Sequence: Synthetic peptide
  XENP021250 vhCDR2
WIDPENGDTEYAPKFQG

SEQ ID NO: 25438 - protein, 9 aa, Artificial Sequence
  Description of Artificial Sequence: Synthetic peptide
  XENP021250 vhCDR3
RGVRQALDY

SEQ ID NO: 25439 - protein, 214 aa, Artificial Sequence; identical to SEQ ID NO: 17250
  Description of Artificial Sequence: Synthetic polypeptide
  XENP021250 2A11_H1.23_L2_Fab Light Chain

SEQ ID NO: 25440 - protein, 107 aa, Artificial Sequence; identical to SEQ ID NO: 17251
  Description of Artificial Sequence: Synthetic polypeptide
  VL of XENP021250

SEQ ID NO: 25441 - protein, 11 aa, Artificial Sequence
  Description of Artificial Sequence: Synthetic peptide
  XENP021250 vlCDR1
QASQDIGNYLN

SEQ ID NO: 25442 - protein, 7 aa, Artificial Sequence
  Description of Artificial Sequence: Synthetic peptide
  XENP021250 vlCDR2
YTSRLHS

SEQ ID NO: 25443 - protein, 9 aa, Artificial Sequence
  Description of Artificial Sequence: Synthetic peptide
  XENP021250 vlCDR3
QQGNTLPYT

SEQ ID NO: 25444 - protein, 223 aa, Artificial Sequence
  Description of Artificial Sequence: Synthetic polypeptide
  XENP021251 2A11_H1.24_L2_Fab Heavy Chain
EVQLVQSGAEVKKPGATVKISCKASGFNIKKYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25445 - protein, 118 aa, Artificial Sequence
  Description of Artificial Sequence: Synthetic polypeptide
  VH of XENP021251
EVQLVQSGAEVKKPGATVKISCKASGFNIKKYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25446 - protein, 5 aa, Artificial Sequence
  Description of Artificial Sequence: Synthetic peptide
  XENP021251 vhCDR1
KYYMH

SEQ ID NO: 25447 - protein, 17 aa, Artificial Sequence
  Description of Artificial Sequence: Synthetic peptide
  XENP021251 vhCDR2
WIDPENGDTEYAPKFQG

SEQ ID NO: 25448 - protein, 9 aa, Artificial Sequence
  Description of Artificial Sequence: Synthetic peptide
  XENP021251 vhCDR3
RGVRQALDY

SEQ ID NO: 25449 - protein, 214 aa, Artificial Sequence; identical to SEQ ID NO: 17250
  Description of Artificial Sequence: Synthetic polypeptide
  XENP021251 2A11_H1.24_L2_Fab Light Chain

SEQ ID NO: 25450 - protein, 107 aa, Artificial Sequence; identical to SEQ ID NO: 17251
  Description of Artificial Sequence: Synthetic polypeptide
  VL of XENP021251

SEQ ID NO: 25451 - protein, 11 aa, Artificial Sequence
  Description of Artificial Sequence: Synthetic peptide
  XENP021251 vlCDR1
QASQDIGNYLN

SEQ ID NO: 25452 - protein, 7 aa, Artificial Sequence
  Description of Artificial Sequence: Synthetic peptide
  XENP021251 vlCDR2
YTSRLHS

SEQ ID NO: 25453 - protein, 9 aa, Artificial Sequence
  Description of Artificial Sequence: Synthetic peptide
  XENP021251 vlCDR3
QQGNTLPYT

SEQ ID NO: 25454 - protein, 223 aa, Artificial Sequence
  Description of Artificial Sequence: Synthetic polypeptide
  XENP021252 2A11_H1.25_L2_Fab Heavy Chain
EVQLVQSGAEVKKPGATVKISCKASGFNIKLYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25455 - protein, 118 aa, Artificial Sequence
  Description of Artificial Sequence: Synthetic polypeptide
  VH of XENP021252
EVQLVQSGAEVKKPGATVKISCKASGFNIKLYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25456 - protein, 5 aa, Artificial Sequence
  Description of Artificial Sequence: Synthetic peptide
  XENP021252 vhCDR1
LYYMH

SEQ ID NO: 25457 - protein, 17 aa, Artificial Sequence
  Description of Artificial Sequence: Synthetic peptide
  XENP021252 vhCDR2
WIDPENGDTEYAPKFQG

SEQ ID NO: 25458 - protein, 9 aa, Artificial Sequence
  Description of Artificial Sequence: Synthetic peptide
  XENP021252 vhCDR3
RGVRQALDY

SEQ ID NO: 25459 - protein, 214 aa, Artificial Sequence; identical to SEQ ID NO: 17250
  Description of Artificial Sequence: Synthetic polypeptide
  XENP021252 2A11_H1.25_L2_Fab Light Chain

SEQ ID NO: 25460 - protein, 107 aa, Artificial Sequence; identical to SEQ ID NO: 17251
  Description of Artificial Sequence: Synthetic polypeptide
  VL of XENP021252

SEQ ID NO: 25461 - protein, 11 aa, Artificial Sequence
  Description of Artificial Sequence: Synthetic peptide
  XENP021252 vlCDR1
QASQDIGNYLN

SEQ ID NO: 25462 - protein, 7 aa, Artificial Sequence
  Description of Artificial Sequence: Synthetic peptide
  XENP021252 vlCDR2
YTSRLHS

SEQ ID NO: 25463 - protein, 9 aa, Artificial Sequence
  Description of Artificial Sequence: Synthetic peptide
  XENP021252 vlCDR3
QQGNTLPYT

SEQ ID NO: 25464 - protein, 223 aa, Artificial Sequence
  Description of Artificial Sequence: Synthetic polypeptide
  XENP021253 2A11_H1.26_L2_Fab Heavy Chain
EVQLVQSGAEVKKPGATVKISCKASGFNIKTYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25465 - protein, 118 aa, Artificial Sequence
  Description of Artificial Sequence: Synthetic polypeptide
  VH of XENP021253
EVQLVQSGAEVKKPGATVKISCKASGFNIKTYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25466 - protein, 5 aa, Artificial Sequence
  Description of Artificial Sequence: Synthetic peptide
  XENP021253 vhCDR1
TYYMH

SEQ ID NO: 25467 - protein, 17 aa, Artificial Sequence
  Description of Artificial Sequence: Synthetic peptide
  XENP021253 vhCDR2
WIDPENGDTEYAPKFQG

SEQ ID NO: 25468 - protein, 9 aa, Artificial Sequence
  Description of Artificial Sequence: Synthetic peptide
  XENP021253 vhCDR3
RGVRQALDY

SEQ ID NO: 25469 - protein, 214 aa, Artificial Sequence; identical to SEQ ID NO: 17250
  Description of Artificial Sequence: Synthetic polypeptide
  XENP021253 2A11_H1.26_L2_Fab Light Chain

SEQ ID NO: 25470 - protein, 107 aa, Artificial Sequence; identical to SEQ ID NO: 17251
  Description of Artificial Sequence: Synthetic polypeptide
  VL of XENP021253

SEQ ID NO: 25471 - protein, 11 aa, Artificial Sequence
  Description of Artificial Sequence: Synthetic peptide
  XENP021253 vlCDR1
QASQDIGNYLN

SEQ ID NO: 25472 - protein, 7 aa, Artificial Sequence
  Description of Artificial Sequence: Synthetic peptide
  XENP021253 vlCDR2
YTSRLHS

SEQ ID NO: 25473 - protein, 9 aa, Artificial Sequence
  Description of Artificial Sequence: Synthetic peptide
  XENP021253 vlCDR3
QQGNTLPYT

SEQ ID NO: 25474 - protein, 223 aa, Artificial Sequence
  Description of Artificial Sequence: Synthetic polypeptide
  XENP021254 2A11_H1.27_L2_Fab Heavy Chain
EVQLVQSGAEVKKPGATVKISCKASGFNIKQYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25475 - protein, 118 aa, Artificial Sequence
  Description of Artificial Sequence: Synthetic polypeptide
  VH of XENP021254
EVQLVQSGAEVKKPGATVKISCKASGFNIKQYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25476 - protein, 5 aa, Artificial Sequence
  Description of Artificial Sequence: Synthetic peptide
  XENP021254 vhCDR1
QYYMH

SEQ ID NO: 25477 - protein, 17 aa, Artificial Sequence
  Description of Artificial Sequence: Synthetic peptide
  XENP021254 vhCDR2
WIDPENGDTEYAPKFQG

SEQ ID NO: 25478 - protein, 9 aa, Artificial Sequence
  Description of Artificial Sequence: Synthetic peptide
  XENP021254 vhCDR3
RGVRQALDY

SEQ ID NO: 25479 - protein, 214 aa, Artificial Sequence; identical to SEQ ID NO: 17250
  Description of Artificial Sequence: Synthetic polypeptide
  XENP021254 2A11_H1.27_L2_Fab Light Chain

SEQ ID NO: 25480 - protein, 107 aa, Artificial Sequence; identical to SEQ ID NO: 17251
  Description of Artificial Sequence: Synthetic polypeptide
  VL of XENP021254

SEQ ID NO: 25481 - protein, 11 aa, Artificial Sequence
  Description of Artificial Sequence: Synthetic peptide
  XENP021254 vlCDR1
QASQDIGNYLN

SEQ ID NO: 25482 - protein, 7 aa, Artificial Sequence
  Description of Artificial Sequence: Synthetic peptide
  XENP021254 vlCDR2
YTSRLHS

SEQ ID NO: 25483 - protein, 9 aa, Artificial Sequence
  Description of Artificial Sequence: Synthetic peptide
  XENP021254 vlCDR3
QQGNTLPYT

SEQ ID NO: 25484 - protein, 223 aa, Artificial Sequence
  Description of Artificial Sequence: Synthetic polypeptide
  XENP021255 2A11_H1.28_L2_Fab Heavy Chain
EVQLVQSGAEVKKPGATVKISCKASGFNIKFYYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25485 - protein, 118 aa, Artificial Sequence
  Description of Artificial Sequence: Synthetic polypeptide
  VH of XENP021255
EVQLVQSGAEVKKPGATVKISCKASGFNIKFYYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25486 - protein, 5 aa, Artificial Sequence
  Description of Artificial Sequence: Synthetic peptide
  XENP021255 vhCDR1
FYYMH

SEQ ID NO: 25487 - protein, 17 aa, Artificial Sequence
  Description of Artificial Sequence: Synthetic peptide
  XENP021255 vhCDR2
WIDPENGDTEYAPKFQG

SEQ ID NO: 25488 - protein, 9 aa, Artificial Sequence
  Description of Artificial Sequence: Synthetic peptide
  XENP021255 vhCDR3
RGVRQALDY

SEQ ID NO: 25489 - protein, 214 aa, Artificial Sequence; identical to SEQ ID NO: 17250
  Description of Artificial Sequence: Synthetic polypeptide
  XENP021255 2A11_H1.28_L2_Fab Light Chain

SEQ ID NO: 25490 - protein, 107 aa, Artificial Sequence; identical to SEQ ID NO: 17251
  Description of Artificial Sequence: Synthetic polypeptide
  VL of XENP021255

SEQ ID NO: 25491 - protein, 11 aa, Artificial Sequence
  Description of Artificial Sequence: Synthetic peptide
  XENP021255 vlCDR1
QASQDIGNYLN

SEQ ID NO: 25492 - protein, 7 aa, Artificial Sequence
  Description of Artificial Sequence: Synthetic peptide
  XENP021255 vlCDR2
YTSRLHS

SEQ ID NO: 25493 - protein, 9 aa, Artificial Sequence
  Description of Artificial Sequence: Synthetic peptide
  XENP021255 vlCDR3
QQGNTLPYT

SEQ ID NO: 25494 - protein, 223 aa, Artificial Sequence
  Description of Artificial Sequence: Synthetic polypeptide
  XENP021256 2A11_H1.29_L2_Fab Heavy Chain
EVQLVQSGAEVKKPGATVKISCKASGFNIKDFYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25495 - protein, 118 aa, Artificial Sequence
  Description of Artificial Sequence: Synthetic polypeptide
  VH of XENP021256
EVQLVQSGAEVKKPGATVKISCKASGFNIKDFYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25496 - protein, 5 aa, Artificial Sequence
  Description of Artificial Sequence: Synthetic peptide
  XENP021256 vhCDR1
DFYMH

SEQ ID NO: 25497 - protein, 17 aa, Artificial Sequence
  Description of Artificial Sequence: Synthetic peptide
  XENP021256 vhCDR2
WIDPENGDTEYAPKFQG

SEQ ID NO: 25498 - protein, 9 aa, Artificial Sequence
  Description of Artificial Sequence: Synthetic peptide
  XENP021256 vhCDR3
RGVRQALDY

SEQ ID NO: 25499 - protein, 214 aa, Artificial Sequence; identical to SEQ ID NO: 17250
  Description of Artificial Sequence: Synthetic polypeptide
  XENP021256 2A11_H1.29_L2_Fab Light Chain

SEQ ID NO: 25500 - protein, 107 aa, Artificial Sequence; identical to SEQ ID NO: 17251
  Description of Artificial Sequence: Synthetic polypeptide
  VL of XENP021256

SEQ ID NO: 25501 - protein, 11 aa, Artificial Sequence
  Description of Artificial Sequence: Synthetic peptide
  XENP021256 vlCDR1
QASQDIGNYLN

SEQ ID NO: 25502 - protein, 7 aa, Artificial Sequence
  Description of Artificial Sequence: Synthetic peptide
  XENP021256 vlCDR2
YTSRLHS

SEQ ID NO: 25503 - protein, 9 aa, Artificial Sequence
  Description of Artificial Sequence: Synthetic peptide
  XENP021256 vlCDR3
QQGNTLPYT

SEQ ID NO: 25504 - protein, 223 aa, Artificial Sequence
  Description of Artificial Sequence: Synthetic polypeptide
  XENP021257 2A11_H1.30_L2_Fab Heavy Chain
EVQLVQSGAEVKKPGATVKISCKASGFNIKDHYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25505 - protein, 118 aa, Artificial Sequence
  Description of Artificial Sequence: Synthetic polypeptide
  VH of XENP021257
EVQLVQSGAEVKKPGATVKISCKASGFNIKDHYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25506 - protein, 5 aa, Artificial Sequence
  Description of Artificial Sequence: Synthetic peptide
  XENP021257 vhCDR1
DHYMH

SEQ ID NO: 25507 - protein, 17 aa, Artificial Sequence
  Description of Artificial Sequence: Synthetic peptide
  XENP021257 vhCDR2
WIDPENGDTEYAPKFQG

SEQ ID NO: 25508 - protein, 9 aa, Artificial Sequence
  Description of Artificial Sequence: Synthetic peptide
  XENP021257 vhCDR3
RGVRQALDY

SEQ ID NO: 25509 - protein, 214 aa, Artificial Sequence; identical to SEQ ID NO: 17250
  Description of Artificial Sequence: Synthetic polypeptide
  XENP021257 2A11_H1.30_L2_Fab Light Chain

SEQ ID NO: 25510 - protein, 107 aa, Artificial Sequence; identical to SEQ ID NO: 17251
  Description of Artificial Sequence: Synthetic polypeptide
  VL of XENP021257

SEQ ID NO: 25511 - protein, 11 aa, Artificial Sequence
  Description of Artificial Sequence: Synthetic peptide
  XENP021257 vlCDR1
QASQDIGNYLN

SEQ ID NO: 25512 - protein, 7 aa, Artificial Sequence
  Description of Artificial Sequence: Synthetic peptide
  XENP021257 vlCDR2
YTSRLHS

SEQ ID NO: 25513 - protein, 9 aa, Artificial Sequence
  Description of Artificial Sequence: Synthetic peptide
  XENP021257 vlCDR3
QQGNTLPYT

SEQ ID NO: 25514 - protein, 223 aa, Artificial Sequence
  Description of Artificial Sequence: Synthetic polypeptide
  XENP021258 2A11_H1.31_L2_Fab Heavy Chain
EVQLVQSGAEVKKPGATVKISCKASGFNIKDLYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25515 - protein, 118 aa, Artificial Sequence
  Description of Artificial Sequence: Synthetic polypeptide
  VH of XENP021258
EVQLVQSGAEVKKPGATVKISCKASGFNIKDLYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25516 - protein, 5 aa, Artificial Sequence
  Description of Artificial Sequence: Synthetic peptide
  XENP021258 vhCDR1
DLYMH

SEQ ID NO: 25517 - protein, 17 aa, Artificial Sequence
  Description of Artificial Sequence: Synthetic peptide
  XENP021258 vhCDR2
WIDPENGDTEYAPKFQG

SEQ ID NO: 25518 - protein, 9 aa, Artificial Sequence
  Description of Artificial Sequence: Synthetic peptide
  XENP021258 vhCDR3
RGVRQALDY

SEQ ID NO: 25519 - protein, 214 aa, Artificial Sequence; identical to SEQ ID NO: 17250
  Description of Artificial Sequence: Synthetic polypeptide
  XENP021258 2A11_H1.31_L2_Fab Light Chain

SEQ ID NO: 25520 - protein, 107 aa, Artificial Sequence; identical to SEQ ID NO: 17251
  Description of Artificial Sequence: Synthetic polypeptide
  VL of XENP021258

SEQ ID NO: 25521 - protein, 11 aa, Artificial Sequence
  Description of Artificial Sequence: Synthetic peptide
  XENP021258 vlCDR1
QASQDIGNYLN

SEQ ID NO: 25522 - protein, 7 aa, Artificial Sequence
  Description of Artificial Sequence: Synthetic peptide
  XENP021258 vlCDR2
YTSRLHS

SEQ ID NO: 25523 - protein, 9 aa, Artificial Sequence
  Description of Artificial Sequence: Synthetic peptide
  XENP021258 vlCDR3
QQGNTLPYT

SEQ ID NO: 25524 - protein, 223 aa, Artificial Sequence
  Description of Artificial Sequence: Synthetic polypeptide
  XENP021259 2A11_H1.32_L2_Fab Heavy Chain
EVQLVQSGAEVKKPGATVKISCKASGFNIKDVYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25525 - protein, 118 aa, Artificial Sequence
  Description of Artificial Sequence: Synthetic polypeptide
  VH of XENP021259
EVQLVQSGAEVKKPGATVKISCKASGFNIKDVYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25526 - protein, 5 aa, Artificial Sequence
  Description of Artificial Sequence: Synthetic peptide
  XENP021259 vhCDR1
DVYMH

SEQ ID NO: 25527 - protein, 17 aa, Artificial Sequence
  Description of Artificial Sequence: Synthetic peptide
  XENP021259 vhCDR2
WIDPENGDTEYAPKFQG

SEQ ID NO: 25528 - protein, 9 aa, Artificial Sequence
  Description of Artificial Sequence: Synthetic peptide
  XENP021259 vhCDR3
RGVRQALDY

SEQ ID NO: 25529 - protein, 214 aa, Artificial Sequence; identical to SEQ ID NO: 17250
  Description of Artificial Sequence: Synthetic polypeptide
  XENP021259 2A11_H1.32_L2_Fab Light Chain

SEQ ID NO: 25530 - protein, 107 aa, Artificial Sequence; identical to SEQ ID NO: 17251
  Description of Artificial Sequence: Synthetic polypeptide
  VL of XENP021259

SEQ ID NO: 25531 - protein, 11 aa, Artificial Sequence
  Description of Artificial Sequence: Synthetic peptide
  XENP021259 vlCDR1
QASQDIGNYLN

SEQ ID NO: 25532 - protein, 7 aa, Artificial Sequence
  Description of Artificial Sequence: Synthetic peptide
  XENP021259 vlCDR2
YTSRLHS

SEQ ID NO: 25533 - protein, 9 aa, Artificial Sequence
  Description of Artificial Sequence: Synthetic peptide
  XENP021259 vlCDR3
QQGNTLPYT

SEQ ID NO: 25534 - protein, 223 aa, Artificial Sequence
  Description of Artificial Sequence: Synthetic polypeptide
  XENP021260 2A11_H1.33_L2_Fab Heavy Chain
EVQLVQSGAEVKKPGATVKISCKASGFNIKDAYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25535 - protein, 118 aa, Artificial Sequence
  Description of Artificial Sequence: Synthetic polypeptide
  VH of XENP021260
EVQLVQSGAEVKKPGATVKISCKASGFNIKDAYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25536 - protein, 5 aa, Artificial Sequence
  Description of Artificial Sequence: Synthetic peptide
  XENP021260 vhCDR1
DAYMH

SEQ ID NO: 25537 - protein, 17 aa, Artificial Sequence
  Description of Artificial Sequence: Synthetic peptide
  XENP021260 vhCDR2
WIDPENGDTEYAPKFQG

SEQ ID NO: 25538 - protein, 9 aa, Artificial Sequence
  Description of Artificial Sequence: Synthetic peptide
  XENP021260 vhCDR3
RGVRQALDY

SEQ ID NO: 25539 - protein, 214 aa, Artificial Sequence; identical to SEQ ID NO: 17250
  Description of Artificial Sequence: Synthetic polypeptide
  XENP021260 2A11_H1.33_L2_Fab Light Chain

SEQ ID NO: 25540 - protein, 107 aa, Artificial Sequence; identical to SEQ ID NO: 17251
  Description of Artificial Sequence: Synthetic polypeptide
  VL of XENP021260

SEQ ID NO: 25541 - protein, 11 aa, Artificial Sequence
  Description of Artificial Sequence: Synthetic peptide
  XENP021260 vlCDR1
QASQDIGNYLN

SEQ ID NO: 25542 - protein, 7 aa, Artificial Sequence
  Description of Artificial Sequence: Synthetic peptide
  XENP021260 vlCDR2
YTSRLHS

SEQ ID NO: 25543 - protein, 9 aa, Artificial Sequence
  Description of Artificial Sequence: Synthetic peptide
  XENP021260 vlCDR3
QQGNTLPYT

SEQ ID NO: 25544 - protein, 223 aa, Artificial Sequence
  Description of Artificial Sequence: Synthetic polypeptide
  XENP021261 2A11_H1.34_L2_Fab Heavy Chain
EVQLVQSGAEVKKPGATVKISCKASGFNIKDQYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25545 - protein, 118 aa, Artificial Sequence
  Description of Artificial Sequence: Synthetic polypeptide
  VH of XENP021261
EVQLVQSGAEVKKPGATVKISCKASGFNIKDQYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25546 - protein, 5 aa, Artificial Sequence
  Description of Artificial Sequence: Synthetic peptide
  XENP021261 vhCDR1
DQYMH

SEQ ID NO: 25547 - protein, 17 aa, Artificial Sequence
  Description of Artificial Sequence: Synthetic peptide
  XENP021261 vhCDR2
WIDPENGDTEYAPKFQG

SEQ ID NO: 25548 - protein, 9 aa, Artificial Sequence
  Description of Artificial Sequence: Synthetic peptide
  XENP021261 vhCDR3
RGVRQALDY

SEQ ID NO: 25549 - protein, 214 aa, Artificial Sequence; identical to SEQ ID NO: 17250
  Description of Artificial Sequence: Synthetic polypeptide
  XENP021261 2A11_H1.34_L2_Fab Light Chain

SEQ ID NO: 25550 - protein, 107 aa, Artificial Sequence; identical to SEQ ID NO: 17251
  Description of Artificial Sequence: Synthetic polypeptide
  VL of XENP021261

SEQ ID NO: 25551 - protein, 11 aa, Artificial Sequence
  Description of Artificial Sequence: Synthetic peptide
  XENP021261 vlCDR1
QASQDIGNYLN

SEQ ID NO: 25552 - protein, 7 aa, Artificial Sequence
  Description of Artificial Sequence: Synthetic peptide
  XENP021261 vlCDR2
YTSRLHS

SEQ ID NO: 25553 - protein, 9 aa, Artificial Sequence
  Description of Artificial Sequence: Synthetic peptide
  XENP021261 vlCDR3
QQGNTLPYT

SEQ ID NO: 25554 - protein, 223 aa, Artificial Sequence
  Description of Artificial Sequence: Synthetic polypeptide
  XENP021262 2A11_H1.35_L2_Fab Heavy Chain
EVQLVQSGAEVKKPGATVKISCKASGFNIKDEYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25555 - protein, 118 aa, Artificial Sequence
  Description of Artificial Sequence: Synthetic polypeptide
  VH of XENP021262
EVQLVQSGAEVKKPGATVKISCKASGFNIKDEYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25556 - protein, 5 aa, Artificial Sequence
  Description of Artificial Sequence: Synthetic peptide
  XENP021262 vhCDR1
DEYMH

SEQ ID NO: 25557 - protein, 17 aa, Artificial Sequence
  Description of Artificial Sequence: Synthetic peptide
  XENP021262 vhCDR2
WIDPENGDTEYAPKFQG

SEQ ID NO: 25558 - protein, 9 aa, Artificial Sequence
  Description of Artificial Sequence: Synthetic peptide
  XENP021262 vhCDR3
RGVRQALDY

SEQ ID NO: 25559 - protein, 214 aa, Artificial Sequence; identical to SEQ ID NO: 17250
  Description of Artificial Sequence: Synthetic polypeptide
  XENP021262 2A11_H1.35_L2_Fab Light Chain

SEQ ID NO: 25560 - protein, 107 aa, Artificial Sequence; identical to SEQ ID NO: 17251
  Description of Artificial Sequence: Synthetic polypeptide
  VL of XENP021262

SEQ ID NO: 25561 - protein, 11 aa, Artificial Sequence
  Description of Artificial Sequence: Synthetic peptide
  XENP021262 vlCDR1
QASQDIGNYLN

SEQ ID NO: 25562 - protein, 7 aa, Artificial Sequence
  Description of Artificial Sequence: Synthetic peptide
  XENP021262 vlCDR2
YTSRLHS

SEQ ID NO: 25563 - protein, 9 aa, Artificial Sequence
  Description of Artificial Sequence: Synthetic peptide
  XENP021262 vlCDR3
QQGNTLPYT

SEQ ID NO: 25564 - protein, 223 aa, Artificial Sequence
  Description of Artificial Sequence: Synthetic polypeptide
  XENP021263 2A11_H1.36_L2_Fab Heavy Chain
EVQLVQSGAEVKKPGATVKISCKASGFNIKDKYMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25565 - protein, 118 aa, Artificial Sequence
  Description of Artificial Sequence: Synthetic polypeptide
  VH of XENP021263
EVQLVQSGAEVKKPGATVKISCKASGFNIKDKYMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25566 - protein, 5 aa, Artificial Sequence
  Description of Artificial Sequence: Synthetic peptide
  XENP021263 vhCDR1
DKYMH

SEQ ID NO: 25567 - protein, 17 aa, Artificial Sequence
  Description of Artificial Sequence: Synthetic peptide
  XENP021263 vhCDR2
WIDPENGDTEYAPKFQG

SEQ ID NO: 25568 - protein, 9 aa, Artificial Sequence
  Description of Artificial Sequence: Synthetic peptide
  XENP021263 vhCDR3
RGVRQALDY

SEQ ID NO: 25569 - protein, 214 aa, Artificial Sequence; identical to SEQ ID NO: 17250
  Description of Artificial Sequence: Synthetic polypeptide
  XENP021263 2A11_H1.36_L2_Fab Light Chain

SEQ ID NO: 25570 - protein, 107 aa, Artificial Sequence; identical to SEQ ID NO: 17251
  Description of Artificial Sequence: Synthetic polypeptide
  VL of XENP021263

SEQ ID NO: 25571 - protein, 11 aa, Artificial Sequence
  Description of Artificial Sequence: Synthetic peptide
  XENP021263 vlCDR1
QASQDIGNYLN

SEQ ID NO: 25572 - protein, 7 aa, Artificial Sequence
  Description of Artificial Sequence: Synthetic peptide
  XENP021263 vlCDR2
YTSRLHS

SEQ ID NO: 25573 - protein, 9 aa, Artificial Sequence
  Description of Artificial Sequence: Synthetic peptide
  XENP021263 vlCDR3
QQGNTLPYT

SEQ ID NO: 25574 - protein, 223 aa, Artificial Sequence
  Description of Artificial Sequence: Synthetic polypeptide
  XENP021264 2A11_H1.37_L2_Fab Heavy Chain
EVQLVQSGAEVKKPGATVKISCKASGFNIKDYFMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25575 - protein, 118 aa, Artificial Sequence
  Description of Artificial Sequence: Synthetic polypeptide
  VH of XENP021264
EVQLVQSGAEVKKPGATVKISCKASGFNIKDYFMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25576 - protein, 5 aa, Artificial Sequence
  Description of Artificial Sequence: Synthetic peptide
  XENP021264 vhCDR1
DYFMH

SEQ ID NO: 25577 - protein, 17 aa, Artificial Sequence
  Description of Artificial Sequence: Synthetic peptide
  XENP021264 vhCDR2
WIDPENGDTEYAPKFQG

SEQ ID NO: 25578 - protein, 9 aa, Artificial Sequence
  Description of Artificial Sequence: Synthetic peptide
  XENP021264 vhCDR3
RGVRQALDY

SEQ ID NO: 25579 - protein, 214 aa, Artificial Sequence; identical to SEQ ID NO: 17250
  Description of Artificial Sequence: Synthetic polypeptide
  XENP021264 2A11_H1.37_L2_Fab Light Chain

SEQ ID NO: 25580 - protein, 107 aa, Artificial Sequence; identical to SEQ ID NO: 17251
  Description of Artificial Sequence: Synthetic polypeptide
  VL of XENP021264

SEQ ID NO: 25581 - protein, 11 aa, Artificial Sequence
  Description of Artificial Sequence: Synthetic peptide
  XENP021264 vlCDR1
QASQDIGNYLN

SEQ ID NO: 25582 - protein, 7 aa, Artificial Sequence
  Description of Artificial Sequence: Synthetic peptide
  XENP021264 vlCDR2
YTSRLHS

SEQ ID NO: 25583 - protein, 9 aa, Artificial Sequence
  Description of Artificial Sequence: Synthetic peptide
  XENP021264 vlCDR3
QQGNTLPYT

SEQ ID NO: 25584 - protein, 223 aa, Artificial Sequence
  Description of Artificial Sequence: Synthetic polypeptide
  XENP021265 2A11_H1.38_L2_Fab Heavy Chain
EVQLVQSGAEVKKPGATVKISCKASGFNIKDYHMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25585 - protein, 118 aa, Artificial Sequence
  Description of Artificial Sequence: Synthetic polypeptide
  VH of XENP021265
EVQLVQSGAEVKKPGATVKISCKASGFNIKDYHMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25586 - protein, 5 aa, Artificial Sequence
  Description of Artificial Sequence: Synthetic peptide
  XENP021265 vhCDR1
DYHMH

SEQ ID NO: 25587 - protein, 17 aa, Artificial Sequence
  Description of Artificial Sequence: Synthetic peptide
  XENP021265 vhCDR2
WIDPENGDTEYAPKFQG

SEQ ID NO: 25588 - protein, 9 aa, Artificial Sequence
  Description of Artificial Sequence: Synthetic peptide
  XENP021265 vhCDR3
RGVRQALDY

SEQ ID NO: 25589 - protein, 214 aa, Artificial Sequence; identical to SEQ ID NO: 17250
  Description of Artificial Sequence: Synthetic polypeptide
  XENP021265 2A11_H1.38_L2_Fab Light Chain

SEQ ID NO: 25590 - protein, 107 aa, Artificial Sequence; identical to SEQ ID NO: 17251
  Description of Artificial Sequence: Synthetic polypeptide
  VL of XENP021265

SEQ ID NO: 25591 - protein, 11 aa, Artificial Sequence
  Description of Artificial Sequence: Synthetic peptide
  XENP021265 vlCDR1
QASQDIGNYLN

SEQ ID NO: 25592 - protein, 7 aa, Artificial Sequence
  Description of Artificial Sequence: Synthetic peptide
  XENP021265 vlCDR2
YTSRLHS

SEQ ID NO: 25593 - protein, 9 aa, Artificial Sequence
  Description of Artificial Sequence: Synthetic peptide
  XENP021265 vlCDR3
QQGNTLPYT

SEQ ID NO: 25594 - protein, 223 aa, Artificial Sequence
  Description of Artificial Sequence: Synthetic polypeptide
  XENP021266 2A11_H1.39_L2_Fab Heavy Chain
EVQLVQSGAEVKKPGATVKISCKASGFNIKDYLMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25595 - protein, 118 aa, Artificial Sequence
  Description of Artificial Sequence: Synthetic polypeptide
  VH of XENP021266
EVQLVQSGAEVKKPGATVKISCKASGFNIKDYLMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25596 - protein, 5 aa, Artificial Sequence
  Description of Artificial Sequence: Synthetic peptide
  XENP021266 vhCDR1
DYLMH

SEQ ID NO: 25597 - protein, 17 aa, Artificial Sequence
  Description of Artificial Sequence: Synthetic peptide
  XENP021266 vhCDR2
WIDPENGDTEYAPKFQG

SEQ ID NO: 25598 - protein, 9 aa, Artificial Sequence
  Description of Artificial Sequence: Synthetic peptide
  XENP021266 vhCDR3
RGVRQALDY

SEQ ID NO: 25599 - protein, 214 aa, Artificial Sequence; identical to SEQ ID NO: 17250
  Description of Artificial Sequence: Synthetic polypeptide
  XENP021266 2A11_H1.39_L2_Fab Light Chain

SEQ ID NO: 25600 - protein, 107 aa, Artificial Sequence; identical to SEQ ID NO: 17251
  Description of Artificial Sequence: Synthetic polypeptide
  VL of XENP021266

SEQ ID NO: 25601 - protein, 11 aa, Artificial Sequence
  Description of Artificial Sequence: Synthetic peptide
  XENP021266 vlCDR1
QASQDIGNYLN

SEQ ID NO: 25602 - protein, 7 aa, Artificial Sequence
  Description of Artificial Sequence: Synthetic peptide
  XENP021266 vlCDR2
YTSRLHS

SEQ ID NO: 25603 - protein, 9 aa, Artificial Sequence
  Description of Artificial Sequence: Synthetic peptide
  XENP021266 vlCDR3
QQGNTLPYT

SEQ ID NO: 25604 - protein, 223 aa, Artificial Sequence
  Description of Artificial Sequence: Synthetic polypeptide
  XENP021267 2A11_H1.40_L2_Fab Heavy Chain
EVQLVQSGAEVKKPGATVKISCKASGFNIKDYWMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25605 - protein, 118 aa, Artificial Sequence
  Description of Artificial Sequence: Synthetic polypeptide
  VH of XENP021267
EVQLVQSGAEVKKPGATVKISCKASGFNIKDYWMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25606 - protein, 5 aa, Artificial Sequence
  Description of Artificial Sequence: Synthetic peptide
  XENP021267 vhCDR1
DYWMH

SEQ ID NO: 25607 - protein, 17 aa, Artificial Sequence
  Description of Artificial Sequence: Synthetic peptide
  XENP021267 vhCDR2
WIDPENGDTEYAPKFQG

SEQ ID NO: 25608 - protein, 9 aa, Artificial Sequence
  Description of Artificial Sequence: Synthetic peptide
  XENP021267 vhCDR3
RGVRQALDY

SEQ ID NO: 25609 - protein, 214 aa, Artificial Sequence; identical to SEQ ID NO: 17250
  Description of Artificial Sequence: Synthetic polypeptide
  XENP021267 2A11_H1.40_L2_Fab Light Chain

SEQ ID NO: 25610 - protein, 107 aa, Artificial Sequence; identical to SEQ ID NO: 17251
  Description of Artificial Sequence: Synthetic polypeptide
  VL of XENP021267

SEQ ID NO: 25611 - protein, 11 aa, Artificial Sequence
  Description of Artificial Sequence: Synthetic peptide
  XENP021267 vlCDR1
QASQDIGNYLN

SEQ ID NO: 25612 - protein, 7 aa, Artificial Sequence
  Description of Artificial Sequence: Synthetic peptide
  XENP021267 vlCDR2
YTSRLHS

SEQ ID NO: 25613 - protein, 9 aa, Artificial Sequence
  Description of Artificial Sequence: Synthetic peptide
  XENP021267 vlCDR3
QQGNTLPYT

SEQ ID NO: 25614 - protein, 223 aa, Artificial Sequence
  Description of Artificial Sequence: Synthetic polypeptide
  XENP021268 2A11_H1.41_L2_Fab Heavy Chain
EVQLVQSGAEVKKPGATVKISCKASGFNIKDYVMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25615 - protein, 118 aa, Artificial Sequence
  Description of Artificial Sequence: Synthetic polypeptide
  VH of XENP021268
EVQLVQSGAEVKKPGATVKISCKASGFNIKDYVMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25616 - protein, 5 aa, Artificial Sequence
  Description of Artificial Sequence: Synthetic peptide
  XENP021268 vhCDR1
DYVMH

SEQ ID NO: 25617 - protein, 17 aa, Artificial Sequence
  Description of Artificial Sequence: Synthetic peptide
  XENP021268 vhCDR2
WIDPENGDTEYAPKFQG

SEQ ID NO: 25618 - protein, 9 aa, Artificial Sequence
  Description of Artificial Sequence: Synthetic peptide
  XENP021268 vhCDR3
RGVRQALDY

SEQ ID NO: 25619 - protein, 214 aa, Artificial Sequence; identical to SEQ ID NO: 17250
  Description of Artificial Sequence: Synthetic polypeptide
  XENP021268 2A11_H1.41_L2_Fab Light Chain

SEQ ID NO: 25620 - protein, 107 aa, Artificial Sequence; identical to SEQ ID NO: 17251
  Description of Artificial Sequence: Synthetic polypeptide
  VL of XENP021268

SEQ ID NO: 25621 - protein, 11 aa, Artificial Sequence
  Description of Artificial Sequence: Synthetic peptide
  XENP021268 vlCDR1
QASQDIGNYLN

SEQ ID NO: 25622 - protein, 7 aa, Artificial Sequence
  Description of Artificial Sequence: Synthetic peptide
  XENP021268 vlCDR2
YTSRLHS

SEQ ID NO: 25623 - protein, 9 aa, Artificial Sequence
  Description of Artificial Sequence: Synthetic peptide
  XENP021268 vlCDR3
QQGNTLPYT

SEQ ID NO: 25624 - protein, 223 aa, Artificial Sequence
  Description of Artificial Sequence: Synthetic polypeptide
  XENP021269 2A11_H1.42_L2_Fab Heavy Chain
EVQLVQSGAEVKKPGATVKISCKASGFNIKDYTMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25625 - protein, 118 aa, Artificial Sequence
  Description of Artificial Sequence: Synthetic polypeptide
  VH of XENP021269
EVQLVQSGAEVKKPGATVKISCKASGFNIKDYTMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25626 - protein, 5 aa, Artificial Sequence
  Description of Artificial Sequence: Synthetic peptide
  XENP021269 vhCDR1
DYTMH

SEQ ID NO: 25627 - protein, 17 aa, Artificial Sequence
  Description of Artificial Sequence: Synthetic peptide
  XENP021269 vhCDR2
WIDPENGDTEYAPKFQG

SEQ ID NO: 25628 - protein, 9 aa, Artificial Sequence
  Description of Artificial Sequence: Synthetic peptide
  XENP021269 vhCDR3
RGVRQALDY

SEQ ID NO: 25629 - protein, 214 aa, Artificial Sequence; identical to SEQ ID NO: 17250
  Description of Artificial Sequence: Synthetic polypeptide
  XENP021269 2A11_H1.42_L2_Fab Light Chain

SEQ ID NO: 25630 - protein, 107 aa, Artificial Sequence; identical to SEQ ID NO: 17251
  Description of Artificial Sequence: Synthetic polypeptide
  VL of XENP021269

SEQ ID NO: 25631 - protein, 11 aa, Artificial Sequence
  Description of Artificial Sequence: Synthetic peptide
  XENP021269 vlCDR1
QASQDIGNYLN

SEQ ID NO: 25632 - protein, 7 aa, Artificial Sequence
  Description of Artificial Sequence: Synthetic peptide
  XENP021269 vlCDR2
YTSRLHS

SEQ ID NO: 25633 - protein, 9 aa, Artificial Sequence
  Description of Artificial Sequence: Synthetic peptide
  XENP021269 vlCDR3
QQGNTLPYT

SEQ ID NO: 25634 - protein, 223 aa, Artificial Sequence
  Description of Artificial Sequence: Synthetic polypeptide
  XENP021270 2A11_H1.43_L2_Fab Heavy Chain
EVQLVQSGAEVKKPGATVKISCKASGFNIKDYQMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25635 - protein, 118 aa, Artificial Sequence
  Description of Artificial Sequence: Synthetic polypeptide
  VH of XENP021270
EVQLVQSGAEVKKPGATVKISCKASGFNIKDYQMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25636 - protein, 5 aa, Artificial Sequence
  Description of Artificial Sequence: Synthetic peptide
  XENP021270 vhCDR1
DYQMH

SEQ ID NO: 25637 - protein, 17 aa, Artificial Sequence
  Description of Artificial Sequence: Synthetic peptide
  XENP021270 vhCDR2
WIDPENGDTEYAPKFQG

SEQ ID NO: 25638 - protein, 9 aa, Artificial Sequence
  Description of Artificial Sequence: Synthetic peptide
  XENP021270 vhCDR3
RGVRQALDY

SEQ ID NO: 25639 - protein, 214 aa, Artificial Sequence; identical to SEQ ID NO: 17250
  Description of Artificial Sequence: Synthetic polypeptide
  XENP021270 2A11_H1.43_L2_Fab Light Chain

SEQ ID NO: 25640 - protein, 107 aa, Artificial Sequence; identical to SEQ ID NO: 17251
  Description of Artificial Sequence: Synthetic polypeptide
  VL of XENP021270

SEQ ID NO: 25641 - protein, 11 aa, Artificial Sequence
  Description of Artificial Sequence: Synthetic peptide
  XENP021270 vlCDR1
QASQDIGNYLN

SEQ ID NO: 25642 - protein, 7 aa, Artificial Sequence
  Description of Artificial Sequence: Synthetic peptide
  XENP021270 vlCDR2
YTSRLHS

SEQ ID NO: 25643 - protein, 9 aa, Artificial Sequence
  Description of Artificial Sequence: Synthetic peptide
  XENP021270 vlCDR3
QQGNTLPYT

SEQ ID NO: 25644 - protein, 223 aa, Artificial Sequence
  Description of Artificial Sequence: Synthetic polypeptide
  XENP021271 2A11_H1.44_L2_Fab Heavy Chain
EVQLVQSGAEVKKPGATVKISCKASGFNIKDYRMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25645 - protein, 118 aa, Artificial Sequence
  Description of Artificial Sequence: Synthetic polypeptide
  VH of XENP021271
EVQLVQSGAEVKKPGATVKISCKASGFNIKDYRMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25646 - protein, 5 aa, Artificial Sequence
  Description of Artificial Sequence: Synthetic peptide
  XENP021271 vhCDR1
DYRMH

SEQ ID NO: 25647 - protein, 17 aa, Artificial Sequence
  Description of Artificial Sequence: Synthetic peptide
  XENP021271 vhCDR2
WIDPENGDTEYAPKFQG

SEQ ID NO: 25648 - protein, 9 aa, Artificial Sequence
  Description of Artificial Sequence: Synthetic peptide
  XENP021271 vhCDR3
RGVRQALDY

SEQ ID NO: 25649 - protein, 214 aa, Artificial Sequence; identical to SEQ ID NO: 17250
  Description of Artificial Sequence: Synthetic polypeptide
  XENP021271 2A11_H1.44_L2_Fab Light Chain

SEQ ID NO: 25650 - protein, 107 aa, Artificial Sequence; identical to SEQ ID NO: 17251
  Description of Artificial Sequence: Synthetic polypeptide
  VL of XENP021271

SEQ ID NO: 25651 - protein, 11 aa, Artificial Sequence
  Description of Artificial Sequence: Synthetic peptide
  XENP021271 vlCDR1
QASQDIGNYLN

SEQ ID NO: 25652 - protein, 7 aa, Artificial Sequence
  Description of Artificial Sequence: Synthetic peptide
  XENP021271 vlCDR2
YTSRLHS

SEQ ID NO: 25653 - protein, 9 aa, Artificial Sequence
  Description of Artificial Sequence: Synthetic peptide
  XENP021271 vlCDR3
QQGNTLPYT

SEQ ID NO: 25654 - protein, 223 aa, Artificial Sequence
  Description of Artificial Sequence: Synthetic polypeptide
  XENP021272 2A11_H1.45_L2_Fab Heavy Chain
EVQLVQSGAEVKKPGATVKISCKASGFNIKDYKMHWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25655 - protein, 118 aa, Artificial Sequence
  Description of Artificial Sequence: Synthetic polypeptide
  VH of XENP021272
EVQLVQSGAEVKKPGATVKISCKASGFNIKDYKMHWVQQAPGKGLEWMGWIDPENGDTEYAPKFQGRVTITADTSTNTAYMELSSLRSEDTAVYYCYARGVRQALDYWGQGTLVTVSS

SEQ ID NO: 25656 - protein, 5 aa, Artificial Sequence
  Description of Artificial Sequence: Synthetic peptide
  XENP021272 vhCDR1
DYKMH

SEQ ID NO: 25657 - protein, 17 aa, Artificial Sequence
  Description of Artificial Sequence: Synthetic peptide
  XENP021272 vhCDR2
WIDPENGDTEYAPKFQG

SEQ ID NO: 25658 - protein, 9 aa, Artificial Sequence
  Description of Artificial Sequence: Synthetic peptide
  XENP021272 vhCDR3
RGVRQALDY

SEQ ID NO: 25659 - protein, 214 aa, Artificial Sequence; identical to SEQ ID NO: 17250
  Description of Artificial Sequence: Synthetic polypeptide
  XENP021272 2A11_H1.45_L2_Fab Light Chain

SEQ ID NO: 25660 - protein, 107 aa, Artificial Sequence; identical to SEQ ID NO: 17251
  Description of Artificial Sequence: Synthetic polypeptide
  VL of XENP021272

SEQ ID NO: 25661 - protein, 11 aa, Artificial Sequence
  Description of Artificial Sequence: Synthetic peptide
  XENP021272 vlCDR1
QASQDIGNYLN

SEQ ID NO: 25662 - protein, 7 aa, Artificial Sequence
  Description of Artificial Sequence: Synthetic peptide
  XENP021272 vlCDR2
YTSRLHS

SEQ ID NO: 25663 - protein, 9 aa, Artificial Sequence
  Description of Artificial Sequence: Synthetic peptide
  XENP021272 vlCDR3
QQGNTLPYT

SEQ ID NO: 25664 - protein, 223 aa, Artificial Sequence
  Description of Artificial Sequence: Synthetic polypeptide
  XENP021273 2A11_H1.46_L2_Fab Heavy Chain
EVQLVQSGAEVKKPGATVKISCKASGFNIKDYYMNWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25665 - protein, 118 aa, Artificial Sequence
  Description of Artificial Sequence: Synthetic polypeptide
  VH of XENP021273
EVQLVQSGAEVKKPGATVKISCKASGFNIKDYYMNWVQQAPGKGLEWMGWIDPENGDTEYAPKFQGRVTITADTSTNTAYMELSSLRSEDTAVYYCYARGVRQALDYWGQGTLVTVSS

SEQ ID NO: 25666 - protein, 5 aa, Artificial Sequence
  Description of Artificial Sequence: Synthetic peptide
  XENP021273 vhCDR1
DYYMN

SEQ ID NO: 25667 - protein, 17 aa, Artificial Sequence
  Description of Artificial Sequence: Synthetic peptide
  XENP021273 vhCDR2
WIDPENGDTEYAPKFQG

SEQ ID NO: 25668 - protein, 9 aa, Artificial Sequence
  Description of Artificial Sequence: Synthetic peptide
  XENP021273 vhCDR3
RGVRQALDY

SEQ ID NO: 25669 - protein, 214 aa, Artificial Sequence; identical to SEQ ID NO: 17250
  Description of Artificial Sequence: Synthetic polypeptide
  XENP021273 2A11_H1.46_L2_Fab Light Chain

SEQ ID NO: 25670 - protein, 107 aa, Artificial Sequence; identical to SEQ ID NO: 17251
  Description of Artificial Sequence: Synthetic polypeptide
  VL of XENP021273

SEQ ID NO: 25671 - protein, 11 aa, Artificial Sequence
  Description of Artificial Sequence: Synthetic peptide
  XENP021273 vlCDR1
QASQDIGNYLN

SEQ ID NO: 25672 - protein, 7 aa, Artificial Sequence
  Description of Artificial Sequence: Synthetic peptide
  XENP021273 vlCDR2
YTSRLHS

SEQ ID NO: 25673 - protein, 9 aa, Artificial Sequence
  Description of Artificial Sequence: Synthetic peptide
  XENP021273 vlCDR3
QQGNTLPYT

SEQ ID NO: 25674 - protein, 223 aa, Artificial Sequence
  Description of Artificial Sequence: Synthetic polypeptide
  XENP021274 2A11_H1.47_L2_Fab Heavy Chain
EVQLVQSGAEVKKPGATVKISCKASGFNIKDYYMSWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25675 - protein, 118 aa, Artificial Sequence
  Description of Artificial Sequence: Synthetic polypeptide
  VH of XENP021274
EVQLVQSGAEVKKPGATVKISCKASGFNIKDYYMSWVQQAPGKGLEWMGWIDPENGDTEYAPKFQGRVTITADTSTNTAYMELSSLRSEDTAVYYCYARGVRQALDYWGQGTLVTVSS

SEQ ID NO: 25676 - protein, 5 aa, Artificial Sequence
  Description of Artificial Sequence: Synthetic peptide
  XENP021274 vhCDR1
DYYMS

SEQ ID NO: 25677 - protein, 17 aa, Artificial Sequence
  Description of Artificial Sequence: Synthetic peptide
  XENP021274 vhCDR2
WIDPENGDTEYAPKFQG

SEQ ID NO: 25678 - protein, 9 aa, Artificial Sequence
  Description of Artificial Sequence: Synthetic peptide
  XENP021274 vhCDR3
RGVRQALDY

SEQ ID NO: 25679 - protein, 214 aa, Artificial Sequence; identical to SEQ ID NO: 17250
  Description of Artificial Sequence: Synthetic polypeptide
  XENP021274 2A11_H1.47_L2_Fab Light Chain

SEQ ID NO: 25680 - protein, 107 aa, Artificial Sequence; identical to SEQ ID NO: 17251
  Description of Artificial Sequence: Synthetic polypeptide
  VL of XENP021274

SEQ ID NO: 25681 - protein, 11 aa, Artificial Sequence
  Description of Artificial Sequence: Synthetic peptide
  XENP021274 vlCDR1
QASQDIGNYLN

SEQ ID NO: 25682 - protein, 7 aa, Artificial Sequence
  Description of Artificial Sequence: Synthetic peptide
  XENP021274 vlCDR2
YTSRLHS

SEQ ID NO: 25683 - protein, 9 aa, Artificial Sequence
  Description of Artificial Sequence: Synthetic peptide
  XENP021274 vlCDR3
QQGNTLPYT

SEQ ID NO: 25684 - protein, 223 aa, Artificial Sequence
  Description of Artificial Sequence: Synthetic polypeptide
  XENP021275 2A11_H1.48_L2_Fab Heavy Chain
EVQLVQSGAEVKKPGATVKISCKASGFNIKDYYMEWVQQAPGKGLEWMGWIDPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25685 - protein, 118 aa, Artificial Sequence
  Description of Artificial Sequence: Synthetic polypeptide
  VH of XENP021275
EVQLVQSGAEVKKPGATVKISCKASGFNIKDYYMEWVQQAPGKGLEWMGWIDPENGDTEYAPKFQGRVTITADTSTNTAYMELSSLRSEDTAVYYCYARGVRQALDYWGQGTLVTVSS

SEQ ID NO: 25686 - protein, 5 aa, Artificial Sequence
  Description of Artificial Sequence: Synthetic peptide
  XENP021275 vhCDR1
DYYME

SEQ ID NO: 25687 - protein, 17 aa, Artificial Sequence
  Description of Artificial Sequence: Synthetic peptide
  XENP021275 vhCDR2
WIDPENGDTEYAPKFQG

SEQ ID NO: 25688 - protein, 9 aa, Artificial Sequence
  Description of Artificial Sequence: Synthetic peptide
  XENP021275 vhCDR3
RGVRQALDY

SEQ ID NO: 25689 - protein, 214 aa, Artificial Sequence; identical to SEQ ID NO: 17250
  Description of Artificial Sequence: Synthetic polypeptide
  XENP021275 2A11_H1.48_L2_Fab Light Chain

SEQ ID NO: 25690 - protein, 107 aa, Artificial Sequence; identical to SEQ ID NO: 17251
  Description of Artificial Sequence: Synthetic polypeptide
  VL of XENP021275

SEQ ID NO: 25691 - protein, 11 aa, Artificial Sequence
  Description of Artificial Sequence: Synthetic peptide
  XENP021275 vlCDR1
QASQDIGNYLN

SEQ ID NO: 25692 - protein, 7 aa, Artificial Sequence
  Description of Artificial Sequence: Synthetic peptide
  XENP021275 vlCDR2
YTSRLHS

SEQ ID NO: 25693 - protein, 9 aa, Artificial Sequence
  Description of Artificial Sequence: Synthetic peptide
  XENP021275 vlCDR3
QQGNTLPYT

SEQ ID NO: 25694 - protein, 223 aa, Artificial Sequence
  Description of Artificial Sequence: Synthetic polypeptide
  XENP021276 2A11_H1.49_L2_Fab Heavy Chain
EVQLVQSGAEVKKPGATVKISCKASGFNIKDYYMHWVQQAPGKGLEWMGWINPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25695 - protein, 118 aa, Artificial Sequence
  Description of Artificial Sequence: Synthetic polypeptide
  VH of XENP021276
EVQLVQSGAEVKKPGATVKISCKASGFNIKDYYMHWVQQAPGKGLEWMGWINPENGDTEYAPKFQGRVTITADTSTNTAYMELSSLRSEDTAVYYCYARGVRQALDYWGQGTLVTVSS

SEQ ID NO: 25696 - protein, 5 aa, Artificial Sequence
  Description of Artificial Sequence: Synthetic peptide
  XENP021276 vhCDR1
DYYMH

SEQ ID NO: 25697 - protein, 17 aa, Artificial Sequence
  Description of Artificial Sequence: Synthetic peptide
  XENP021276 vhCDR2
WINPENGDTEYAPKFQG

SEQ ID NO: 25698 - protein, 9 aa, Artificial Sequence
  Description of Artificial Sequence: Synthetic peptide
  XENP021276 vhCDR3
RGVRQALDY

SEQ ID NO: 25699 - protein, 214 aa, Artificial Sequence; identical to SEQ ID NO: 17250
  Description of Artificial Sequence: Synthetic polypeptide
  XENP021276 2A11_H1.49_L2_Fab Light Chain

SEQ ID NO: 25700 - protein, 107 aa, Artificial Sequence; identical to SEQ ID NO: 17251
  Description of Artificial Sequence: Synthetic polypeptide
  VL of XENP021276

SEQ ID NO: 25701 - protein, 11 aa, Artificial Sequence
  Description of Artificial Sequence: Synthetic peptide
  XENP021276 vlCDR1
QASQDIGNYLN

SEQ ID NO: 25702 - protein, 7 aa, Artificial Sequence
  Description of Artificial Sequence: Synthetic peptide
  XENP021276 vlCDR2
YTSRLHS

SEQ ID NO: 25703 - protein, 9 aa, Artificial Sequence
  Description of Artificial Sequence: Synthetic peptide
  XENP021276 vlCDR3
QQGNTLPYT

SEQ ID NO: 25704 - protein, 223 aa, Artificial Sequence
  Description of Artificial Sequence: Synthetic polypeptide
  XENP021277 2A11_H1.50_L2_Fab Heavy Chain
EVQLVQSGAEVKKPGATVKISCKASGFNIKDYYMHWVQQAPGKGLEWMGWIEPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25705 - protein, 118 aa, Artificial Sequence
  Description of Artificial Sequence: Synthetic polypeptide
  VH of XENP021277
EVQLVQSGAEVKKPGATVKISCKASGFNIKDYYMHWVQQAPGKGLEWMGWIEPENGDTEYAPKFQGRVTITADTSTNTAYMELSSLRSEDTAVYYCYARGVRQALDYWGQGTLVTVSS

SEQ ID NO: 25706 - protein, 5 aa, Artificial Sequence
  Description of Artificial Sequence: Synthetic peptide
  XENP021277 vhCDR1
DYYMH

SEQ ID NO: 25707 - protein, 17 aa, Artificial Sequence
  Description of Artificial Sequence: Synthetic peptide
  XENP021277 vhCDR2
WIEPENGDTEYAPKFQG

SEQ ID NO: 25708 - protein, 9 aa, Artificial Sequence
  Description of Artificial Sequence: Synthetic peptide
  XENP021277 vhCDR3
RGVRQALDY

SEQ ID NO: 25709 - protein, 214 aa, Artificial Sequence; identical to SEQ ID NO: 17250
  Description of Artificial Sequence: Synthetic polypeptide
  XENP021277 2A11_H1.50_L2_Fab Light Chain

SEQ ID NO: 25710 - protein, 107 aa, Artificial Sequence; identical to SEQ ID NO: 17251
  Description of Artificial Sequence: Synthetic polypeptide
  VL of XENP021277

SEQ ID NO: 25711 - protein, 11 aa, Artificial Sequence
  Description of Artificial Sequence: Synthetic peptide
  XENP021277 vlCDR1
QASQDIGNYLN

SEQ ID NO: 25712 - protein, 7 aa, Artificial Sequence
  Description of Artificial Sequence: Synthetic peptide
  XENP021277 vlCDR2
YTSRLHS

SEQ ID NO: 25713 - protein, 9 aa, Artificial Sequence
  Description of Artificial Sequence: Synthetic peptide
  XENP021277 vlCDR3
QQGNTLPYT

SEQ ID NO: 25714 - protein, 223 aa, Artificial Sequence
  Description of Artificial Sequence: Synthetic polypeptide
  XENP021278 2A11_H1.51_L2_Fab Heavy Chain
EVQLVQSGAEVKKPGATVKISCKASGFNIKDYYMHWVQQAPGKGLEWMGWIHPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25715 - protein, 118 aa, Artificial Sequence
  Description of Artificial Sequence: Synthetic polypeptide
  VH of XENP021278
EVQLVQSGAEVKKPGATVKISCKASGFNIKDYYMHWVQQAPGKGLEWMGWIHPENGDTEYAPKFQGRVTITADTSTNTAYMELSSLRSEDTAVYYCYARGVRQALDYWGQGTLVTVSS

SEQ ID NO: 25716 - protein, 5 aa, Artificial Sequence
  Description of Artificial Sequence: Synthetic peptide
  XENP021278 vhCDR1
DYYMH

SEQ ID NO: 25717 - protein, 17 aa, Artificial Sequence
  Description of Artificial Sequence: Synthetic peptide
  XENP021278 vhCDR2
WIHPENGDTEYAPKFQG

SEQ ID NO: 25718 - protein, 9 aa, Artificial Sequence
  Description of Artificial Sequence: Synthetic peptide
  XENP021278 vhCDR3
RGVRQALDY

SEQ ID NO: 25719 - protein, 214 aa, Artificial Sequence; identical to SEQ ID NO: 17250
  Description of Artificial Sequence: Synthetic polypeptide
  XENP021278 2A11_H1.51_L2_Fab Light Chain

SEQ ID NO: 25720 - protein, 107 aa, Artificial Sequence; identical to SEQ ID NO: 17251
  Description of Artificial Sequence: Synthetic polypeptide
  VL of XENP021278

SEQ ID NO: 25721 - protein, 11 aa, Artificial Sequence
  Description of Artificial Sequence: Synthetic peptide
  XENP021278 vlCDR1
QASQDIGNYLN

SEQ ID NO: 25722 - protein, 7 aa, Artificial Sequence
  Description of Artificial Sequence: Synthetic peptide
  XENP021278 vlCDR2
YTSRLHS

SEQ ID NO: 25723 - protein, 9 aa, Artificial Sequence
  Description of Artificial Sequence: Synthetic peptide
  XENP021278 vlCDR3
QQGNTLPYT

SEQ ID NO: 25724 - protein, 223 aa, Artificial Sequence
  Description of Artificial Sequence: Synthetic polypeptide
  XENP021279 2A11_H1.52_L2_Fab Heavy Chain
EVQLVQSGAEVKKPGATVKISCKASGFNIKDYYMHWVQQAPGKGLEWMGWISPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25725 - protein, 118 aa, Artificial Sequence
  Description of Artificial Sequence: Synthetic polypeptide
  VH of XENP021279
EVQLVQSGAEVKKPGATVKISCKASGFNIKDYYMHWVQQAPGKGLEWMGWISPENGDTEYAPKFQGRVTITADTSTNTAYMELSSLRSEDTAVYYCYARGVRQALDYWGQGTLVTVSS

SEQ ID NO: 25726 - protein, 5 aa, Artificial Sequence
  Description of Artificial Sequence: Synthetic peptide
  XENP021279 vhCDR1
DYYMH

SEQ ID NO: 25727 - protein, 17 aa, Artificial Sequence
  Description of Artificial Sequence: Synthetic peptide
  XENP021279 vhCDR2
WISPENGDTEYAPKFQG

SEQ ID NO: 25728 - protein, 9 aa, Artificial Sequence
  Description of Artificial Sequence: Synthetic peptide
  XENP021279 vhCDR3
RGVRQALDY

SEQ ID NO: 25729 - protein, 214 aa, Artificial Sequence; identical to SEQ ID NO: 17250
  Description of Artificial Sequence: Synthetic polypeptide
  XENP021279 2A11_H1.52_L2_Fab Light Chain

SEQ ID NO: 25730 - protein, 107 aa, Artificial Sequence; identical to SEQ ID NO: 17251
  Description of Artificial Sequence: Synthetic polypeptide
  VL of XENP021279

SEQ ID NO: 25731 - protein, 11 aa, Artificial Sequence
  Description of Artificial Sequence: Synthetic peptide
  XENP021279 vlCDR1
QASQDIGNYLN

SEQ ID NO: 25732 - protein, 7 aa, Artificial Sequence
  Description of Artificial Sequence: Synthetic peptide
  XENP021279 vlCDR2
YTSRLHS

SEQ ID NO: 25733 - protein, 9 aa, Artificial Sequence
  Description of Artificial Sequence: Synthetic peptide
  XENP021279 vlCDR3
QQGNTLPYT

SEQ ID NO: 25734 - protein, 223 aa, Artificial Sequence
  Description of Artificial Sequence: Synthetic polypeptide
  XENP021280 2A11_H1.53_L2_Fab Heavy Chain
EVQLVQSGAEVKKPGATVKISCKASGFNIKDYYMHWVQQAPGKGLEWMGWIQPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25735 - protein, 118 aa, Artificial Sequence
  Description of Artificial Sequence: Synthetic polypeptide
  VH of XENP021280
EVQLVQSGAEVKKPGATVKISCKASGFNIKDYYMHWVQQAPGKGLEWMGWIQPENGDTEYAPKFQGRVTITADTSTNTAYMELSSLRSEDTAVYYCYARGVRQALDYWGQGTLVTVSS

SEQ ID NO: 25736 - protein, 5 aa, Artificial Sequence
  Description of Artificial Sequence: Synthetic peptide
  XENP021280 vhCDR1
DYYMH

SEQ ID NO: 25737 - protein, 17 aa, Artificial Sequence
  Description of Artificial Sequence: Synthetic peptide
  XENP021280 vhCDR2
WIQPENGDTEYAPKFQG

SEQ ID NO: 25738 - protein, 9 aa, Artificial Sequence
  Description of Artificial Sequence: Synthetic peptide
  XENP021280 vhCDR3
RGVRQALDY

SEQ ID NO: 25739 - protein, 214 aa, Artificial Sequence; identical to SEQ ID NO: 17250
  Description of Artificial Sequence: Synthetic polypeptide
  XENP021280 2A11_H1.53_L2_Fab Light Chain

SEQ ID NO: 25740 - protein, 107 aa, Artificial Sequence; identical to SEQ ID NO: 17251
  Description of Artificial Sequence: Synthetic polypeptide
  VL of XENP021280

SEQ ID NO: 25741 - protein, 11 aa, Artificial Sequence
  Description of Artificial Sequence: Synthetic peptide
  XENP021280 vlCDR1
QASQDIGNYLN

SEQ ID NO: 25742 - protein, 7 aa, Artificial Sequence
  Description of Artificial Sequence: Synthetic peptide
  XENP021280 vlCDR2
YTSRLHS

SEQ ID NO: 25743 - protein, 9 aa, Artificial Sequence
  Description of Artificial Sequence: Synthetic peptide
  XENP021280 vlCDR3
QQGNTLPYT

SEQ ID NO: 25744 - protein, 223 aa, Artificial Sequence
  Description of Artificial Sequence: Synthetic polypeptide
  XENP021281 2A11_H1.54_L2_Fab Heavy Chain
EVQLVQSGAEVKKPGATVKISCKASGFNIKDYYMHWVQQAPGKGLEWMGWILPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25745 - protein, 118 aa, Artificial Sequence
  Description of Artificial Sequence: Synthetic polypeptide
  VH of XENP021281
EVQLVQSGAEVKKPGATVKISCKASGFNIKDYYMHWVQQAPGKGLEWMGWILPENGDTEYAPKFQGRVTITADTSTNTAYMELSSLRSEDTAVYYCYARGVRQALDYWGQGTLVTVSS

SEQ ID NO: 25746 - protein, 5 aa, Artificial Sequence
  Description of Artificial Sequence: Synthetic peptide
  XENP021281 vhCDR1
DYYMH

SEQ ID NO: 25747 - protein, 17 aa, Artificial Sequence
  Description of Artificial Sequence: Synthetic peptide
  XENP021281 vhCDR2
WILPENGDTEYAPKFQG

SEQ ID NO: 25748 - protein, 9 aa, Artificial Sequence
  Description of Artificial Sequence: Synthetic peptide
  XENP021281 vhCDR3
RGVRQALDY

SEQ ID NO: 25749 - protein, 214 aa, Artificial Sequence; identical to SEQ ID NO: 17250
  Description of Artificial Sequence: Synthetic polypeptide
  XENP021281 2A11_H1.54_L2_Fab Light Chain

SEQ ID NO: 25750 - protein, 107 aa, Artificial Sequence; identical to SEQ ID NO: 17251
  Description of Artificial Sequence: Synthetic polypeptide
  VL of XENP021281

SEQ ID NO: 25751 - protein, 11 aa, Artificial Sequence
  Description of Artificial Sequence: Synthetic peptide
  XENP021281 vlCDR1
QASQDIGNYLN

SEQ ID NO: 25752 - protein, 7 aa, Artificial Sequence
  Description of Artificial Sequence: Synthetic peptide
  XENP021281 vlCDR2
YTSRLHS

SEQ ID NO: 25753 - protein, 9 aa, Artificial Sequence
  Description of Artificial Sequence: Synthetic peptide
  XENP021281 vlCDR3
QQGNTLPYT

SEQ ID NO: 25754 - protein, 223 aa, Artificial Sequence
  Description of Artificial Sequence: Synthetic polypeptide
  XENP021282 2A11_H1.55_L2_Fab Heavy Chain
EVQLVQSGAEVKKPGATVKISCKASGFNIKDYYMHWVQQAPGKGLEWMGWITPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25755 - protein, 118 aa, Artificial Sequence
  Description of Artificial Sequence: Synthetic polypeptide
  VH of XENP021282
EVQLVQSGAEVKKPGATVKISCKASGFNIKDYYMHWVQQAPGKGLEWMGWITPENGDTEYAPKFQGRVTITADTSTNTAYMELSSLRSEDTAVYYCYARGVRQALDYWGQGTLVTVSS

SEQ ID NO: 25756 - protein, 5 aa, Artificial Sequence
  Description of Artificial Sequence: Synthetic peptide
  XENP021282 vhCDR1
DYYMH

SEQ ID NO: 25757 - protein, 17 aa, Artificial Sequence
  Description of Artificial Sequence: Synthetic peptide
  XENP021282 vhCDR2
WITPENGDTEYAPKFQG

SEQ ID NO: 25758 - protein, 9 aa, Artificial Sequence
  Description of Artificial Sequence: Synthetic peptide
  XENP021282 vhCDR3
RGVRQALDY

SEQ ID NO: 25759 - protein, 214 aa, Artificial Sequence; identical to SEQ ID NO: 17250
  Description of Artificial Sequence: Synthetic polypeptide
  XENP021282 2A11_H1.55_L2_Fab Light Chain

SEQ ID NO: 25760 - protein, 107 aa, Artificial Sequence; identical to SEQ ID NO: 17251
  Description of Artificial Sequence: Synthetic polypeptide
  VL of XENP021282

SEQ ID NO: 25761 - protein, 11 aa, Artificial Sequence
  Description of Artificial Sequence: Synthetic peptide
  XENP021282 vlCDR1
QASQDIGNYLN

SEQ ID NO: 25762 - protein, 7 aa, Artificial Sequence
  Description of Artificial Sequence: Synthetic peptide
  XENP021282 vlCDR2
YTSRLHS

SEQ ID NO: 25763 - protein, 9 aa, Artificial Sequence
  Description of Artificial Sequence: Synthetic peptide
  XENP021282 vlCDR3
QQGNTLPYT

SEQ ID NO: 25764 - protein, 223 aa, Artificial Sequence
  Description of Artificial Sequence: Synthetic polypeptide
  XENP021283 2A11_H1.56_L2_Fab Heavy Chain
EVQLVQSGAEVKKPGATVKISCKASGFNIKDYYMHWVQQAPGKGLEWMGWIRPENGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25765 - protein, 118 aa, Artificial Sequence
  Description of Artificial Sequence: Synthetic polypeptide
  VH of XENP021283
EVQLVQSGAEVKKPGATVKISCKASGFNIKDYYMHWVQQAPGKGLEWMGWIRPENGDTEYAPKFQGRVTITADTSTNTAYMELSSLRSEDTAVYYCYARGVRQALDYWGQGTLVTVSS

SEQ ID NO: 25766 - protein, 5 aa, Artificial Sequence
  Description of Artificial Sequence: Synthetic peptide
  XENP021283 vhCDR1
DYYMH

SEQ ID NO: 25767 - protein, 17 aa, Artificial Sequence
  Description of Artificial Sequence: Synthetic peptide
  XENP021283 vhCDR2
WIRPENGDTEYAPKFQG

SEQ ID NO: 25768 - protein, 9 aa, Artificial Sequence
  Description of Artificial Sequence: Synthetic peptide
  XENP021283 vhCDR3
RGVRQALDY

SEQ ID NO: 25769 - protein, 214 aa, Artificial Sequence; identical to SEQ ID NO: 17250
  Description of Artificial Sequence: Synthetic polypeptide
  XENP021283 2A11_H1.56_L2_Fab Light Chain

SEQ ID NO: 25770 - protein, 107 aa, Artificial Sequence; identical to SEQ ID NO: 17251
  Description of Artificial Sequence: Synthetic polypeptide
  VL of XENP021283

SEQ ID NO: 25771 - protein, 11 aa, Artificial Sequence
  Description of Artificial Sequence: Synthetic peptide
  XENP021283 vlCDR1
QASQDIGNYLN

SEQ ID NO: 25772 - protein, 7 aa, Artificial Sequence
  Description of Artificial Sequence: Synthetic peptide
  XENP021283 vlCDR2
YTSRLHS

SEQ ID NO: 25773 - protein, 9 aa, Artificial Sequence
  Description of Artificial Sequence: Synthetic peptide
  XENP021283 vlCDR3
QQGNTLPYT

SEQ ID NO: 25774 - protein, 223 aa, Artificial Sequence
  Description of Artificial Sequence: Synthetic polypeptide
  XENP021284 2A11_H1.57_L2_Fab Heavy Chain
EVQLVQSGAEVKKPGATVKISCKASGFNIKDYYMHWVQQAPGKGLEWMGWIDPQNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25775 - protein, 118 aa, Artificial Sequence
  Description of Artificial Sequence: Synthetic polypeptide
  VH of XENP021284
EVQLVQSGAEVKKPGATVKISCKASGFNIKDYYMHWVQQAPGKGLEWMGWIDPQNGDTEYAPKFQGRVTITADTSTNTAYMELSSLRSEDTAVYYCYARGVRQALDYWGQGTLVTVSS

SEQ ID NO: 25776 - protein, 5 aa, Artificial Sequence
  Description of Artificial Sequence: Synthetic peptide
  XENP021284 vhCDR1
DYYMH

SEQ ID NO: 25777 - protein, 17 aa, Artificial Sequence
  Description of Artificial Sequence: Synthetic peptide
  XENP021284 vhCDR2
WIDPQNGDTEYAPKFQG

SEQ ID NO: 25778 - protein, 9 aa, Artificial Sequence
  Description of Artificial Sequence: Synthetic peptide
  XENP021284 vhCDR3
RGVRQALDY

SEQ ID NO: 25779 - protein, 214 aa, Artificial Sequence; identical to SEQ ID NO: 17250
  Description of Artificial Sequence: Synthetic polypeptide
  XENP021284 2A11_H1.57_L2_Fab Light Chain

SEQ ID NO: 25780 - protein, 107 aa, Artificial Sequence; identical to SEQ ID NO: 17251
  Description of Artificial Sequence: Synthetic polypeptide
  VL of XENP021284

SEQ ID NO: 25781 - protein, 11 aa, Artificial Sequence
  Description of Artificial Sequence: Synthetic peptide
  XENP021284 vlCDR1
QASQDIGNYLN

SEQ ID NO: 25782 - protein, 7 aa, Artificial Sequence
  Description of Artificial Sequence: Synthetic peptide
  XENP021284 vlCDR2
YTSRLHS

SEQ ID NO: 25783 - protein, 9 aa, Artificial Sequence
  Description of Artificial Sequence: Synthetic peptide
  XENP021284 vlCDR3
QQGNTLPYT

SEQ ID NO: 25784 - protein, 223 aa, Artificial Sequence
  Description of Artificial Sequence: Synthetic polypeptide
  XENP021285 2A11_H1.58_L2_Fab Heavy Chain
EVQLVQSGAEVKKPGATVKISCKASGFNIKDYYMHWVQQAPGKGLEWMGWIDPDNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25785 - protein, 118 aa, Artificial Sequence
  Description of Artificial Sequence: Synthetic polypeptide
  VH of XENP021285
EVQLVQSGAEVKKPGATVKISCKASGFNIKDYYMHWVQQAPGKGLEWMGWIDPDNGDTEYAPKFQGRVTITADTSTNTAYMELSSLRSEDTAVYYCYARGVRQALDYWGQGTLVTVSS

SEQ ID NO: 25786 - protein, 5 aa, Artificial Sequence
  Description of Artificial Sequence: Synthetic peptide
  XENP021285 vhCDR1
DYYMH

SEQ ID NO: 25787 - protein, 17 aa, Artificial Sequence
  Description of Artificial Sequence: Synthetic peptide
  XENP021285 vhCDR2
WIDPDNGDTEYAPKFQG

SEQ ID NO: 25788 - protein, 9 aa, Artificial Sequence
  Description of Artificial Sequence: Synthetic peptide
  XENP021285 vhCDR3
RGVRQALDY

SEQ ID NO: 25789 - protein, 214 aa, Artificial Sequence; identical to SEQ ID NO: 17250
  Description of Artificial Sequence: Synthetic polypeptide
  XENP021285 2A11_H1.58_L2_Fab Light Chain

SEQ ID NO: 25790 - protein, 107 aa, Artificial Sequence; identical to SEQ ID NO: 17251
  Description of Artificial Sequence: Synthetic polypeptide
  VL of XENP021285

SEQ ID NO: 25791 - protein, 11 aa, Artificial Sequence
  Description of Artificial Sequence: Synthetic peptide
  XENP021285 vlCDR1
QASQDIGNYLN

SEQ ID NO: 25792 - protein, 7 aa, Artificial Sequence
  Description of Artificial Sequence: Synthetic peptide
  XENP021285 vlCDR2
YTSRLHS

SEQ ID NO: 25793 - protein, 9 aa, Artificial Sequence
  Description of Artificial Sequence: Synthetic peptide
  XENP021285 vlCDR3
QQGNTLPYT

SEQ ID NO: 25794 - protein, 223 aa, Artificial Sequence
  Description of Artificial Sequence: Synthetic polypeptide
  XENP021286 2A11_H1.59_L2_Fab Heavy Chain
EVQLVQSGAEVKKPGATVKISCKASGFNIKDYYMHWVQQAPGKGLEWMGWIDPKNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25795 - protein, 118 aa, Artificial Sequence
  Description of Artificial Sequence: Synthetic polypeptide
  VH of XENP021286
EVQLVQSGAEVKKPGATVKISCKASGFNIKDYYMHWVQQAPGKGLEWMGWIDPKNGDTEYAPKFQGRVTITADTSTNTAYMELSSLRSEDTAVYYCYARGVRQALDYWGQGTLVTVSS

SEQ ID NO: 25796 - protein, 5 aa, Artificial Sequence
  Description of Artificial Sequence: Synthetic peptide
  XENP021286 vhCDR1
DYYMH

SEQ ID NO: 25797 - protein, 17 aa, Artificial Sequence
  Description of Artificial Sequence: Synthetic peptide
  XENP021286 vhCDR2
WIDPKNGDTEYAPKFQG

SEQ ID NO: 25798 - protein, 9 aa, Artificial Sequence
  Description of Artificial Sequence: Synthetic peptide
  XENP021286 vhCDR3
RGVRQALDY

SEQ ID NO: 25799 - protein, 214 aa, Artificial Sequence; identical to SEQ ID NO: 17250
  Description of Artificial Sequence: Synthetic polypeptide
  XENP021286 2A11_H1.59_L2_Fab Light Chain

SEQ ID NO: 25800 - protein, 107 aa, Artificial Sequence; identical to SEQ ID NO: 17251
  Description of Artificial Sequence: Synthetic polypeptide
  VL of XENP021286

SEQ ID NO: 25801 - protein, 11 aa, Artificial Sequence
  Description of Artificial Sequence: Synthetic peptide
  XENP021286 vlCDR1
QASQDIGNYLN

SEQ ID NO: 25802 - protein, 7 aa, Artificial Sequence
  Description of Artificial Sequence: Synthetic peptide
  XENP021286 vlCDR2
YTSRLHS

SEQ ID NO: 25803 - protein, 9 aa, Artificial Sequence
  Description of Artificial Sequence: Synthetic peptide
  XENP021286 vlCDR3
QQGNTLPYT

SEQ ID NO: 25804 - protein, 223 aa, Artificial Sequence
  Description of Artificial Sequence: Synthetic polypeptide
  XENP021287 2A11_H1.60_L2_Fab Heavy Chain
EVQLVQSGAEVKKPGATVKISCKASGFNIKDYYMHWVQQAPGKGLEWMGWIDPSNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25805 - protein, 118 aa, Artificial Sequence
  Description of Artificial Sequence: Synthetic polypeptide
  VH of XENP021287
EVQLVQSGAEVKKPGATVKISCKASGFNIKDYYMHWVQQAPGKGLEWMGWIDPSNGDTEYAPKFQGRVTITADTSTNTAYMELSSLRSEDTAVYYCYARGVRQALDYWGQGTLVTVSS

SEQ ID NO: 25806 - protein, 5 aa, Artificial Sequence
  Description of Artificial Sequence: Synthetic peptide
  XENP021287 vhCDR1
DYYMH

SEQ ID NO: 25807 - protein, 17 aa, Artificial Sequence
  Description of Artificial Sequence: Synthetic peptide
  XENP021287 vhCDR2
WIDPSNGDTEYAPKFQG

SEQ ID NO: 25808 - protein, 9 aa, Artificial Sequence
  Description of Artificial Sequence: Synthetic peptide
  XENP021287 vhCDR3
RGVRQALDY

SEQ ID NO: 25809 - protein, 214 aa, Artificial Sequence; identical to SEQ ID NO: 17250
  Description of Artificial Sequence: Synthetic polypeptide
  XENP021287 2A11_H1.60_L2_Fab Light Chain

SEQ ID NO: 25810 - protein, 107 aa, Artificial Sequence; identical to SEQ ID NO: 17251
  Description of Artificial Sequence: Synthetic polypeptide
  VL of XENP021287

SEQ ID NO: 25811 - protein, 11 aa, Artificial Sequence
  Description of Artificial Sequence: Synthetic peptide
  XENP021287 vlCDR1
QASQDIGNYLN

SEQ ID NO: 25812 - protein, 7 aa, Artificial Sequence
  Description of Artificial Sequence: Synthetic peptide
  XENP021287 vlCDR2
YTSRLHS

SEQ ID NO: 25813 - protein, 9 aa, Artificial Sequence
  Description of Artificial Sequence: Synthetic peptide
  XENP021287 vlCDR3
QQGNTLPYT

SEQ ID NO: 25814 - protein, 223 aa, Artificial Sequence
  Description of Artificial Sequence: Synthetic polypeptide
  XENP021288 2A11_H1.61_L2_Fab Heavy Chain
EVQLVQSGAEVKKPGATVKISCKASGFNIKDYYMHWVQQAPGKGLEWMGWIDPNNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25815 - protein, 118 aa, Artificial Sequence
  Description of Artificial Sequence: Synthetic polypeptide
  VH of XENP021288
EVQLVQSGAEVKKPGATVKISCKASGFNIKDYYMHWVQQAPGKGLEWMGWIDPNNGDTEYAPKFQGRVTITADTSTNTAYMELSSLRSEDTAVYYCYARGVRQALDYWGQGTLVTVSS

SEQ ID NO: 25816 - protein, 5 aa, Artificial Sequence
  Description of Artificial Sequence: Synthetic peptide
  XENP021288 vhCDR1
DYYMH

SEQ ID NO: 25817 - protein, 17 aa, Artificial Sequence
  Description of Artificial Sequence: Synthetic peptide
  XENP021288 vhCDR2
WIDPNNGDTEYAPKFQG

SEQ ID NO: 25818 - protein, 9 aa, Artificial Sequence
  Description of Artificial Sequence: Synthetic peptide
  XENP021288 vhCDR3
RGVRQALDY

SEQ ID NO: 25819 - protein, 214 aa, Artificial Sequence; identical to SEQ ID NO: 17250
  Description of Artificial Sequence: Synthetic polypeptide
  XENP021288 2A11_H1.61_L2_Fab Light Chain

SEQ ID NO: 25820 - protein, 107 aa, Artificial Sequence; identical to SEQ ID NO: 17251
  Description of Artificial Sequence: Synthetic polypeptide
  VL of XENP021288

SEQ ID NO: 25821 - protein, 11 aa, Artificial Sequence
  Description of Artificial Sequence: Synthetic peptide
  XENP021288 vlCDR1
QASQDIGNYLN

SEQ ID NO: 25822 - protein, 7 aa, Artificial Sequence
  Description of Artificial Sequence: Synthetic peptide
  XENP021288 vlCDR2
YTSRLHS

SEQ ID NO: 25823 - protein, 9 aa, Artificial Sequence
  Description of Artificial Sequence: Synthetic peptide
  XENP021288 vlCDR3
QQGNTLPYT

SEQ ID NO: 25824 - protein, 223 aa, Artificial Sequence
  Description of Artificial Sequence: Synthetic polypeptide
  XENP021289 2A11_H1.62_L2_Fab Heavy Chain
EVQLVQSGAEVKKPGATVKISCKASGFNIKDYYMHWVQQAPGKGLEWMGWIDPANGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25825 - protein, 118 aa, Artificial Sequence
  Description of Artificial Sequence: Synthetic polypeptide
  VH of XENP021289
EVQLVQSGAEVKKPGATVKISCKASGFNIKDYYMHWVQQAPGKGLEWMGWIDPANGDTEYAPKFQGRVTITADTSTNTAYMELSSLRSEDTAVYYCYARGVRQALDYWGQGTLVTVSS

SEQ ID NO: 25826 - protein, 5 aa, Artificial Sequence
  Description of Artificial Sequence: Synthetic peptide
  XENP021289 vhCDR1
DYYMH

SEQ ID NO: 25827 - protein, 17 aa, Artificial Sequence
  Description of Artificial Sequence: Synthetic peptide
  XENP021289 vhCDR2
WIDPANGDTEYAPKFQG

SEQ ID NO: 25828 - protein, 9 aa, Artificial Sequence
  Description of Artificial Sequence: Synthetic peptide
  XENP021289 vhCDR3
RGVRQALDY

SEQ ID NO: 25829 - protein, 214 aa, Artificial Sequence; identical to SEQ ID NO: 17250
  Description of Artificial Sequence: Synthetic polypeptide
  XENP021289 2A11_H1.62_L2_Fab Light Chain

SEQ ID NO: 25830 - protein, 107 aa, Artificial Sequence; identical to SEQ ID NO: 17251
  Description of Artificial Sequence: Synthetic polypeptide
  VL of XENP021289

SEQ ID NO: 25831 - protein, 11 aa, Artificial Sequence
  Description of Artificial Sequence: Synthetic peptide
  XENP021289 vlCDR1
QASQDIGNYLN

SEQ ID NO: 25832 - protein, 7 aa, Artificial Sequence
  Description of Artificial Sequence: Synthetic peptide
  XENP021289 vlCDR2
YTSRLHS

SEQ ID NO: 25833 - protein, 9 aa, Artificial Sequence
  Description of Artificial Sequence: Synthetic peptide
  XENP021289 vlCDR3
QQGNTLPYT

SEQ ID NO: 25834 - protein, 223 aa, Artificial Sequence
  Description of Artificial Sequence: Synthetic polypeptide
  XENP021290 2A11_H1.63_L2_Fab Heavy Chain
EVQLVQSGAEVKKPGATVKISCKASGFNIKDYYMHWVQQAPGKGLEWMGWIDPTNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25835 - protein, 118 aa, Artificial Sequence
  Description of Artificial Sequence: Synthetic polypeptide
  VH of XENP021290
EVQLVQSGAEVKKPGATVKISCKASGFNIKDYYMHWVQQAPGKGLEWMGWIDPTNGDTEYAPKFQGRVTITADTSTNTAYMELSSLRSEDTAVYYCYARGVRQALDYWGQGTLVTVSS

SEQ ID NO: 25836 - protein, 5 aa, Artificial Sequence
  Description of Artificial Sequence: Synthetic peptide
  XENP021290 vhCDR1
DYYMH

SEQ ID NO: 25837 - protein, 17 aa, Artificial Sequence
  Description of Artificial Sequence: Synthetic peptide
  XENP021290 vhCDR2
WIDPTNGDTEYAPKFQG

SEQ ID NO: 25838 - protein, 9 aa, Artificial Sequence
  Description of Artificial Sequence: Synthetic peptide
  XENP021290 vhCDR3
RGVRQALDY

SEQ ID NO: 25839 - protein, 214 aa, Artificial Sequence; identical to SEQ ID NO: 17250
  Description of Artificial Sequence: Synthetic polypeptide
  XENP021290 2A11_H1.63_L2_Fab Light Chain

SEQ ID NO: 25840 - protein, 107 aa, Artificial Sequence; identical to SEQ ID NO: 17251
  Description of Artificial Sequence: Synthetic polypeptide
  VL of XENP021290

SEQ ID NO: 25841 - protein, 11 aa, Artificial Sequence
  Description of Artificial Sequence: Synthetic peptide
  XENP021290 vlCDR1
QASQDIGNYLN

SEQ ID NO: 25842 - protein, 7 aa, Artificial Sequence
  Description of Artificial Sequence: Synthetic peptide
  XENP021290 vlCDR2
YTSRLHS

SEQ ID NO: 25843 - protein, 9 aa, Artificial Sequence
  Description of Artificial Sequence: Synthetic peptide
  XENP021290 vlCDR3
QQGNTLPYT

SEQ ID NO: 25844 - protein, 223 aa, Artificial Sequence
  Description of Artificial Sequence: Synthetic polypeptide
  XENP021291 2A11_H1.64_L2_Fab Heavy Chain
EVQLVQSGAEVKKPGATVKISCKASGFNIKDYYMHWVQQAPGKGLEWMGWIDPYNGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25845 - protein, 118 aa, Artificial Sequence
  Description of Artificial Sequence: Synthetic polypeptide
  VH of XENP021291
EVQLVQSGAEVKKPGATVKISCKASGFNIKDYYMHWVQQAPGKGLEWMGWIDPYNGDTEYAPKFQGRVTITADTSTNTAYMELSSLRSEDTAVYYCYARGVRQALDYWGQGTLVTVSS

SEQ ID NO: 25846 - protein, 5 aa, Artificial Sequence
  Description of Artificial Sequence: Synthetic peptide
  XENP021291 vhCDR1
DYYMH

SEQ ID NO: 25847 - protein, 17 aa, Artificial Sequence
  Description of Artificial Sequence: Synthetic peptide
  XENP021291 vhCDR2
WIDPYNGDTEYAPKFQG

SEQ ID NO: 25848 - protein, 9 aa, Artificial Sequence
  Description of Artificial Sequence: Synthetic peptide
  XENP021291 vhCDR3
RGVRQALDY

SEQ ID NO: 25849 - protein, 214 aa, Artificial Sequence; identical to SEQ ID NO: 17250
  Description of Artificial Sequence: Synthetic polypeptide
  XENP021291 2A11_H1.64_L2_Fab Light Chain

SEQ ID NO: 25850 - protein, 107 aa, Artificial Sequence; identical to SEQ ID NO: 17251
  Description of Artificial Sequence: Synthetic polypeptide
  VL of XENP021291

SEQ ID NO: 25851 - protein, 11 aa, Artificial Sequence
  Description of Artificial Sequence: Synthetic peptide
  XENP021291 vlCDR1
QASQDIGNYLN

SEQ ID NO: 25852 - protein, 7 aa, Artificial Sequence
  Description of Artificial Sequence: Synthetic peptide
  XENP021291 vlCDR2
YTSRLHS

SEQ ID NO: 25853 - protein, 9 aa, Artificial Sequence
  Description of Artificial Sequence: Synthetic peptide
  XENP021291 vlCDR3
QQGNTLPYT

SEQ ID NO: 25854 - protein, 223 aa, Artificial Sequence
  Description of Artificial Sequence: Synthetic polypeptide
  XENP021292 2A11_H1.65_L2_Fab Heavy Chain
EVQLVQSGAEVKKPGATVKISCKASGFNIKDYYMHWVQQAPGKGLEWMGWIDPEDGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25855 - protein, 118 aa, Artificial Sequence
  Description of Artificial Sequence: Synthetic polypeptide
  VH of XENP021292
EVQLVQSGAEVKKPGATVKISCKASGFNIKDYYMHWVQQAPGKGLEWMGWIDPEDGDTEYAPKFQGRVTITADTSTNTAYMELSSLRSEDTAVYYCYARGVRQALDYWGQGTLVTVSS

SEQ ID NO: 25856 - protein, 5 aa, Artificial Sequence
  Description of Artificial Sequence: Synthetic peptide
  XENP021292 vhCDR1
DYYMH

SEQ ID NO: 25857 - protein, 17 aa, Artificial Sequence
  Description of Artificial Sequence: Synthetic peptide
  XENP021292 vhCDR2
WIDPEDGDTEYAPKFQG

SEQ ID NO: 25858 - protein, 9 aa, Artificial Sequence
  Description of Artificial Sequence: Synthetic peptide
  XENP021292 vhCDR3
RGVRQALDY

SEQ ID NO: 25859 - protein, 214 aa, Artificial Sequence; identical to SEQ ID NO: 17250
  Description of Artificial Sequence: Synthetic polypeptide
  XENP021292 2A11_H1.65_L2_Fab Light Chain

SEQ ID NO: 25860 - protein, 107 aa, Artificial Sequence; identical to SEQ ID NO: 17251
  Description of Artificial Sequence: Synthetic polypeptide
  VL of XENP021292

SEQ ID NO: 25861 - protein, 11 aa, Artificial Sequence
  Description of Artificial Sequence: Synthetic peptide
  XENP021292 vlCDR1
QASQDIGNYLN

SEQ ID NO: 25862 - protein, 7 aa, Artificial Sequence
  Description of Artificial Sequence: Synthetic peptide
  XENP021292 vlCDR2
YTSRLHS

SEQ ID NO: 25863 - protein, 9 aa, Artificial Sequence
  Description of Artificial Sequence: Synthetic peptide
  XENP021292 vlCDR3
QQGNTLPYT

SEQ ID NO: 25864 - protein, 223 aa, Artificial Sequence
  Description of Artificial Sequence: Synthetic polypeptide
  XENP021293 2A11_H1.66_L2_Fab Heavy Chain
EVQLVQSGAEVKKPGATVKISCKASGFNIKDYYMHWVQQAPGKGLEWMGWIDPEHGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25865 - protein, 118 aa, Artificial Sequence
  Description of Artificial Sequence: Synthetic polypeptide
  VH of XENP021293
EVQLVQSGAEVKKPGATVKISCKASGFNIKDYYMHWVQQAPGKGLEWMGWIDPEHGDTEYAPKFQGRVTITADTSTNTAYMELSSLRSEDTAVYYCYARGVRQALDYWGQGTLVTVSS

SEQ ID NO: 25866 - protein, 5 aa, Artificial Sequence
  Description of Artificial Sequence: Synthetic peptide
  XENP021293 vhCDR1
DYYMH

SEQ ID NO: 25867 - protein, 17 aa, Artificial Sequence
  Description of Artificial Sequence: Synthetic peptide
  XENP021293 vhCDR2
WIDPEHGDTEYAPKFQG

SEQ ID NO: 25868 - protein, 9 aa, Artificial Sequence
  Description of Artificial Sequence: Synthetic peptide
  XENP021293 vhCDR3
RGVRQALDY

SEQ ID NO: 25869 - protein, 214 aa, Artificial Sequence; identical to SEQ ID NO: 17250
  Description of Artificial Sequence: Synthetic polypeptide
  XENP021293 2A11_H1.66_L2_Fab Light Chain

SEQ ID NO: 25870 - protein, 107 aa, Artificial Sequence; identical to SEQ ID NO: 17251
  Description of Artificial Sequence: Synthetic polypeptide
  VL of XENP021293

SEQ ID NO: 25871 - protein, 11 aa, Artificial Sequence
  Description of Artificial Sequence: Synthetic peptide
  XENP021293 vlCDR1
QASQDIGNYLN

SEQ ID NO: 25872 - protein, 7 aa, Artificial Sequence
  Description of Artificial Sequence: Synthetic peptide
  XENP021293 vlCDR2
YTSRLHS

SEQ ID NO: 25873 - protein, 9 aa, Artificial Sequence
  Description of Artificial Sequence: Synthetic peptide
  XENP021293 vlCDR3
QQGNTLPYT

SEQ ID NO: 25874 - protein, 223 aa, Artificial Sequence
  Description of Artificial Sequence: Synthetic polypeptide
  XENP021294 2A11_H1.67_L2_Fab Heavy Chain
EVQLVQSGAEVKKPGATVKISCKASGFNIKDYYMHWVQQAPGKGLEWMGWIDPEEGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25875 - protein, 118 aa, Artificial Sequence
  Description of Artificial Sequence: Synthetic polypeptide
  VH of XENP021294
EVQLVQSGAEVKKPGATVKISCKASGFNIKDYYMHWVQQAPGKGLEWMGWIDPEEGDTEYAPKFQGRVTITADTSTNTAYMELSSLRSEDTAVYYCYARGVRQALDYWGQGTLVTVSS

SEQ ID NO: 25876 - protein, 5 aa, Artificial Sequence
  Description of Artificial Sequence: Synthetic peptide
  XENP021294 vhCDR1
DYYMH

SEQ ID NO: 25877 - protein, 17 aa, Artificial Sequence
  Description of Artificial Sequence: Synthetic peptide
  XENP021294 vhCDR2
WIDPEEGDTEYAPKFQG

SEQ ID NO: 25878 - protein, 9 aa, Artificial Sequence
  Description of Artificial Sequence: Synthetic peptide
  XENP021294 vhCDR3
RGVRQALDY

SEQ ID NO: 25879 - protein, 214 aa, Artificial Sequence; identical to SEQ ID NO: 17250
  Description of Artificial Sequence: Synthetic polypeptide
  XENP021294 2A11_H1.67_L2_Fab Light Chain

SEQ ID NO: 25880 - protein, 107 aa, Artificial Sequence; identical to SEQ ID NO: 17251
  Description of Artificial Sequence: Synthetic polypeptide
  VL of XENP021294

SEQ ID NO: 25881 - protein, 11 aa, Artificial Sequence
  Description of Artificial Sequence: Synthetic peptide
  XENP021294 vlCDR1
QASQDIGNYLN

SEQ ID NO: 25882 - protein, 7 aa, Artificial Sequence
  Description of Artificial Sequence: Synthetic peptide
  XENP021294 vlCDR2
YTSRLHS

SEQ ID NO: 25883 - protein, 9 aa, Artificial Sequence
  Description of Artificial Sequence: Synthetic peptide
  XENP021294 vlCDR3
QQGNTLPYT

SEQ ID NO: 25884 - protein, 223 aa, Artificial Sequence
  Description of Artificial Sequence: Synthetic polypeptide
  XENP021295 2A11_H1.68_L2_Fab Heavy Chain
EVQLVQSGAEVKKPGATVKISCKASGFNIKDYYMHWVQQAPGKGLEWMGWIDPEQGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25885 - protein, 118 aa, Artificial Sequence
  Description of Artificial Sequence: Synthetic polypeptide
  VH of XENP021295
EVQLVQSGAEVKKPGATVKISCKASGFNIKDYYMHWVQQAPGKGLEWMGWIDPEQGDTEYAPKFQGRVTITADTSTNTAYMELSSLRSEDTAVYYCYARGVRQALDYWGQGTLVTVSS

SEQ ID NO: 25886 - protein, 5 aa, Artificial Sequence
  Description of Artificial Sequence: Synthetic peptide
  XENP021295 vhCDR1
DYYMH

SEQ ID NO: 25887 - protein, 17 aa, Artificial Sequence
  Description of Artificial Sequence: Synthetic peptide
  XENP021295 vhCDR2
WIDPEQGDTEYAPKFQG

SEQ ID NO: 25888 - protein, 9 aa, Artificial Sequence
  Description of Artificial Sequence: Synthetic peptide
  XENP021295 vhCDR3
RGVRQALDY

SEQ ID NO: 25889 - protein, 214 aa, Artificial Sequence; identical to SEQ ID NO: 17250
  Description of Artificial Sequence: Synthetic polypeptide
  XENP021295 2A11_H1.68_L2_Fab Light Chain

SEQ ID NO: 25890 - protein, 107 aa, Artificial Sequence; identical to SEQ ID NO: 17251
  Description of Artificial Sequence: Synthetic polypeptide
  VL of XENP021295

SEQ ID NO: 25891 - protein, 11 aa, Artificial Sequence
  Description of Artificial Sequence: Synthetic peptide
  XENP021295 vlCDR1
QASQDIGNYLN

SEQ ID NO: 25892 - protein, 7 aa, Artificial Sequence
  Description of Artificial Sequence: Synthetic peptide
  XENP021295 vlCDR2
YTSRLHS

SEQ ID NO: 25893 - protein, 9 aa, Artificial Sequence
  Description of Artificial Sequence: Synthetic peptide
  XENP021295 vlCDR3
QQGNTLPYT

SEQ ID NO: 25894 - protein, 223 aa, Artificial Sequence
  Description of Artificial Sequence: Synthetic polypeptide
  XENP021296 2A11_H1.69_L2_Fab Heavy Chain
EVQLVQSGAEVKKPGATVKISCKASGFNIKDYYMHWVQQAPGKGLEWMGWIDPERGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25895 - protein, 118 aa, Artificial Sequence
  Description of Artificial Sequence: Synthetic polypeptide
  VH of XENP021296
EVQLVQSGAEVKKPGATVKISCKASGFNIKDYYMHWVQQAPGKGLEWMGWIDPERGDTEYAPKFQGRVTITADTSTNTAYMELSSLRSEDTAVYYCYARGVRQALDYWGQGTLVTVSS

SEQ ID NO: 25896 - protein, 5 aa, Artificial Sequence
  Description of Artificial Sequence: Synthetic peptide
  XENP021296 vhCDR1
DYYMH

SEQ ID NO: 25897 - protein, 17 aa, Artificial Sequence
  Description of Artificial Sequence: Synthetic peptide
  XENP021296 vhCDR2
WIDPERGDTEYAPKFQG

SEQ ID NO: 25898 - protein, 9 aa, Artificial Sequence
  Description of Artificial Sequence: Synthetic peptide
  XENP021296 vhCDR3
RGVRQALDY

SEQ ID NO: 25899 - protein, 214 aa, Artificial Sequence; identical to SEQ ID NO: 17250
  Description of Artificial Sequence: Synthetic polypeptide
  XENP021296 2A11_H1.69_L2_Fab Light Chain

SEQ ID NO: 25900 - protein, 107 aa, Artificial Sequence; identical to SEQ ID NO: 17251
  Description of Artificial Sequence: Synthetic polypeptide
  VL of XENP021296

SEQ ID NO: 25901 - protein, 11 aa, Artificial Sequence
  Description of Artificial Sequence: Synthetic peptide
  XENP021296 vlCDR1
QASQDIGNYLN

SEQ ID NO: 25902 - protein, 7 aa, Artificial Sequence
  Description of Artificial Sequence: Synthetic peptide
  XENP021296 vlCDR2
YTSRLHS

SEQ ID NO: 25903 - protein, 9 aa, Artificial Sequence
  Description of Artificial Sequence: Synthetic peptide
  XENP021296 vlCDR3
QQGNTLPYT

SEQ ID NO: 25904 - protein, 223 aa, Artificial Sequence
  Description of Artificial Sequence: Synthetic polypeptide
  XENP021301 2A11_H1.70_L2_Fab Heavy Chain
EVQLVQSGAEVKKPGATVKISCKASGFNIKDYYMHWVQQAPGKGLEWMGWIDPELGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25905 - protein, 118 aa, Artificial Sequence
  Description of Artificial Sequence: Synthetic polypeptide
  VH of XENP021301
EVQLVQSGAEVKKPGATVKISCKASGFNIKDYYMHWVQQAPGKGLEWMGWIDPELGDTEYAPKFQGRVTITADTSTNTAYMELSSLRSEDTAVYYCYARGVRQALDYWGQGTLVTVSS

SEQ ID NO: 25906 - protein, 5 aa, Artificial Sequence
  Description of Artificial Sequence: Synthetic peptide
  XENP021301 vhCDR1
DYYMH

SEQ ID NO: 25907 - protein, 17 aa, Artificial Sequence
  Description of Artificial Sequence: Synthetic peptide
  XENP021301 vhCDR2
WIDPELGDTEYAPKFQG

SEQ ID NO: 25908 - protein, 9 aa, Artificial Sequence
  Description of Artificial Sequence: Synthetic peptide
  XENP021301 vhCDR3
RGVRQALDY

SEQ ID NO: 25909 - protein, 214 aa, Artificial Sequence; identical to SEQ ID NO: 17250
  Description of Artificial Sequence: Synthetic polypeptide
  XENP021301 2A11_H1.70_L2_Fab Light Chain

SEQ ID NO: 25910 - protein, 107 aa, Artificial Sequence; identical to SEQ ID NO: 17251
  Description of Artificial Sequence: Synthetic polypeptide
  VL of XENP021301

SEQ ID NO: 25911 - protein, 11 aa, Artificial Sequence
  Description of Artificial Sequence: Synthetic peptide
  XENP021301 vlCDR1
QASQDIGNYLN

SEQ ID NO: 25912 - protein, 7 aa, Artificial Sequence
  Description of Artificial Sequence: Synthetic peptide
  XENP021301 vlCDR2
YTSRLHS

SEQ ID NO: 25913 - protein, 9 aa, Artificial Sequence
  Description of Artificial Sequence: Synthetic peptide
  XENP021301 vlCDR3
QQGNTLPYT

SEQ ID NO: 25914 - protein, 223 aa, Artificial Sequence
  Description of Artificial Sequence: Synthetic polypeptide
  XENP021302 2A11_H1.71_L2_Fab Heavy Chain
EVQLVQSGAEVKKPGATVKISCKASGFNIKDYYMHWVQQAPGKGLEWMGWIDPETGDTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25915 - protein, 118 aa, Artificial Sequence
  Description of Artificial Sequence: Synthetic polypeptide
  VH of XENP021302
EVQLVQSGAEVKKPGATVKISCKASGFNIKDYYMHWVQQAPGKGLEWMGWIDPETGDTEYAPKFQGRVTITADTSTNTAYMELSSLRSEDTAVYYCYARGVRQALDYWGQGTLVTVSS

SEQ ID NO: 25916 - protein, 5 aa, Artificial Sequence
  Description of Artificial Sequence: Synthetic peptide
  XENP021302 vhCDR1
DYYMH

SEQ ID NO: 25917 - protein, 17 aa, Artificial Sequence
  Description of Artificial Sequence: Synthetic peptide
  XENP021302 vhCDR2
WIDPETGDTEYAPKFQG

SEQ ID NO: 25918 - protein, 9 aa, Artificial Sequence
  Description of Artificial Sequence: Synthetic peptide
  XENP021302 vhCDR3
RGVRQALDY

SEQ ID NO: 25919 - protein, 214 aa, Artificial Sequence; identical to SEQ ID NO: 17250
  Description of Artificial Sequence: Synthetic polypeptide
  XENP021302 2A11_H1.71_L2_Fab Light Chain

SEQ ID NO: 25920 - protein, 107 aa, Artificial Sequence; identical to SEQ ID NO: 17251
  Description of Artificial Sequence: Synthetic polypeptide
  VL of XENP021302

SEQ ID NO: 25921 - protein, 11 aa, Artificial Sequence
  Description of Artificial Sequence: Synthetic peptide
  XENP021302 vlCDR1
QASQDIGNYLN

SEQ ID NO: 25922 - protein, 7 aa, Artificial Sequence
  Description of Artificial Sequence: Synthetic peptide
  XENP021302 vlCDR2
YTSRLHS

SEQ ID NO: 25923 - protein, 9 aa, Artificial Sequence
  Description of Artificial Sequence: Synthetic peptide
  XENP021302 vlCDR3
QQGNTLPYT

SEQ ID NO: 25924 - protein, 223 aa, Artificial Sequence
  Description of Artificial Sequence: Synthetic polypeptide
  XENP021303 2A11_H1.72_L2_Fab Heavy Chain
EVQLVQSGAEVKKPGATVKISCKASGFNIKDYYMHWVQQAPGKGLEWMGWIDPENGNTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25925 - protein, 118 aa, Artificial Sequence
  Description of Artificial Sequence: Synthetic polypeptide
  VH of XENP021303
EVQLVQSGAEVKKPGATVKISCKASGFNIKDYYMHWVQQAPGKGLEWMGWIDPENGNTEYAPKFQGRVTITADTSTNTAYMELSSLRSEDTAVYYCYARGVRQALDYWGQGTLVTVSS

SEQ ID NO: 25926 - protein, 5 aa, Artificial Sequence
  Description of Artificial Sequence: Synthetic peptide
  XENP021303 vhCDR1
DYYMH

SEQ ID NO: 25927 - protein, 17 aa, Artificial Sequence
  Description of Artificial Sequence: Synthetic peptide
  XENP021303 vhCDR2
WIDPENGNTEYAPKFQG

SEQ ID NO: 25928 - protein, 9 aa, Artificial Sequence
  Description of Artificial Sequence: Synthetic peptide
  XENP021303 vhCDR3
RGVRQALDY

SEQ ID NO: 25929 - protein, 214 aa, Artificial Sequence; identical to SEQ ID NO: 17250
  Description of Artificial Sequence: Synthetic polypeptide
  XENP021303 2A11_H1.72_L2_Fab Light Chain

SEQ ID NO: 25930 - protein, 107 aa, Artificial Sequence; identical to SEQ ID NO: 17251
  Description of Artificial Sequence: Synthetic polypeptide
  VL of XENP021303

SEQ ID NO: 25931 - protein, 11 aa, Artificial Sequence
  Description of Artificial Sequence: Synthetic peptide
  XENP021303 vlCDR1
QASQDIGNYLN

SEQ ID NO: 25932 - protein, 7 aa, Artificial Sequence
  Description of Artificial Sequence: Synthetic peptide
  XENP021303 vlCDR2
YTSRLHS

SEQ ID NO: 25933 - protein, 9 aa, Artificial Sequence
  Description of Artificial Sequence: Synthetic peptide
  XENP021303 vlCDR3
QQGNTLPYT

SEQ ID NO: 25934 - protein, 223 aa, Artificial Sequence
  Description of Artificial Sequence: Synthetic polypeptide
  XENP021304 2A11_H1.73_L2_Fab Heavy Chain
EVQLVQSGAEVKKPGATVKISCKASGFNIKDYYMHWVQQAPGKGLEWMGWIDPENGETEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25935 - protein, 118 aa, Artificial Sequence
  Description of Artificial Sequence: Synthetic polypeptide
  VH of XENP021304
EVQLVQSGAEVKKPGATVKISCKASGFNIKDYYMHWVQQAPGKGLEWMGWIDPENGETEYAPKFQGRVTITADTSTNTAYMELSSLRSEDTAVYYCYARGVRQALDYWGQGTLVTVSS

SEQ ID NO: 25936 - protein, 5 aa, Artificial Sequence
  Description of Artificial Sequence: Synthetic peptide
  XENP021304 vhCDR1
DYYMH

SEQ ID NO: 25937 - protein, 17 aa, Artificial Sequence
  Description of Artificial Sequence: Synthetic peptide
  XENP021304 vhCDR2
WIDPENGETEYAPKFQG

SEQ ID NO: 25938 - protein, 9 aa, Artificial Sequence
  Description of Artificial Sequence: Synthetic peptide
  XENP021304 vhCDR3
RGVRQALDY

SEQ ID NO: 25939 - protein, 214 aa, Artificial Sequence; identical to SEQ ID NO: 17250
  Description of Artificial Sequence: Synthetic polypeptide
  XENP021304 2A11_H1.73_L2_Fab Light Chain

SEQ ID NO: 25940 - protein, 107 aa, Artificial Sequence; identical to SEQ ID NO: 17251
  Description of Artificial Sequence: Synthetic polypeptide
  VL of XENP021304

SEQ ID NO: 25941 - protein, 11 aa, Artificial Sequence
  Description of Artificial Sequence: Synthetic peptide
  XENP021304 vlCDR1
QASQDIGNYLN

SEQ ID NO: 25942 - protein, 7 aa, Artificial Sequence
  Description of Artificial Sequence: Synthetic peptide
  XENP021304 vlCDR2
YTSRLHS

SEQ ID NO: 25943 - protein, 9 aa, Artificial Sequence
  Description of Artificial Sequence: Synthetic peptide
  XENP021304 vlCDR3
QQGNTLPYT

SEQ ID NO: 25944 - protein, 223 aa, Artificial Sequence
  Description of Artificial Sequence: Synthetic polypeptide
  XENP021305 2A11_H1.74_L2_Fab Heavy Chain
EVQLVQSGAEVKKPGATVKISCKASGFNIKDYYMHWVQQAPGKGLEWMGWIDPENGHTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25945 - protein, 118 aa, Artificial Sequence
  Description of Artificial Sequence: Synthetic polypeptide
  VH of XENP021305
EVQLVQSGAEVKKPGATVKISCKASGFNIKDYYMHWVQQAPGKGLEWMGWIDPENGHTEYAPKFQGRVTITADTSTNTAYMELSSLRSEDTAVYYCYARGVRQALDYWGQGTLVTVSS

SEQ ID NO: 25946 - protein, 5 aa, Artificial Sequence
  Description of Artificial Sequence: Synthetic peptide
  XENP021305 vhCDR1
DYYMH

SEQ ID NO: 25947 - protein, 17 aa, Artificial Sequence
  Description of Artificial Sequence: Synthetic peptide
  XENP021305 vhCDR2
WIDPENGHTEYAPKFQG

SEQ ID NO: 25948 - protein, 9 aa, Artificial Sequence
  Description of Artificial Sequence: Synthetic peptide
  XENP021305 vhCDR3
RGVRQALDY

SEQ ID NO: 25949 - protein, 214 aa, Artificial Sequence; identical to SEQ ID NO: 17250
  Description of Artificial Sequence: Synthetic polypeptide
  XENP021305 2A11_H1.74_L2_Fab Light Chain

SEQ ID NO: 25950 - protein, 107 aa, Artificial Sequence; identical to SEQ ID NO: 17251
  Description of Artificial Sequence: Synthetic polypeptide
  VL of XENP021305

SEQ ID NO: 25951 - protein, 11 aa, Artificial Sequence
  Description of Artificial Sequence: Synthetic peptide
  XENP021305 vlCDR1
QASQDIGNYLN

SEQ ID NO: 25952 - protein, 7 aa, Artificial Sequence
  Description of Artificial Sequence: Synthetic peptide
  XENP021305 vlCDR2
YTSRLHS

SEQ ID NO: 25953 - protein, 9 aa, Artificial Sequence
  Description of Artificial Sequence: Synthetic peptide
  XENP021305 vlCDR3
QQGNTLPYT

SEQ ID NO: 25954 - protein, 223 aa, Artificial Sequence
  Description of Artificial Sequence: Synthetic polypeptide
  XENP021306 2A11_H1.75_L2_Fab Heavy Chain
EVQLVQSGAEVKKPGATVKISCKASGFNIKDYYMHWVQQAPGKGLEWMGWIDPENGQTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25955 - protein, 118 aa, Artificial Sequence
  Description of Artificial Sequence: Synthetic polypeptide
  VH of XENP021306
EVQLVQSGAEVKKPGATVKISCKASGFNIKDYYMHWVQQAPGKGLEWMGWIDPENGQTEYAPKFQGRVTITADTSTNTAYMELSSLRSEDTAVYYCYARGVRQALDYWGQGTLVTVSS

SEQ ID NO: 25956 - protein, 5 aa, Artificial Sequence
  Description of Artificial Sequence: Synthetic peptide
  XENP021306 vhCDR1
DYYMH

SEQ ID NO: 25957 - protein, 17 aa, Artificial Sequence
  Description of Artificial Sequence: Synthetic peptide
  XENP021306 vhCDR2
WIDPENGQTEYAPKFQG

SEQ ID NO: 25958 - protein, 9 aa, Artificial Sequence
  Description of Artificial Sequence: Synthetic peptide
  XENP021306 vhCDR3
RGVRQALDY

SEQ ID NO: 25959 - protein, 214 aa, Artificial Sequence; identical to SEQ ID NO: 17250
  Description of Artificial Sequence: Synthetic polypeptide
  XENP021306 2A11_H1.75_L2_Fab Light Chain

SEQ ID NO: 25960 - protein, 107 aa, Artificial Sequence; identical to SEQ ID NO: 17251
  Description of Artificial Sequence: Synthetic polypeptide
  VL of XENP021306

SEQ ID NO: 25961 - protein, 11 aa, Artificial Sequence
  Description of Artificial Sequence: Synthetic peptide
  XENP021306 vlCDR1
QASQDIGNYLN

SEQ ID NO: 25962 - protein, 7 aa, Artificial Sequence
  Description of Artificial Sequence: Synthetic peptide
  XENP021306 vlCDR2
YTSRLHS

SEQ ID NO: 25963 - protein, 9 aa, Artificial Sequence
  Description of Artificial Sequence: Synthetic peptide
  XENP021306 vlCDR3
QQGNTLPYT

SEQ ID NO: 25964 - protein, 223 aa, Artificial Sequence
  Description of Artificial Sequence: Synthetic polypeptide
  XENP021307 2A11_H1.76_L2_Fab Heavy Chain
EVQLVQSGAEVKKPGATVKISCKASGFNIKDYYMHWVQQAPGKGLEWMGWIDPENGLTEYAPKFQGRVTITADTSTNTAYMELSSLRSEDTAVYYCYARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25965 - protein, 118 aa, Artificial Sequence
  Description of Artificial Sequence: Synthetic polypeptide
  VH of XENP021307
EVQLVQSGAEVKKPGATVKISCKASGFNIKDYYMHWVQQAPGKGLEWMGWIDPENGLTEYAPKFQGRVTITADTSTNTAYMELSSLRSEDTAVYYCYARGVRQALDYWGQGTLVTVSS

SEQ ID NO: 25966 - protein, 5 aa, Artificial Sequence
  Description of Artificial Sequence: Synthetic peptide
  XENP021307 vhCDR1
DYYMH

SEQ ID NO: 25967 - protein, 17 aa, Artificial Sequence
  Description of Artificial Sequence: Synthetic peptide
  XENP021307 vhCDR2
WIDPENGLTEYAPKFQG

SEQ ID NO: 25968 - protein, 9 aa, Artificial Sequence
  Description of Artificial Sequence: Synthetic peptide
  XENP021307 vhCDR3
RGVRQALDY

SEQ ID NO: 25969 - protein, 214 aa, Artificial Sequence; identical to SEQ ID NO: 17250
  Description of Artificial Sequence: Synthetic polypeptide
  XENP021307 2A11_H1.76_L2_Fab Light Chain

SEQ ID NO: 25970 - protein, 107 aa, Artificial Sequence; identical to SEQ ID NO: 17251
  Description of Artificial Sequence: Synthetic polypeptide
  VL of XENP021307

SEQ ID NO: 25971 - protein, 11 aa, Artificial Sequence
  Description of Artificial Sequence: Synthetic peptide
  XENP021307 vlCDR1
QASQDIGNYLN

SEQ ID NO: 25972 - protein, 7 aa, Artificial Sequence
  Description of Artificial Sequence: Synthetic peptide
  XENP021307 vlCDR2
YTSRLHS

SEQ ID NO: 25973 - protein, 9 aa, Artificial Sequence
  Description of Artificial Sequence: Synthetic peptide
  XENP021307 vlCDR3
QQGNTLPYT

SEQ ID NO: 25974 - protein, 223 aa, Artificial Sequence
  Description of Artificial Sequence: Synthetic polypeptide
  XENP021308 2A11_H1.77_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCNARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25975 - protein, 118 aa, Artificial Sequence
  Description of Artificial Sequence: Synthetic polypeptide
  VH of XENP021308
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCNARGVRQALDYWGQGTLVTVSS

SEQ ID NO: 25976 - protein, 5 aa, Artificial Sequence
  Description of Artificial Sequence: Synthetic peptide
  XENP021308 vhCDR1
DYYMH

SEQ ID NO: 25977 - protein, 17 aa, Artificial Sequence
  Description of Artificial Sequence: Synthetic peptide
  XENP021308 vhCDR2
WIDPENGDTEYAPKFQG

SEQ ID NO: 25978 - protein, 9 aa, Artificial Sequence
  Description of Artificial Sequence: Synthetic peptide
  XENP021308 vhCDR3
RGVRQALDY

SEQ ID NO: 25979 - protein, 214 aa, Artificial Sequence; identical to SEQ ID NO: 17250
  Description of Artificial Sequence: Synthetic polypeptide
  XENP021308 2A11_H1.77_L2_Fab Light Chain

SEQ ID NO: 25980 - protein, 107 aa, Artificial Sequence; identical to SEQ ID NO: 17251
  Description of Artificial Sequence: Synthetic polypeptide
  VL of XENP021308

SEQ ID NO: 25981 - protein, 11 aa, Artificial Sequence
  Description of Artificial Sequence: Synthetic peptide
  XENP021308 vlCDR1
QASQDIGNYLN

SEQ ID NO: 25982 - protein, 7 aa, Artificial Sequence
  Description of Artificial Sequence: Synthetic peptide
  XENP021308 vlCDR2
YTSRLHS

SEQ ID NO: 25983 - protein, 9 aa, Artificial Sequence
  Description of Artificial Sequence: Synthetic peptide
  XENP021308 vlCDR3
QQGNTLPYT

SEQ ID NO: 25984 - protein, 223 aa, Artificial Sequence
  Description of Artificial Sequence: Synthetic polypeptide
  XENP021309 2A11_H1.78_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCQARGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25985 - protein, 118 aa, Artificial Sequence
  Description of Artificial Sequence: Synthetic polypeptide
  VH of XENP021309
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCQARGVRQALDYWGQGTLVTVSS

SEQ ID NO: 25986 - protein, 5 aa, Artificial Sequence
  Description of Artificial Sequence: Synthetic peptide
  XENP021309 vhCDR1
DYYMH

SEQ ID NO: 25987 - protein, 17 aa, Artificial Sequence
  Description of Artificial Sequence: Synthetic peptide
  XENP021309 vhCDR2
WIDPENGDTEYAPKFQG

SEQ ID NO: 25988 - protein, 9 aa, Artificial Sequence
  Description of Artificial Sequence: Synthetic peptide
  XENP021309 vhCDR3
RGVRQALDY

SEQ ID NO: 25989 - protein, 214 aa, Artificial Sequence; identical to SEQ ID NO: 17250
  Description of Artificial Sequence: Synthetic polypeptide
  XENP021309 2A11_H1.78_L2_Fab Light Chain

SEQ ID NO: 25990 - protein, 107 aa, Artificial Sequence; identical to SEQ ID NO: 17251
  Description of Artificial Sequence: Synthetic polypeptide
  VL of XENP021309

SEQ ID NO: 25991 - protein, 11 aa, Artificial Sequence
  Description of Artificial Sequence: Synthetic peptide
  XENP021309 vlCDR1
QASQDIGNYLN

SEQ ID NO: 25992 - protein, 7 aa, Artificial Sequence
  Description of Artificial Sequence: Synthetic peptide
  XENP021309 vlCDR2
YTSRLHS

SEQ ID NO: 25993 - protein, 9 aa, Artificial Sequence
  Description of Artificial Sequence: Synthetic peptide
  XENP021309 vlCDR3
QQGNTLPYT

SEQ ID NO: 25994 - protein, 223 aa, Artificial Sequence
  Description of Artificial Sequence: Synthetic polypeptide
  XENP021310 2A11_H1.79_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYIRGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 25995 - protein, 118 aa, Artificial Sequence
  Description of Artificial Sequence: Synthetic polypeptide
  VH of XENP021310
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYIRGVRQALDYWGQGTLVTVSS

SEQ ID NO: 25996 - protein, 5 aa, Artificial Sequence
  Description of Artificial Sequence: Synthetic peptide
  XENP021310 vhCDR1
DYYMH

SEQ ID NO: 25997 - protein, 17 aa, Artificial Sequence
  Description of Artificial Sequence: Synthetic peptide
  XENP021310 vhCDR2
WIDPENGDTEYAPKFQG

SEQ ID NO: 25998 - protein, 9 aa, Artificial Sequence
  Description of Artificial Sequence: Synthetic peptide
  XENP021310 vhCDR3
RGVRQALDY

SEQ ID NO: 25999 - protein, 214 aa, Artificial Sequence; identical to SEQ ID NO: 17250
  Description of Artificial Sequence: Synthetic polypeptide
  XENP021310 2A11_H1.79_L2_Fab Light Chain

SEQ ID NO: 26000 - protein, 107 aa, Artificial Sequence; identical to SEQ ID NO: 17251
  Description of Artificial Sequence: Synthetic polypeptide
  VL of XENP021310

SEQ ID NO: 26001 - protein, 11 aa, Artificial Sequence
  Description of Artificial Sequence: Synthetic peptide
  XENP021310 vlCDR1
QASQDIGNYLN

SEQ ID NO: 26002 - protein, 7 aa, Artificial Sequence
  Description of Artificial Sequence: Synthetic peptide
  XENP021310 vlCDR2
YTSRLHS

SEQ ID NO: 26003 - protein, 9 aa, Artificial Sequence
  Description of Artificial Sequence: Synthetic peptide
  XENP021310 vlCDR3
QQGNTLPYT

SEQ ID NO: 26004 - protein, 223 aa, Artificial Sequence
  Description of Artificial Sequence: Synthetic polypeptide
  XENP021311 2A11_H1.80_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYLRGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26005 - protein, 118 aa, Artificial Sequence
  Description of Artificial Sequence: Synthetic polypeptide
  VH of XENP021311
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYLRGVRQALDYWGQGTLVTVSS

SEQ ID NO: 26006 - protein, 5 aa, Artificial Sequence
  Description of Artificial Sequence: Synthetic peptide
  XENP021311 vhCDR1
DYYMH

SEQ ID NO: 26007 - protein, 17 aa, Artificial Sequence
  Description of Artificial Sequence: Synthetic peptide
  XENP021311 vhCDR2
WIDPENGDTEYAPKFQG

SEQ ID NO: 26008 - protein, 9 aa, Artificial Sequence
  Description of Artificial Sequence: Synthetic peptide
  XENP021311 vhCDR3
RGVRQALDY

SEQ ID NO: 26009 - protein, 214 aa, Artificial Sequence; identical to SEQ ID NO: 17250
  Description of Artificial Sequence: Synthetic polypeptide
  XENP021311 2A11_H1.80_L2_Fab Light Chain

SEQ ID NO: 26010 - protein, 107 aa, Artificial Sequence; identical to SEQ ID NO: 17251
  Description of Artificial Sequence: Synthetic polypeptide
  VL of XENP021311

SEQ ID NO: 26011 - protein, 11 aa, Artificial Sequence
  Description of Artificial Sequence: Synthetic peptide
  XENP021311 vlCDR1
QASQDIGNYLN

SEQ ID NO: 26012 - protein, 7 aa, Artificial Sequence
  Description of Artificial Sequence: Synthetic peptide
  XENP021311 vlCDR2
YTSRLHS

SEQ ID NO: 26013 - protein, 9 aa, Artificial Sequence
  Description of Artificial Sequence: Synthetic peptide
  XENP021311 vlCDR3
QQGNTLPYT

SEQ ID NO: 26014 - protein, 223 aa, Artificial Sequence
  Description of Artificial Sequence: Synthetic polypeptide
  XENP021312 2A11_H1.81_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYVRGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26015 - protein, 118 aa, Artificial Sequence
  Description of Artificial Sequence: Synthetic polypeptide
  VH of XENP021312
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYVRGVRQALDYWGQGTLVTVSS

SEQ ID NO: 26016 - protein, 5 aa, Artificial Sequence
  Description of Artificial Sequence: Synthetic peptide
  XENP021312 vhCDR1
DYYMH

SEQ ID NO: 26017 - protein, 17 aa, Artificial Sequence
  Description of Artificial Sequence: Synthetic peptide
  XENP021312 vhCDR2
WIDPENGDTEYAPKFQG

SEQ ID NO: 26018 - protein, 9 aa, Artificial Sequence
  Description of Artificial Sequence: Synthetic peptide
  XENP021312 vhCDR3
RGVRQALDY

SEQ ID NO: 26019 - protein, 214 aa, Artificial Sequence; identical to SEQ ID NO: 17250
  Description of Artificial Sequence: Synthetic polypeptide
  XENP021312 2A11_H1.81_L2_Fab Light Chain

SEQ ID NO: 26020 - protein, 107 aa, Artificial Sequence; identical to SEQ ID NO: 17251
  Description of Artificial Sequence: Synthetic polypeptide
  VL of XENP021312

SEQ ID NO: 26021 - protein, 11 aa, Artificial Sequence
  Description of Artificial Sequence: Synthetic peptide
  XENP021312 vlCDR1
QASQDIGNYLN

SEQ ID NO: 26022 - protein, 7 aa, Artificial Sequence
  Description of Artificial Sequence: Synthetic peptide
  XENP021312 vlCDR2
YTSRLHS

SEQ ID NO: 26023 - protein, 9 aa, Artificial Sequence
  Description of Artificial Sequence: Synthetic peptide
  XENP021312 vlCDR3
QQGNTLPYT

SEQ ID NO: 26024 - protein, 223 aa, Artificial Sequence
  Description of Artificial Sequence: Synthetic polypeptide
  XENP021313 2A11_H1.82_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAKGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26025 - protein, 118 aa, Artificial Sequence
  Description of Artificial Sequence: Synthetic polypeptide
  VH of XENP021313
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAKGVRQALDYWGQGTLVTVSS

SEQ ID NO: 26026 - protein, 5 aa, Artificial Sequence
  Description of Artificial Sequence: Synthetic peptide
  XENP021313 vhCDR1
DYYMH

SEQ ID NO: 26027 - protein, 17 aa, Artificial Sequence
  Description of Artificial Sequence: Synthetic peptide
  XENP021313 vhCDR2
WIDPENGDTEYAPKFQG

SEQ ID NO: 26028 - protein, 9 aa, Artificial Sequence
  Description of Artificial Sequence: Synthetic peptide
  XENP021313 vhCDR3
KGVRQALDY

SEQ ID NO: 26029 - protein, 214 aa, Artificial Sequence; identical to SEQ ID NO: 17250
  Description of Artificial Sequence: Synthetic polypeptide
  XENP021313 2A11_H1.82_L2_Fab Light Chain

SEQ ID NO: 26030 - protein, 107 aa, Artificial Sequence; identical to SEQ ID NO: 17251
  Description of Artificial Sequence: Synthetic polypeptide
  VL of XENP021313

SEQ ID NO: 26031 - protein, 11 aa, Artificial Sequence
  Description of Artificial Sequence: Synthetic peptide
  XENP021313 vlCDR1
QASQDIGNYLN

SEQ ID NO: 26032 - protein, 7 aa, Artificial Sequence
  Description of Artificial Sequence: Synthetic peptide
  XENP021313 vlCDR2
YTSRLHS

SEQ ID NO: 26033 - protein, 9 aa, Artificial Sequence
  Description of Artificial Sequence: Synthetic peptide
  XENP021313 vlCDR3
QQGNTLPYT

SEQ ID NO: 26034 - protein, 223 aa, Artificial Sequence
  Description of Artificial Sequence: Synthetic polypeptide
  XENP021314 2A11_H1.83_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAEGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26035 - protein, 118 aa, Artificial Sequence
  Description of Artificial Sequence: Synthetic polypeptide
  VH of XENP021314
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAEGVRQALDYWGQGTLVTVSS

SEQ ID NO: 26036 - protein, 5 aa, Artificial Sequence
  Description of Artificial Sequence: Synthetic peptide
  XENP021314 vhCDR1
DYYMH

SEQ ID NO: 26037 - protein, 17 aa, Artificial Sequence
  Description of Artificial Sequence: Synthetic peptide
  XENP021314 vhCDR2
WIDPENGDTEYAPKFQG

SEQ ID NO: 26038 - protein, 9 aa, Artificial Sequence
  Description of Artificial Sequence: Synthetic peptide
  XENP021314 vhCDR3
EGVRQALDY

SEQ ID NO: 26039 - protein, 214 aa, Artificial Sequence; identical to SEQ ID NO: 17250
  Description of Artificial Sequence: Synthetic polypeptide
  XENP021314 2A11_H1.83_L2_Fab Light Chain

SEQ ID NO: 26040 - protein, 107 aa, Artificial Sequence; identical to SEQ ID NO: 17251
  Description of Artificial Sequence: Synthetic polypeptide
  VL of XENP021314

SEQ ID NO: 26041 - protein, 11 aa, Artificial Sequence
  Description of Artificial Sequence: Synthetic peptide
  XENP021314 vlCDR1
QASQDIGNYLN

SEQ ID NO: 26042 - protein, 7 aa, Artificial Sequence
  Description of Artificial Sequence: Synthetic peptide
  XENP021314 vlCDR2
YTSRLHS

SEQ ID NO: 26043 - protein, 9 aa, Artificial Sequence
  Description of Artificial Sequence: Synthetic peptide
  XENP021314 vlCDR3
QQGNTLPYT

SEQ ID NO: 26044 - protein, 223 aa, Artificial Sequence
  Description of Artificial Sequence: Synthetic polypeptide
  XENP021315 2A11_H1.84_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAYGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26045 - protein, 118 aa, Artificial Sequence
  Description of Artificial Sequence: Synthetic polypeptide
  VH of XENP021315
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAYGVRQALDYWGQGTLVTVSS

SEQ ID NO: 26046 - protein, 5 aa, Artificial Sequence
  Description of Artificial Sequence: Synthetic peptide
  XENP021315 vhCDR1
DYYMH

SEQ ID NO: 26047 - protein, 17 aa, Artificial Sequence
  Description of Artificial Sequence: Synthetic peptide
  XENP021315 vhCDR2
WIDPENGDTEYAPKFQG

SEQ ID NO: 26048 - protein, 9 aa, Artificial Sequence
  Description of Artificial Sequence: Synthetic peptide
  XENP021315 vhCDR3
YGVRQALDY

SEQ ID NO: 26049 - protein, 214 aa, Artificial Sequence; identical to SEQ ID NO: 17250
  Description of Artificial Sequence: Synthetic polypeptide
  XENP021315 2A11_H1.84_L2_Fab Light Chain

SEQ ID NO: 26050 - protein, 107 aa, Artificial Sequence; identical to SEQ ID NO: 17251
  Description of Artificial Sequence: Synthetic polypeptide
  VL of XENP021315

SEQ ID NO: 26051 - protein, 11 aa, Artificial Sequence
  Description of Artificial Sequence: Synthetic peptide
  XENP021315 vlCDR1
QASQDIGNYLN

SEQ ID NO: 26052 - protein, 7 aa, Artificial Sequence
  Description of Artificial Sequence: Synthetic peptide
  XENP021315 vlCDR2
YTSRLHS

SEQ ID NO: 26053 - protein, 9 aa, Artificial Sequence
  Description of Artificial Sequence: Synthetic peptide
  XENP021315 vlCDR3
QQGNTLPYT

SEQ ID NO: 26054 - protein, 223 aa, Artificial Sequence
  Description of Artificial Sequence: Synthetic polypeptide
  XENP021316 2A11_H1.85_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAQGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26055 - protein, 118 aa, Artificial Sequence
  Description of Artificial Sequence: Synthetic polypeptide
  VH of XENP021316
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAQGVRQALDYWGQGTLVTVSS

SEQ ID NO: 26056 - protein, 5 aa, Artificial Sequence
  Description of Artificial Sequence: Synthetic peptide
  XENP021316 vhCDR1
DYYMH

SEQ ID NO: 26057 - protein, 17 aa, Artificial Sequence
  Description of Artificial Sequence: Synthetic peptide
  XENP021316 vhCDR2
WIDPENGDTEYAPKFQG

SEQ ID NO: 26058 - protein, 9 aa, Artificial Sequence
  Description of Artificial Sequence: Synthetic peptide
  XENP021316 vhCDR3
QGVRQALDY

SEQ ID NO: 26059 - protein, 214 aa, Artificial Sequence; identical to SEQ ID NO: 17250
  Description of Artificial Sequence: Synthetic polypeptide
  XENP021316 2A11_H1.85_L2_Fab Light Chain

SEQ ID NO: 26060 - protein, 107 aa, Artificial Sequence; identical to SEQ ID NO: 17251
  Description of Artificial Sequence: Synthetic polypeptide
  VL of XENP021316

SEQ ID NO: 26061 - protein, 11 aa, Artificial Sequence
  Description of Artificial Sequence: Synthetic peptide
  XENP021316 vlCDR1
QASQDIGNYLN

SEQ ID NO: 26062 - protein, 7 aa, Artificial Sequence
  Description of Artificial Sequence: Synthetic peptide
  XENP021316 vlCDR2
YTSRLHS

SEQ ID NO: 26063 - protein, 9 aa, Artificial Sequence
  Description of Artificial Sequence: Synthetic peptide
  XENP021316 vlCDR3
QQGNTLPYT

SEQ ID NO: 26064 - protein, 223 aa, Artificial Sequence
  Description of Artificial Sequence: Synthetic polypeptide
  XENP021317 2A11_H1.86_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYATGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26065 - protein, 118 aa, Artificial Sequence
  Description of Artificial Sequence: Synthetic polypeptide
  VH of XENP021317
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYATGVRQALDYWGQGTLVTVSS

SEQ ID NO: 26066 - protein, 5 aa, Artificial Sequence
  Description of Artificial Sequence: Synthetic peptide
  XENP021317 vhCDR1
DYYMH

SEQ ID NO: 26067 - protein, 17 aa, Artificial Sequence
  Description of Artificial Sequence: Synthetic peptide
  XENP021317 vhCDR2
WIDPENGDTEYAPKFQG

SEQ ID NO: 26068 - protein, 9 aa, Artificial Sequence
  Description of Artificial Sequence: Synthetic peptide
  XENP021317 vhCDR3
TGVRQALDY

SEQ ID NO: 26069 - protein, 214 aa, Artificial Sequence; identical to SEQ ID NO: 17250
  Description of Artificial Sequence: Synthetic polypeptide
  XENP021317 2A11_H1.86_L2_Fab Light Chain

SEQ ID NO: 26070 - protein, 107 aa, Artificial Sequence; identical to SEQ ID NO: 17251
  Description of Artificial Sequence: Synthetic polypeptide
  VL of XENP021317

SEQ ID NO: 26071 - protein, 11 aa, Artificial Sequence
  Description of Artificial Sequence: Synthetic peptide
  XENP021317 vlCDR1
QASQDIGNYLN

SEQ ID NO: 26072 - protein, 7 aa, Artificial Sequence
  Description of Artificial Sequence: Synthetic peptide
  XENP021317 vlCDR2
YTSRLHS

SEQ ID NO: 26073 - protein, 9 aa, Artificial Sequence
  Description of Artificial Sequence: Synthetic peptide
  XENP021317 vlCDR3
QQGNTLPYT

SEQ ID NO: 26074 - protein, 223 aa, Artificial Sequence
  Description of Artificial Sequence: Synthetic polypeptide
  XENP021318 2A11_H1.87_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAAGVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26075 - protein, 118 aa, Artificial Sequence
  Description of Artificial Sequence: Synthetic polypeptide
  VH of XENP021318
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYAAGVRQALDYWGQGTLVTVSS

SEQ ID NO: 26076 - protein, 5 aa, Artificial Sequence
  Description of Artificial Sequence: Synthetic peptide
  XENP021318 vhCDR1
DYYMH

SEQ ID NO: 26077 - protein, 17 aa, Artificial Sequence
  Description of Artificial Sequence: Synthetic peptide
  XENP021318 vhCDR2
WIDPENGDTEYAPKFQG

SEQ ID NO: 26078 - protein, 9 aa, Artificial Sequence
  Description of Artificial Sequence: Synthetic peptide
  XENP021318 vhCDR3
AGVRQALDY

SEQ ID NO: 26079 - protein, 214 aa, Artificial Sequence; identical to SEQ ID NO: 17250
  Description of Artificial Sequence: Synthetic polypeptide
  XENP021318 2A11_H1.87_L2_Fab Light Chain

SEQ ID NO: 26080 - protein, 107 aa, Artificial Sequence; identical to SEQ ID NO: 17251
  Description of Artificial Sequence: Synthetic polypeptide
  VL of XENP021318

SEQ ID NO: 26081 - protein, 11 aa, Artificial Sequence
  Description of Artificial Sequence: Synthetic peptide
  XENP021318 vlCDR1
QASQDIGNYLN

SEQ ID NO: 26082 - protein, 7 aa, Artificial Sequence
  Description of Artificial Sequence: Synthetic peptide
  XENP021318 vlCDR2
YTSRLHS

SEQ ID NO: 26083 - protein, 9 aa, Artificial Sequence
  Description of Artificial Sequence: Synthetic peptide
  XENP021318 vlCDR3
QQGNTLPYT

SEQ ID NO: 26084 - protein, 223 aa, Artificial Sequence
  Description of Artificial Sequence: Synthetic polypeptide
  XENP021319 2A11_H1.88_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARPVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26085 - protein, 118 aa, Artificial Sequence
  Description of Artificial Sequence: Synthetic polypeptide
  VH of XENP021319
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARPVRQALDYWGQGTLVTVSS

SEQ ID NO: 26086 - protein, 5 aa, Artificial Sequence
  Description of Artificial Sequence: Synthetic peptide
  XENP021319 vhCDR1
DYYMH

SEQ ID NO: 26087 - protein, 17 aa, Artificial Sequence
  Description of Artificial Sequence: Synthetic peptide
  XENP021319 vhCDR2
WIDPENGDTEYAPKFQG

SEQ ID NO: 26088 - protein, 9 aa, Artificial Sequence
  Description of Artificial Sequence: Synthetic peptide
  XENP021319 vhCDR3
RPVRQALDY

SEQ ID NO: 26089 - protein, 214 aa, Artificial Sequence; identical to SEQ ID NO: 17250
  Description of Artificial Sequence: Synthetic polypeptide
  XENP021319 2A11_H1.88_L2_Fab Light Chain

SEQ ID NO: 26090 - protein, 107 aa, Artificial Sequence; identical to SEQ ID NO: 17251
  Description of Artificial Sequence: Synthetic polypeptide
  VL of XENP021319

SEQ ID NO: 26091 - protein, 11 aa, Artificial Sequence
  Description of Artificial Sequence: Synthetic peptide
  XENP021319 vlCDR1
QASQDIGNYLN

SEQ ID NO: 26092 - protein, 7 aa, Artificial Sequence
  Description of Artificial Sequence: Synthetic peptide
  XENP021319 vlCDR2
YTSRLHS

SEQ ID NO: 26093 - protein, 9 aa, Artificial Sequence
  Description of Artificial Sequence: Synthetic peptide
  XENP021319 vlCDR3
QQGNTLPYT

SEQ ID NO: 26094 - protein, 223 aa, Artificial Sequence
  Description of Artificial Sequence: Synthetic polypeptide
  XENP021320 2A11_H1.89_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARAVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26095 - protein, 118 aa, Artificial Sequence
  Description of Artificial Sequence: Synthetic polypeptide
  VH of XENP021320
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARAVRQALDYWGQGTLVTVSS

SEQ ID NO: 26096 - protein, 5 aa, Artificial Sequence
  Description of Artificial Sequence: Synthetic peptide
  XENP021320 vhCDR1
DYYMH

SEQ ID NO: 26097 - protein, 17 aa, Artificial Sequence
  Description of Artificial Sequence: Synthetic peptide
  XENP021320 vhCDR2
WIDPENGDTEYAPKFQG

SEQ ID NO: 26098 - protein, 9 aa, Artificial Sequence
  Description of Artificial Sequence: Synthetic peptide
  XENP021320 vhCDR3
RAVRQALDY

SEQ ID NO: 26099 - protein, 214 aa, Artificial Sequence; identical to SEQ ID NO: 17250
  Description of Artificial Sequence: Synthetic polypeptide
  XENP021320 2A11_H1.89_L2_Fab Light Chain

SEQ ID NO: 26100 - protein, 107 aa, Artificial Sequence; identical to SEQ ID NO: 17251
  Description of Artificial Sequence: Synthetic polypeptide
  VL of XENP021320

SEQ ID NO: 26101 - protein, 11 aa, Artificial Sequence
  Description of Artificial Sequence: Synthetic peptide
  XENP021320 vlCDR1
QASQDIGNYLN

SEQ ID NO: 26102 - protein, 7 aa, Artificial Sequence
  Description of Artificial Sequence: Synthetic peptide
  XENP021320 vlCDR2
YTSRLHS

SEQ ID NO: 26103 - protein, 9 aa, Artificial Sequence
  Description of Artificial Sequence: Synthetic peptide
  XENP021320 vlCDR3
QQGNTLPYT

SEQ ID NO: 26104 - protein, 223 aa, Artificial Sequence
  Description of Artificial Sequence: Synthetic polypeptide
  XENP021321 2A11_H1.90_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARSVRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26105 - protein, 118 aa, Artificial Sequence
  Description of Artificial Sequence: Synthetic polypeptide
  VH of XENP021321
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARSVRQALDYWGQGTLVTVSS

SEQ ID NO: 26106 - protein, 5 aa, Artificial Sequence
  Description of Artificial Sequence: Synthetic peptide
  XENP021321 vhCDR1
DYYMH

SEQ ID NO: 26107 - protein, 17 aa, Artificial Sequence
  Description of Artificial Sequence: Synthetic peptide
  XENP021321 vhCDR2
WIDPENGDTEYAPKFQG

SEQ ID NO: 26108 - protein, 9 aa, Artificial Sequence
  Description of Artificial Sequence: Synthetic peptide
  XENP021321 vhCDR3
RSVRQALDY

SEQ ID NO: 26109 - protein, 214 aa, Artificial Sequence; identical to SEQ ID NO: 17250
  Description of Artificial Sequence: Synthetic polypeptide
  XENP021321 2A11_H1.90_L2_Fab Light Chain

SEQ ID NO: 26110 - protein, 107 aa, Artificial Sequence; identical to SEQ ID NO: 17251
  Description of Artificial Sequence: Synthetic polypeptide
  VL of XENP021321

SEQ ID NO: 26111 - protein, 11 aa, Artificial Sequence
  Description of Artificial Sequence: Synthetic peptide
  XENP021321 vlCDR1
QASQDIGNYLN

SEQ ID NO: 26112 - protein, 7 aa, Artificial Sequence
  Description of Artificial Sequence: Synthetic peptide
  XENP021321 vlCDR2
YTSRLHS

SEQ ID NO: 26113 - protein, 9 aa, Artificial Sequence
  Description of Artificial Sequence: Synthetic peptide
  XENP021321 vlCDR3
QQGNTLPYT

SEQ ID NO: 26114 - protein, 223 aa, Artificial Sequence
  Description of Artificial Sequence: Synthetic polypeptide
  XENP021322 2A11_H1.91_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGTRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26115 - protein, 118 aa, Artificial Sequence
  Description of Artificial Sequence: Synthetic polypeptide
  VH of XENP021322
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGTRQALDYWGQGTLVTVSS

SEQ ID NO: 26116 - protein, 5 aa, Artificial Sequence
  Description of Artificial Sequence: Synthetic peptide
  XENP021322 vhCDR1
DYYMH

SEQ ID NO: 26117 - protein, 17 aa, Artificial Sequence
  Description of Artificial Sequence: Synthetic peptide
  XENP021322 vhCDR2
WIDPENGDTEYAPKFQG

SEQ ID NO: 26118 - protein, 9 aa, Artificial Sequence
  Description of Artificial Sequence: Synthetic peptide
  XENP021322 vhCDR3
RGTRQALDY

SEQ ID NO: 26119 - protein, 214 aa, Artificial Sequence; identical to SEQ ID NO: 17250
  Description of Artificial Sequence: Synthetic polypeptide
  XENP021322 2A11_H1.91_L2_Fab Light Chain

SEQ ID NO: 26120 - protein, 107 aa, Artificial Sequence; identical to SEQ ID NO: 17251
  Description of Artificial Sequence: Synthetic polypeptide
  VL of XENP021322

SEQ ID NO: 26121 - protein, 11 aa, Artificial Sequence
  Description of Artificial Sequence: Synthetic peptide
  XENP021322 vlCDR1
QASQDIGNYLN

SEQ ID NO: 26122 - protein, 7 aa, Artificial Sequence
  Description of Artificial Sequence: Synthetic peptide
  XENP021322 vlCDR2
YTSRLHS

SEQ ID NO: 26123 - protein, 9 aa, Artificial Sequence
  Description of Artificial Sequence: Synthetic peptide
  XENP021322 vlCDR3
QQGNTLPYT

SEQ ID NO: 26124 - protein, 223 aa, Artificial Sequence
  Description of Artificial Sequence: Synthetic polypeptide
  XENP021323 2A11_H1.92_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGIRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26125 - protein, 118 aa, Artificial Sequence
  Description of Artificial Sequence: Synthetic polypeptide
  VH of XENP021323
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGIRQALDYWGQGTLVTVSS

SEQ ID NO: 26126 - protein, 5 aa, Artificial Sequence
  Description of Artificial Sequence: Synthetic peptide
  XENP021323 vhCDR1
DYYMH

SEQ ID NO: 26127 - protein, 17 aa, Artificial Sequence
  Description of Artificial Sequence: Synthetic peptide
  XENP021323 vhCDR2
WIDPENGDTEYAPKFQG

SEQ ID NO: 26128 - protein, 9 aa, Artificial Sequence
  Description of Artificial Sequence: Synthetic peptide
  XENP021323 vhCDR3
RGIRQALDY

SEQ ID NO: 26129 - protein, 214 aa, Artificial Sequence; identical to SEQ ID NO: 17250
  Description of Artificial Sequence: Synthetic polypeptide
  XENP021323 2A11_H1.92_L2_Fab Light Chain

SEQ ID NO: 26130 - protein, 107 aa, Artificial Sequence; identical to SEQ ID NO: 17251
  Description of Artificial Sequence: Synthetic polypeptide
  VL of XENP021323

SEQ ID NO: 26131 - protein, 11 aa, Artificial Sequence
  Description of Artificial Sequence: Synthetic peptide
  XENP021323 vlCDR1
QASQDIGNYLN

SEQ ID NO: 26132 - protein, 7 aa, Artificial Sequence
  Description of Artificial Sequence: Synthetic peptide
  XENP021323 vlCDR2
YTSRLHS

SEQ ID NO: 26133 - protein, 9 aa, Artificial Sequence
  Description of Artificial Sequence: Synthetic peptide
  XENP021323 vlCDR3
QQGNTLPYT

SEQ ID NO: 26134 - protein, 223 aa, Artificial Sequence
  Description of Artificial Sequence: Synthetic polypeptide
  XENP021324 2A11_H1.93_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGLRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26135 - protein, 118 aa, Artificial Sequence
  Description of Artificial Sequence: Synthetic polypeptide
  VH of XENP021324
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGLRQALDYWGQGTLVTVSS

SEQ ID NO: 26136 - protein, 5 aa, Artificial Sequence
  Description of Artificial Sequence: Synthetic peptide
  XENP021324 vhCDR1
DYYMH

SEQ ID NO: 26137 - protein, 17 aa, Artificial Sequence
  Description of Artificial Sequence: Synthetic peptide
  XENP021324 vhCDR2
WIDPENGDTEYAPKFQG

SEQ ID NO: 26138 - protein, 9 aa, Artificial Sequence
  Description of Artificial Sequence: Synthetic peptide
  XENP021324 vhCDR3
RGLRQALDY

SEQ ID NO: 26139 - protein, 214 aa, Artificial Sequence; identical to SEQ ID NO: 17250
  Description of Artificial Sequence: Synthetic polypeptide
  XENP021324 2A11_H1.93_L2_Fab Light Chain

SEQ ID NO: 26140 - protein, 107 aa, Artificial Sequence; identical to SEQ ID NO: 17251
  Description of Artificial Sequence: Synthetic polypeptide
  VL of XENP021324

SEQ ID NO: 26141 - protein, 11 aa, Artificial Sequence
  Description of Artificial Sequence: Synthetic peptide
  XENP021324 vlCDR1
QASQDIGNYLN

SEQ ID NO: 26142 - protein, 7 aa, Artificial Sequence
  Description of Artificial Sequence: Synthetic peptide
  XENP021324 vlCDR2
YTSRLHS

SEQ ID NO: 26143 - protein, 9 aa, Artificial Sequence
  Description of Artificial Sequence: Synthetic peptide
  XENP021324 vlCDR3
QQGNTLPYT

SEQ ID NO: 26144 - protein, 223 aa, Artificial Sequence
  Description of Artificial Sequence: Synthetic polypeptide
  XENP021325 2A11_H1.94_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGARQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26145 - protein, 118 aa, Artificial Sequence
  Description of Artificial Sequence: Synthetic polypeptide
  VH of XENP021325
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGARQALDYWGQGTLVTVSS

SEQ ID NO: 26146 - protein, 5 aa, Artificial Sequence
  Description of Artificial Sequence: Synthetic peptide
  XENP021325 vhCDR1
DYYMH

SEQ ID NO: 26147 - protein, 17 aa, Artificial Sequence
  Description of Artificial Sequence: Synthetic peptide
  XENP021325 vhCDR2
WIDPENGDTEYAPKFQG

SEQ ID NO: 26148 - protein, 9 aa, Artificial Sequence
  Description of Artificial Sequence: Synthetic peptide
  XENP021325 vhCDR3
RGARQALDY

SEQ ID NO: 26149 - protein, 214 aa, Artificial Sequence; identical to SEQ ID NO: 17250
  Description of Artificial Sequence: Synthetic polypeptide
  XENP021325 2A11_H1.94_L2_Fab Light Chain

SEQ ID NO: 26150 - protein, 107 aa, Artificial Sequence; identical to SEQ ID NO: 17251
  Description of Artificial Sequence: Synthetic polypeptide
  VL of XENP021325

SEQ ID NO: 26151 - protein, 11 aa, Artificial Sequence
  Description of Artificial Sequence: Synthetic peptide
  XENP021325 vlCDR1
QASQDIGNYLN

SEQ ID NO: 26152 - protein, 7 aa, Artificial Sequence
  Description of Artificial Sequence: Synthetic peptide
  XENP021325 vlCDR2
YTSRLHS

SEQ ID NO: 26153 - protein, 9 aa, Artificial Sequence
  Description of Artificial Sequence: Synthetic peptide
  XENP021325 vlCDR3
QQGNTLPYT

SEQ ID NO: 26154 - protein, 223 aa, Artificial Sequence
  Description of Artificial Sequence: Synthetic polypeptide
  XENP021326 2A11_H1.95_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGYRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26155 - protein, 118 aa, Artificial Sequence
  Description of Artificial Sequence: Synthetic polypeptide
  VH of XENP021326
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGYRQALDYWGQGTLVTVSS

SEQ ID NO: 26156 - protein, 5 aa, Artificial Sequence
  Description of Artificial Sequence: Synthetic peptide
  XENP021326 vhCDR1
DYYMH

SEQ ID NO: 26157 - protein, 17 aa, Artificial Sequence
  Description of Artificial Sequence: Synthetic peptide
  XENP021326 vhCDR2
WIDPENGDTEYAPKFQG

SEQ ID NO: 26158 - protein, 9 aa, Artificial Sequence
  Description of Artificial Sequence: Synthetic peptide
  XENP021326 vhCDR3
RGYRQALDY

SEQ ID NO: 26159 - protein, 214 aa, Artificial Sequence; identical to SEQ ID NO: 17250
  Description of Artificial Sequence: Synthetic polypeptide
  XENP021326 2A11_H1.95_L2_Fab Light Chain

SEQ ID NO: 26160 - protein, 107 aa, Artificial Sequence; identical to SEQ ID NO: 17251
  Description of Artificial Sequence: Synthetic polypeptide
  VL of XENP021326

SEQ ID NO: 26161 - protein, 11 aa, Artificial Sequence
  Description of Artificial Sequence: Synthetic peptide
  XENP021326 vlCDR1
QASQDIGNYLN

SEQ ID NO: 26162 - protein, 7 aa, Artificial Sequence
  Description of Artificial Sequence: Synthetic peptide
  XENP021326 vlCDR2
YTSRLHS

SEQ ID NO: 26163 - protein, 9 aa, Artificial Sequence
  Description of Artificial Sequence: Synthetic peptide
  XENP021326 vlCDR3
QQGNTLPYT

SEQ ID NO: 26164 - protein, 223 aa, Artificial Sequence
  Description of Artificial Sequence: Synthetic polypeptide
  XENP021327 2A11_H1.96_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGQRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26165 - protein, 118 aa, Artificial Sequence
  Description of Artificial Sequence: Synthetic polypeptide
  VH of XENP021327
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGQRQALDYWGQGTLVTVSS

SEQ ID NO: 26166 - protein, 5 aa, Artificial Sequence
  Description of Artificial Sequence: Synthetic peptide
  XENP021327 vhCDR1
DYYMH

SEQ ID NO: 26167 - protein, 17 aa, Artificial Sequence
  Description of Artificial Sequence: Synthetic peptide
  XENP021327 vhCDR2
WIDPENGDTEYAPKFQG

SEQ ID NO: 26168 - protein, 9 aa, Artificial Sequence
  Description of Artificial Sequence: Synthetic peptide
  XENP021327 vhCDR3
RGQRQALDY

SEQ ID NO: 26169 - protein, 214 aa, Artificial Sequence; identical to SEQ ID NO: 17250
  Description of Artificial Sequence: Synthetic polypeptide
  XENP021327 2A11_H1.96_L2_Fab Light Chain

SEQ ID NO: 26170 - protein, 107 aa, Artificial Sequence; identical to SEQ ID NO: 17251
  Description of Artificial Sequence: Synthetic polypeptide
  VL of XENP021327

SEQ ID NO: 26171 - protein, 11 aa, Artificial Sequence
  Description of Artificial Sequence: Synthetic peptide
  XENP021327 vlCDR1
QASQDIGNYLN

SEQ ID NO: 26172 - protein, 7 aa, Artificial Sequence
  Description of Artificial Sequence: Synthetic peptide
  XENP021327 vlCDR2
YTSRLHS

SEQ ID NO: 26173 - protein, 9 aa, Artificial Sequence
  Description of Artificial Sequence: Synthetic peptide
  XENP021327 vlCDR3
QQGNTLPYT

SEQ ID NO: 26174 - protein, 223 aa, Artificial Sequence
  Description of Artificial Sequence: Synthetic polypeptide
  XENP021328 2A11_H1.97_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGSRQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26175 - protein, 118 aa, Artificial Sequence
  Description of Artificial Sequence: Synthetic polypeptide
  VH of XENP021328
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGSRQALDYWGQGTLVTVSS

SEQ ID NO: 26176 - protein, 5 aa, Artificial Sequence
  Description of Artificial Sequence: Synthetic peptide
  XENP021328 vhCDR1
DYYMH

SEQ ID NO: 26177 - protein, 17 aa, Artificial Sequence
  Description of Artificial Sequence: Synthetic peptide
  XENP021328 vhCDR2
WIDPENGDTEYAPKFQG

SEQ ID NO: 26178 - protein, 9 aa, Artificial Sequence
  Description of Artificial Sequence: Synthetic peptide
  XENP021328 vhCDR3
RGSRQALDY

SEQ ID NO: 26179 - protein, 214 aa, Artificial Sequence; identical to SEQ ID NO: 17250
  Description of Artificial Sequence: Synthetic polypeptide
  XENP021328 2A11_H1.97_L2_Fab Light Chain

SEQ ID NO: 26180 - protein, 107 aa, Artificial Sequence; identical to SEQ ID NO: 17251
  Description of Artificial Sequence: Synthetic polypeptide
  VL of XENP021328

SEQ ID NO: 26181 - protein, 11 aa, Artificial Sequence
  Description of Artificial Sequence: Synthetic peptide
  XENP021328 vlCDR1
QASQDIGNYLN

SEQ ID NO: 26182 - protein, 7 aa, Artificial Sequence
  Description of Artificial Sequence: Synthetic peptide
  XENP021328 vlCDR2
YTSRLHS

SEQ ID NO: 26183 - protein, 9 aa, Artificial Sequence
  Description of Artificial Sequence: Synthetic peptide
  XENP021328 vlCDR3
QQGNTLPYT

SEQ ID NO: 26184 - protein, 223 aa, Artificial Sequence
  Description of Artificial Sequence: Synthetic polypeptide
  XENP021329 2A11_H1.98_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVKQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26185 - protein, 118 aa, Artificial Sequence
  Description of Artificial Sequence: Synthetic polypeptide
  VH of XENP021329
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVKQALDYWGQGTLVTVSS

SEQ ID NO: 26186 - protein, 5 aa, Artificial Sequence
  Description of Artificial Sequence: Synthetic peptide
  XENP021329 vhCDR1
DYYMH

SEQ ID NO: 26187 - protein, 17 aa, Artificial Sequence
  Description of Artificial Sequence: Synthetic peptide
  XENP021329 vhCDR2
WIDPENGDTEYAPKFQG

SEQ ID NO: 26188 - protein, 9 aa, Artificial Sequence
  Description of Artificial Sequence: Synthetic peptide
  XENP021329 vhCDR3
RGVKQALDY

SEQ ID NO: 26189 - protein, 214 aa, Artificial Sequence; identical to SEQ ID NO: 17250
  Description of Artificial Sequence: Synthetic polypeptide
  XENP021329 2A11_H1.98_L2_Fab Light Chain

SEQ ID NO: 26190 - protein, 107 aa, Artificial Sequence; identical to SEQ ID NO: 17251
  Description of Artificial Sequence: Synthetic polypeptide
  VL of XENP021329

SEQ ID NO: 26191 - protein, 11 aa, Artificial Sequence
  Description of Artificial Sequence: Synthetic peptide
  XENP021329 vlCDR1
QASQDIGNYLN

SEQ ID NO: 26192 - protein, 7 aa, Artificial Sequence
  Description of Artificial Sequence: Synthetic peptide
  XENP021329 vlCDR2
YTSRLHS

SEQ ID NO: 26193 - protein, 9 aa, Artificial Sequence
  Description of Artificial Sequence: Synthetic peptide
  XENP021329 vlCDR3
QQGNTLPYT

SEQ ID NO: 26194 - protein, 223 aa, Artificial Sequence
  Description of Artificial Sequence: Synthetic polypeptide
  XENP021330 2A11_H1.99_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVEQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26195 - protein, 118 aa, Artificial Sequence
  Description of Artificial Sequence: Synthetic polypeptide
  VH of XENP021330
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVEQALDYWGQGTLVTVSS

SEQ ID NO: 26196 - protein, 5 aa, Artificial Sequence
  Description of Artificial Sequence: Synthetic peptide
  XENP021330 vhCDR1
DYYMH

SEQ ID NO: 26197 - protein, 17 aa, Artificial Sequence
  Description of Artificial Sequence: Synthetic peptide
  XENP021330 vhCDR2
WIDPENGDTEYAPKFQG

SEQ ID NO: 26198 - protein, 9 aa, Artificial Sequence
  Description of Artificial Sequence: Synthetic peptide
  XENP021330 vhCDR3
RGVEQALDY

SEQ ID NO: 26199 - protein, 214 aa, Artificial Sequence; identical to SEQ ID NO: 17250
  Description of Artificial Sequence: Synthetic polypeptide
  XENP021330 2A11_H1.99_L2_Fab Light Chain

SEQ ID NO: 26200 - protein, 107 aa, Artificial Sequence; identical to SEQ ID NO: 17251
  Description of Artificial Sequence: Synthetic polypeptide
  VL of XENP021330

SEQ ID NO: 26201 - protein, 11 aa, Artificial Sequence
  Description of Artificial Sequence: Synthetic peptide
  XENP021330 vlCDR1
QASQDIGNYLN

SEQ ID NO: 26202 - protein, 7 aa, Artificial Sequence
  Description of Artificial Sequence: Synthetic peptide
  XENP021330 vlCDR2
YTSRLHS

SEQ ID NO: 26203 - protein, 9 aa, Artificial Sequence
  Description of Artificial Sequence: Synthetic peptide
  XENP021330 vlCDR3
QQGNTLPYT

SEQ ID NO: 26204 - protein, 223 aa, Artificial Sequence
  Description of Artificial Sequence: Synthetic polypeptide
  XENP021331 2A11_H1.100_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVDQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26205 - protein, 118 aa, Artificial Sequence
  Description of Artificial Sequence: Synthetic polypeptide
  VH of XENP021331
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVDQALDYWGQGTLVTVSS

SEQ ID NO: 26206 - protein, 5 aa, Artificial Sequence
  Description of Artificial Sequence: Synthetic peptide
  XENP021331 vhCDR1
DYYMH

SEQ ID NO: 26207 - protein, 17 aa, Artificial Sequence
  Description of Artificial Sequence: Synthetic peptide
  XENP021331 vhCDR2
WIDPENGDTEYAPKFQG

SEQ ID NO: 26208 - protein, 9 aa, Artificial Sequence
  Description of Artificial Sequence: Synthetic peptide
  XENP021331 vhCDR3
RGVDQALDY

SEQ ID NO: 26209 - protein, 214 aa, Artificial Sequence; identical to SEQ ID NO: 17250
  Description of Artificial Sequence: Synthetic polypeptide
  XENP021331 2A11_H1.100_L2_Fab Light Chain

SEQ ID NO: 26210 - protein, 107 aa, Artificial Sequence; identical to SEQ ID NO: 17251
  Description of Artificial Sequence: Synthetic polypeptide
  VL of XENP021331

SEQ ID NO: 26211 - protein, 11 aa, Artificial Sequence
  Description of Artificial Sequence: Synthetic peptide
  XENP021331 vlCDR1
QASQDIGNYLN

SEQ ID NO: 26212 - protein, 7 aa, Artificial Sequence
  Description of Artificial Sequence: Synthetic peptide
  XENP021331 vlCDR2
YTSRLHS

SEQ ID NO: 26213 - protein, 9 aa, Artificial Sequence
  Description of Artificial Sequence: Synthetic peptide
  XENP021331 vlCDR3
QQGNTLPYT

SEQ ID NO: 26214 - protein, 223 aa, Artificial Sequence
  Description of Artificial Sequence: Synthetic polypeptide
  XENP021332 2A11_H1.101_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVHQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26215 - protein, 118 aa, Artificial Sequence
  Description of Artificial Sequence: Synthetic polypeptide
  VH of XENP021332
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVHQALDYWGQGTLVTVSS

SEQ ID NO: 26216 - protein, 5 aa, Artificial Sequence
  Description of Artificial Sequence: Synthetic peptide
  XENP021332 vhCDR1
DYYMH

SEQ ID NO: 26217 - protein, 17 aa, Artificial Sequence
  Description of Artificial Sequence: Synthetic peptide
  XENP021332 vhCDR2
WIDPENGDTEYAPKFQG

SEQ ID NO: 26218 - protein, 9 aa, Artificial Sequence
  Description of Artificial Sequence: Synthetic peptide
  XENP021332 vhCDR3
RGVHQALDY

SEQ ID NO: 26219 - protein, 214 aa, Artificial Sequence; identical to SEQ ID NO: 17250
  Description of Artificial Sequence: Synthetic polypeptide
  XENP021332 2A11_H1.101_L2_Fab Light Chain

SEQ ID NO: 26220 - protein, 107 aa, Artificial Sequence; identical to SEQ ID NO: 17251
  Description of Artificial Sequence: Synthetic polypeptide
  VL of XENP021332

SEQ ID NO: 26221 - protein, 11 aa, Artificial Sequence
  Description of Artificial Sequence: Synthetic peptide
  XENP021332 vlCDR1
QASQDIGNYLN

SEQ ID NO: 26222 - protein, 7 aa, Artificial Sequence
  Description of Artificial Sequence: Synthetic peptide
  XENP021332 vlCDR2
YTSRLHS

SEQ ID NO: 26223 - protein, 9 aa, Artificial Sequence
  Description of Artificial Sequence: Synthetic peptide
  XENP021332 vlCDR3
QQGNTLPYT

SEQ ID NO: 26224 - protein, 223 aa, Artificial Sequence
  Description of Artificial Sequence: Synthetic polypeptide
  XENP021333 2A11_H1.102_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVTQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26225 - protein, 118 aa, Artificial Sequence
  Description of Artificial Sequence: Synthetic polypeptide
  VH of XENP021333
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVTQALDYWGQGTLVTVSS

SEQ ID NO: 26226 - protein, 5 aa, Artificial Sequence
  Description of Artificial Sequence: Synthetic peptide
  XENP021333 vhCDR1
DYYMH

SEQ ID NO: 26227 - protein, 17 aa, Artificial Sequence
  Description of Artificial Sequence: Synthetic peptide
  XENP021333 vhCDR2
WIDPENGDTEYAPKFQG

SEQ ID NO: 26228 - protein, 9 aa, Artificial Sequence
  Description of Artificial Sequence: Synthetic peptide
  XENP021333 vhCDR3
RGVTQALDY

SEQ ID NO: 26229 - protein, 214 aa, Artificial Sequence; identical to SEQ ID NO: 17250
  Description of Artificial Sequence: Synthetic polypeptide
  XENP021333 2A11_H1.102_L2_Fab Light Chain

SEQ ID NO: 26230 - protein, 107 aa, Artificial Sequence; identical to SEQ ID NO: 17251
  Description of Artificial Sequence: Synthetic polypeptide
  VL of XENP021333

SEQ ID NO: 26231 - protein, 11 aa, Artificial Sequence
  Description of Artificial Sequence: Synthetic peptide
  XENP021333 vlCDR1
QASQDIGNYLN

SEQ ID NO: 26232 - protein, 7 aa, Artificial Sequence
  Description of Artificial Sequence: Synthetic peptide
  XENP021333 vlCDR2
YTSRLHS

SEQ ID NO: 26233 - protein, 9 aa, Artificial Sequence
  Description of Artificial Sequence: Synthetic peptide
  XENP021333 vlCDR3
QQGNTLPYT

SEQ ID NO: 26234 - protein, 223 aa, Artificial Sequence
  Description of Artificial Sequence: Synthetic polypeptide
  XENP021334 2A11_H1.103_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVAQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26235 - protein, 118 aa, Artificial Sequence
  Description of Artificial Sequence: Synthetic polypeptide
  VH of XENP021334
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVAQALDYWGQGTLVTVSS

SEQ ID NO: 26236 - protein, 5 aa, Artificial Sequence
  Description of Artificial Sequence: Synthetic peptide
  XENP021334 vhCDR1
DYYMH

SEQ ID NO: 26237 - protein, 17 aa, Artificial Sequence
  Description of Artificial Sequence: Synthetic peptide
  XENP021334 vhCDR2
WIDPENGDTEYAPKFQG

SEQ ID NO: 26238 - protein, 9 aa, Artificial Sequence
  Description of Artificial Sequence: Synthetic peptide
  XENP021334 vhCDR3
RGVAQALDY

SEQ ID NO: 26239 - protein, 214 aa, Artificial Sequence; identical to SEQ ID NO: 17250
  Description of Artificial Sequence: Synthetic polypeptide
  XENP021334 2A11_H1.103_L2_Fab Light Chain

SEQ ID NO: 26240 - protein, 107 aa, Artificial Sequence; identical to SEQ ID NO: 17251
  Description of Artificial Sequence: Synthetic polypeptide
  VL of XENP021334

SEQ ID NO: 26241 - protein, 11 aa, Artificial Sequence
  Description of Artificial Sequence: Synthetic peptide
  XENP021334 vlCDR1
QASQDIGNYLN

SEQ ID NO: 26242 - protein, 7 aa, Artificial Sequence
  Description of Artificial Sequence: Synthetic peptide
  XENP021334 vlCDR2
YTSRLHS

SEQ ID NO: 26243 - protein, 9 aa, Artificial Sequence
  Description of Artificial Sequence: Synthetic peptide
  XENP021334 vlCDR3
QQGNTLPYT

SEQ ID NO: 26244 - protein, 223 aa, Artificial Sequence
  Description of Artificial Sequence: Synthetic polypeptide
  XENP021335 2A11_H1.104_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVGQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26245 - protein, 118 aa, Artificial Sequence
  Description of Artificial Sequence: Synthetic polypeptide
  VH of XENP021335
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVGQALDYWGQGTLVTVSS

SEQ ID NO: 26246 - protein, 5 aa, Artificial Sequence
  Description of Artificial Sequence: Synthetic peptide
  XENP021335 vhCDR1
DYYMH

SEQ ID NO: 26247 - protein, 17 aa, Artificial Sequence
  Description of Artificial Sequence: Synthetic peptide
  XENP021335 vhCDR2
WIDPENGDTEYAPKFQG

SEQ ID NO: 26248 - protein, 9 aa, Artificial Sequence
  Description of Artificial Sequence: Synthetic peptide
  XENP021335 vhCDR3
RGVGQALDY

SEQ ID NO: 26249 - protein, 214 aa, Artificial Sequence; identical to SEQ ID NO: 17250
  Description of Artificial Sequence: Synthetic polypeptide
  XENP021335 2A11_H1.104_L2_Fab Light Chain

SEQ ID NO: 26250 - protein, 107 aa, Artificial Sequence; identical to SEQ ID NO: 17251
  Description of Artificial Sequence: Synthetic polypeptide
  VL of XENP021335

SEQ ID NO: 26251 - protein, 11 aa, Artificial Sequence
  Description of Artificial Sequence: Synthetic peptide
  XENP021335 vlCDR1
QASQDIGNYLN

SEQ ID NO: 26252 - protein, 7 aa, Artificial Sequence
  Description of Artificial Sequence: Synthetic peptide
  XENP021335 vlCDR2
YTSRLHS

SEQ ID NO: 26253 - protein, 9 aa, Artificial Sequence
  Description of Artificial Sequence: Synthetic peptide
  XENP021335 vlCDR3
QQGNTLPYT

SEQ ID NO: 26254 - protein, 223 aa, Artificial Sequence
  Description of Artificial Sequence: Synthetic polypeptide
  XENP021336 2A11_H1.105_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVYQALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26255 - protein, 118 aa, Artificial Sequence
  Description of Artificial Sequence: Synthetic polypeptide
  VH of XENP021336
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVYQALDYWGQGTLVTVSS

SEQ ID NO: 26256 - protein, 5 aa, Artificial Sequence
  Description of Artificial Sequence: Synthetic peptide
  XENP021336 vhCDR1
DYYMH

SEQ ID NO: 26257 - protein, 17 aa, Artificial Sequence
  Description of Artificial Sequence: Synthetic peptide
  XENP021336 vhCDR2
WIDPENGDTEYAPKFQG

SEQ ID NO: 26258 - protein, 9 aa, Artificial Sequence
  Description of Artificial Sequence: Synthetic peptide
  XENP021336 vhCDR3
RGVYQALDY

SEQ ID NO: 26259 - protein, 214 aa, Artificial Sequence; identical to SEQ ID NO: 17250
  Description of Artificial Sequence: Synthetic polypeptide
  XENP021336 2A11_H1.105_L2_Fab Light Chain

SEQ ID NO: 26260 - protein, 107 aa, Artificial Sequence; identical to SEQ ID NO: 17251
  Description of Artificial Sequence: Synthetic polypeptide
  VL of XENP021336

SEQ ID NO: 26261 - protein, 11 aa, Artificial Sequence
  Description of Artificial Sequence: Synthetic peptide
  XENP021336 vlCDR1
QASQDIGNYLN

SEQ ID NO: 26262 - protein, 7 aa, Artificial Sequence
  Description of Artificial Sequence: Synthetic peptide
  XENP021336 vlCDR2
YTSRLHS

SEQ ID NO: 26263 - protein, 9 aa, Artificial Sequence
  Description of Artificial Sequence: Synthetic peptide
  XENP021336 vlCDR3
QQGNTLPYT

SEQ ID NO: 26264 - protein, 223 aa, Artificial Sequence
  Description of Artificial Sequence: Synthetic polypeptide
  XENP021337 2A11_H1.106_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRAALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26265 - protein, 118 aa, Artificial Sequence
  Description of Artificial Sequence: Synthetic polypeptide
  VH of XENP021337
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRAALDYWGQGTLVTVSS

SEQ ID NO: 26266 - protein, 5 aa, Artificial Sequence
  Description of Artificial Sequence: Synthetic peptide
  XENP021337 vhCDR1
DYYMH

SEQ ID NO: 26267 - protein, 17 aa, Artificial Sequence
  Description of Artificial Sequence: Synthetic peptide
  XENP021337 vhCDR2
WIDPENGDTEYAPKFQG

SEQ ID NO: 26268 - protein, 9 aa, Artificial Sequence
  Description of Artificial Sequence: Synthetic peptide
  XENP021337 vhCDR3
RGVRAALDY

SEQ ID NO: 26269 - protein, 214 aa, Artificial Sequence; identical to SEQ ID NO: 17250
  Description of Artificial Sequence: Synthetic polypeptide
  XENP021337 2A11_H1.106_L2_Fab Light Chain

SEQ ID NO: 26270 - protein, 107 aa, Artificial Sequence; identical to SEQ ID NO: 17251
  Description of Artificial Sequence: Synthetic polypeptide
  VL of XENP021337

SEQ ID NO: 26271 - protein, 11 aa, Artificial Sequence
  Description of Artificial Sequence: Synthetic peptide
  XENP021337 vlCDR1
QASQDIGNYLN

SEQ ID NO: 26272 - protein, 7 aa, Artificial Sequence
  Description of Artificial Sequence: Synthetic peptide
  XENP021337 vlCDR2
YTSRLHS

SEQ ID NO: 26273 - protein, 9 aa, Artificial Sequence
  Description of Artificial Sequence: Synthetic peptide
  XENP021337 vlCDR3
QQGNTLPYT

SEQ ID NO: 26274 - protein, 223 aa, Artificial Sequence
  Description of Artificial Sequence: Synthetic polypeptide
  XENP021338 2A11_H1.107_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRSALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26275 - protein, 118 aa, Artificial Sequence
  Description of Artificial Sequence: Synthetic polypeptide
  VH of XENP021338
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRSALDYWGQGTLVTVSS

SEQ ID NO: 26276 - protein, 5 aa, Artificial Sequence
  Description of Artificial Sequence: Synthetic peptide
  XENP021338 vhCDR1
DYYMH

SEQ ID NO: 26277 - protein, 17 aa, Artificial Sequence
  Description of Artificial Sequence: Synthetic peptide
  XENP021338 vhCDR2
WIDPENGDTEYAPKFQG

SEQ ID NO: 26278 - protein, 9 aa, Artificial Sequence
  Description of Artificial Sequence: Synthetic peptide
  XENP021338 vhCDR3
RGVRSALDY

SEQ ID NO: 26279 - protein, 214 aa, Artificial Sequence; identical to SEQ ID NO: 17250
  Description of Artificial Sequence: Synthetic polypeptide
  XENP021338 2A11_H1.107_L2_Fab Light Chain

SEQ ID NO: 26280 - protein, 107 aa, Artificial Sequence; identical to SEQ ID NO: 17251
  Description of Artificial Sequence: Synthetic polypeptide
  VL of XENP021338

SEQ ID NO: 26281 - protein, 11 aa, Artificial Sequence
  Description of Artificial Sequence: Synthetic peptide
  XENP021338 vlCDR1
QASQDIGNYLN

SEQ ID NO: 26282 - protein, 7 aa, Artificial Sequence
  Description of Artificial Sequence: Synthetic peptide
  XENP021338 vlCDR2
YTSRLHS

SEQ ID NO: 26283 - protein, 9 aa, Artificial Sequence
  Description of Artificial Sequence: Synthetic peptide
  XENP021338 vlCDR3
QQGNTLPYT

SEQ ID NO: 26284 - protein, 223 aa, Artificial Sequence
  Description of Artificial Sequence: Synthetic polypeptide
  XENP021339 2A11_H1.108_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRHALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26285 - protein, 118 aa, Artificial Sequence
  Description of Artificial Sequence: Synthetic polypeptide
  VH of XENP021339
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRHALDYWGQGTLVTVSS

SEQ ID NO: 26286 - protein, 5 aa, Artificial Sequence
  Description of Artificial Sequence: Synthetic peptide
  XENP021339 vhCDR1
DYYMH

SEQ ID NO: 26287 - protein, 17 aa, Artificial Sequence
  Description of Artificial Sequence: Synthetic peptide
  XENP021339 vhCDR2
WIDPENGDTEYAPKFQG

SEQ ID NO: 26288 - protein, 9 aa, Artificial Sequence
  Description of Artificial Sequence: Synthetic peptide
  XENP021339 vhCDR3
RGVRHALDY

SEQ ID NO: 26289 - protein, 214 aa, Artificial Sequence; identical to SEQ ID NO: 17250
  Description of Artificial Sequence: Synthetic polypeptide
  XENP021339 2A11_H1.108_L2_Fab Light Chain

SEQ ID NO: 26290 - protein, 107 aa, Artificial Sequence; identical to SEQ ID NO: 17251
  Description of Artificial Sequence: Synthetic polypeptide
  VL of XENP021339

SEQ ID NO: 26291 - protein, 11 aa, Artificial Sequence
  Description of Artificial Sequence: Synthetic peptide
  XENP021339 vlCDR1
QASQDIGNYLN

SEQ ID NO: 26292 - protein, 7 aa, Artificial Sequence
  Description of Artificial Sequence: Synthetic peptide
  XENP021339 vlCDR2
YTSRLHS

SEQ ID NO: 26293 - protein, 9 aa, Artificial Sequence
  Description of Artificial Sequence: Synthetic peptide
  XENP021339 vlCDR3
QQGNTLPYT

SEQ ID NO: 26294 - protein, 223 aa, Artificial Sequence
  Description of Artificial Sequence: Synthetic polypeptide
  XENP021340 2A11_H1.109_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRLALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26295 - protein, 118 aa, Artificial Sequence
  Description of Artificial Sequence: Synthetic polypeptide
  VH of XENP021340
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRLALDYWGQGTLVTVSS

SEQ ID NO: 26296 - protein, 5 aa, Artificial Sequence
  Description of Artificial Sequence: Synthetic peptide
  XENP021340 vhCDR1
DYYMH

SEQ ID NO: 26297 - protein, 17 aa, Artificial Sequence
  Description of Artificial Sequence: Synthetic peptide
  XENP021340 vhCDR2
WIDPENGDTEYAPKFQG

SEQ ID NO: 26298 - protein, 9 aa, Artificial Sequence
  Description of Artificial Sequence: Synthetic peptide
  XENP021340 vhCDR3
RGVRLALDY

SEQ ID NO: 26299 - protein, 214 aa, Artificial Sequence; identical to SEQ ID NO: 17250
  Description of Artificial Sequence: Synthetic polypeptide
  XENP021340 2A11_H1.109_L2_Fab Light Chain

SEQ ID NO: 26300 - protein, 107 aa, Artificial Sequence; identical to SEQ ID NO: 17251
  Description of Artificial Sequence: Synthetic polypeptide
  VL of XENP021340

SEQ ID NO: 26301 - protein, 11 aa, Artificial Sequence
  Description of Artificial Sequence: Synthetic peptide
  XENP021340 vlCDR1
QASQDIGNYLN

SEQ ID NO: 26302 - protein, 7 aa, Artificial Sequence
  Description of Artificial Sequence: Synthetic peptide
  XENP021340 vlCDR2
YTSRLHS

SEQ ID NO: 26303 - protein, 9 aa, Artificial Sequence
  Description of Artificial Sequence: Synthetic peptide
  XENP021340 vlCDR3
QQGNTLPYT

SEQ ID NO: 26304 - protein, 223 aa, Artificial Sequence
  Description of Artificial Sequence: Synthetic polypeptide
  XENP021341 2A11_H1.110_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRPALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26305 - protein, 118 aa, Artificial Sequence
  Description of Artificial Sequence: Synthetic polypeptide
  VH of XENP021341
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRPALDYWGQGTLVTVSS

SEQ ID NO: 26306 - protein, 5 aa, Artificial Sequence
  Description of Artificial Sequence: Synthetic peptide
  XENP021341 vhCDR1
DYYMH

SEQ ID NO: 26307 - protein, 17 aa, Artificial Sequence
  Description of Artificial Sequence: Synthetic peptide
  XENP021341 vhCDR2
WIDPENGDTEYAPKFQG

SEQ ID NO: 26308 - protein, 9 aa, Artificial Sequence
  Description of Artificial Sequence: Synthetic peptide
  XENP021341 vhCDR3
RGVRPALDY

SEQ ID NO: 26309 - protein, 214 aa, Artificial Sequence; identical to SEQ ID NO: 17250
  Description of Artificial Sequence: Synthetic polypeptide
  XENP021341 2A11_H1.110_L2_Fab Light Chain

SEQ ID NO: 26310 - protein, 107 aa, Artificial Sequence; identical to SEQ ID NO: 17251
  Description of Artificial Sequence: Synthetic polypeptide
  VL of XENP021341

SEQ ID NO: 26311 - protein, 11 aa, Artificial Sequence
  Description of Artificial Sequence: Synthetic peptide
  XENP021341 vlCDR1
QASQDIGNYLN

SEQ ID NO: 26312 - protein, 7 aa, Artificial Sequence
  Description of Artificial Sequence: Synthetic peptide
  XENP021341 vlCDR2
YTSRLHS

SEQ ID NO: 26313 - protein, 9 aa, Artificial Sequence
  Description of Artificial Sequence: Synthetic peptide
  XENP021341 vlCDR3
QQGNTLPYT

SEQ ID NO: 26314 - protein, 223 aa, Artificial Sequence
  Description of Artificial Sequence: Synthetic polypeptide
  XENP021342 2A11_H1.111_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVREALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26315 - protein, 118 aa, Artificial Sequence
  Description of Artificial Sequence: Synthetic polypeptide
  VH of XENP021342
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVREALDYWGQGTLVTVSS

SEQ ID NO: 26316 - protein, 5 aa, Artificial Sequence
  Description of Artificial Sequence: Synthetic peptide
  XENP021342 vhCDR1
DYYMH

SEQ ID NO: 26317 - protein, 17 aa, Artificial Sequence
  Description of Artificial Sequence: Synthetic peptide
  XENP021342 vhCDR2
WIDPENGDTEYAPKFQG

SEQ ID NO: 26318 - protein, 9 aa, Artificial Sequence
  Description of Artificial Sequence: Synthetic peptide
  XENP021342 vhCDR3
RGVREALDY

SEQ ID NO: 26319 - protein, 214 aa, Artificial Sequence; identical to SEQ ID NO: 17250
  Description of Artificial Sequence: Synthetic polypeptide
  XENP021342 2A11_H1.111_L2_Fab Light Chain

SEQ ID NO: 26320 - protein, 107 aa, Artificial Sequence; identical to SEQ ID NO: 17251
  Description of Artificial Sequence: Synthetic polypeptide
  VL of XENP021342

SEQ ID NO: 26321 - protein, 11 aa, Artificial Sequence
  Description of Artificial Sequence: Synthetic peptide
  XENP021342 vlCDR1
QASQDIGNYLN

SEQ ID NO: 26322 - protein, 7 aa, Artificial Sequence
  Description of Artificial Sequence: Synthetic peptide
  XENP021342 vlCDR2
YTSRLHS

SEQ ID NO: 26323 - protein, 9 aa, Artificial Sequence
  Description of Artificial Sequence: Synthetic peptide
  XENP021342 vlCDR3
QQGNTLPYT

SEQ ID NO: 26324 - protein, 223 aa, Artificial Sequence
  Description of Artificial Sequence: Synthetic polypeptide
  XENP021343 2A11_H1.112_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRGALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26325 - protein, 118 aa, Artificial Sequence
  Description of Artificial Sequence: Synthetic polypeptide
  VH of XENP021343
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRGALDYWGQGTLVTVSS

SEQ ID NO: 26326 - protein, 5 aa, Artificial Sequence
  Description of Artificial Sequence: Synthetic peptide
  XENP021343 vhCDR1
DYYMH

SEQ ID NO: 26327 - protein, 17 aa, Artificial Sequence
  Description of Artificial Sequence: Synthetic peptide
  XENP021343 vhCDR2
WIDPENGDTEYAPKFQG

SEQ ID NO: 26328 - protein, 9 aa, Artificial Sequence
  Description of Artificial Sequence: Synthetic peptide
  XENP021343 vhCDR3
RGVRGALDY

SEQ ID NO: 26329 - protein, 214 aa, Artificial Sequence; identical to SEQ ID NO: 17250
  Description of Artificial Sequence: Synthetic polypeptide
  XENP021343 2A11_H1.112_L2_Fab Light Chain

SEQ ID NO: 26330 - protein, 107 aa, Artificial Sequence; identical to SEQ ID NO: 17251
  Description of Artificial Sequence: Synthetic polypeptide
  VL of XENP021343

SEQ ID NO: 26331 - protein, 11 aa, Artificial Sequence
  Description of Artificial Sequence: Synthetic peptide
  XENP021343 vlCDR1
QASQDIGNYLN

SEQ ID NO: 26332 - protein, 7 aa, Artificial Sequence
  Description of Artificial Sequence: Synthetic peptide
  XENP021343 vlCDR2
YTSRLHS

SEQ ID NO: 26333 - protein, 9 aa, Artificial Sequence
  Description of Artificial Sequence: Synthetic peptide
  XENP021343 vlCDR3
QQGNTLPYT

SEQ ID NO: 26334 - protein, 223 aa, Artificial Sequence
  Description of Artificial Sequence: Synthetic polypeptide
  XENP021344 2A11_H1.113_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRKALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26335 - protein, 118 aa, Artificial Sequence
  Description of Artificial Sequence: Synthetic polypeptide
  VH of XENP021344
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRKALDYWGQGTLVTVSS

SEQ ID NO: 26336 - protein, 5 aa, Artificial Sequence
  Description of Artificial Sequence: Synthetic peptide
  XENP021344 vhCDR1
DYYMH

SEQ ID NO: 26337 - protein, 17 aa, Artificial Sequence
  Description of Artificial Sequence: Synthetic peptide
  XENP021344 vhCDR2
WIDPENGDTEYAPKFQG

SEQ ID NO: 26338 - protein, 9 aa, Artificial Sequence
  Description of Artificial Sequence: Synthetic peptide
  XENP021344 vhCDR3
RGVRKALDY

SEQ ID NO: 26339 - protein, 214 aa, Artificial Sequence; identical to SEQ ID NO: 17250
  Description of Artificial Sequence: Synthetic polypeptide
  XENP021344 2A11_H1.113_L2_Fab Light Chain

SEQ ID NO: 26340 - protein, 107 aa, Artificial Sequence; identical to SEQ ID NO: 17251
  Description of Artificial Sequence: Synthetic polypeptide
  VL of XENP021344

SEQ ID NO: 26341 - protein, 11 aa, Artificial Sequence
  Description of Artificial Sequence: Synthetic peptide
  XENP021344 vlCDR1
QASQDIGNYLN

SEQ ID NO: 26342 - protein, 7 aa, Artificial Sequence
  Description of Artificial Sequence: Synthetic peptide
  XENP021344 vlCDR2
YTSRLHS

SEQ ID NO: 26343 - protein, 9 aa, Artificial Sequence
  Description of Artificial Sequence: Synthetic peptide
  XENP021344 vlCDR3
QQGNTLPYT

SEQ ID NO: 26344 - protein, 223 aa, Artificial Sequence
  Description of Artificial Sequence: Synthetic polypeptide
  XENP021345 2A11_H1.114_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26345 - protein, 118 aa, Artificial Sequence
  Description of Artificial Sequence: Synthetic polypeptide
  VH of XENP021345
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQSLDYWGQGTLVTVSS

SEQ ID NO: 26346 - protein, 5 aa, Artificial Sequence
  Description of Artificial Sequence: Synthetic peptide
  XENP021345 vhCDR1
DYYMH

SEQ ID NO: 26347 - protein, 17 aa, Artificial Sequence
  Description of Artificial Sequence: Synthetic peptide
  XENP021345 vhCDR2
WIDPENGDTEYAPKFQG

SEQ ID NO: 26348 - protein, 9 aa, Artificial Sequence
  Description of Artificial Sequence: Synthetic peptide
  XENP021345 vhCDR3
RGVRQSLDY

SEQ ID NO: 26349 - protein, 214 aa, Artificial Sequence; identical to SEQ ID NO: 17250
  Description of Artificial Sequence: Synthetic polypeptide
  XENP021345 2A11_H1.114_L2_Fab Light Chain

SEQ ID NO: 26350 - protein, 107 aa, Artificial Sequence; identical to SEQ ID NO: 17251
  Description of Artificial Sequence: Synthetic polypeptide
  VL of XENP021345

SEQ ID NO: 26351 - protein, 11 aa, Artificial Sequence
  Description of Artificial Sequence: Synthetic peptide
  XENP021345 vlCDR1
QASQDIGNYLN

SEQ ID NO: 26352 - protein, 7 aa, Artificial Sequence
  Description of Artificial Sequence: Synthetic peptide
  XENP021345 vlCDR2
YTSRLHS

SEQ ID NO: 26353 - protein, 9 aa, Artificial Sequence
  Description of Artificial Sequence: Synthetic peptide
  XENP021345 vlCDR3
QQGNTLPYT

SEQ ID NO: 26354 - protein, 223 aa, Artificial Sequence
  Description of Artificial Sequence: Synthetic polypeptide
  XENP021346 2A11_H1.115_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQTLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26355 - protein, 118 aa, Artificial Sequence
  Description of Artificial Sequence: Synthetic polypeptide
  VH of XENP021346
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQTLDYWGQGTLVTVSS

SEQ ID NO: 26356 - protein, 5 aa, Artificial Sequence
  Description of Artificial Sequence: Synthetic peptide
  XENP021346 vhCDR1
DYYMH

SEQ ID NO: 26357 - protein, 17 aa, Artificial Sequence
  Description of Artificial Sequence: Synthetic peptide
  XENP021346 vhCDR2
WIDPENGDTEYAPKFQG

SEQ ID NO: 26358 - protein, 9 aa, Artificial Sequence
  Description of Artificial Sequence: Synthetic peptide
  XENP021346 vhCDR3
RGVRQTLDY

SEQ ID NO: 26359 - protein, 214 aa, Artificial Sequence; identical to SEQ ID NO: 17250
  Description of Artificial Sequence: Synthetic polypeptide
  XENP021346 2A11_H1.115_L2_Fab Light Chain

SEQ ID NO: 26360 - protein, 107 aa, Artificial Sequence; identical to SEQ ID NO: 17251
  Description of Artificial Sequence: Synthetic polypeptide
  VL of XENP021346

SEQ ID NO: 26361 - protein, 11 aa, Artificial Sequence
  Description of Artificial Sequence: Synthetic peptide
  XENP021346 vlCDR1
QASQDIGNYLN

SEQ ID NO: 26362 - protein, 7 aa, Artificial Sequence
  Description of Artificial Sequence: Synthetic peptide
  XENP021346 vlCDR2
YTSRLHS

SEQ ID NO: 26363 - protein, 9 aa, Artificial Sequence
  Description of Artificial Sequence: Synthetic peptide
  XENP021346 vlCDR3
QQGNTLPYT

SEQ ID NO: 26364 - protein, 223 aa, Artificial Sequence
  Description of Artificial Sequence: Synthetic polypeptide
  XENP021347 2A11_H1.116_L2_Fab Heavy Chain
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 26365 - protein, 118 aa, Artificial Sequence
  Description of Artificial Sequence: Synthetic polypeptide
  VH of XENP021347
EVQLVQSGAEVKKPGATVKISCKASGFNIKDYYMHWVQQAPGKGLEWMGWIDPENGDTEYAPKFQGRVTITADTSTNTAYMELSSLRSEDTAVYYCYARGVRQGLDYWGQGTLVTVSS

SEQ ID NO: 26366 - protein, 5 aa, Artificial Sequence
  Description of Artificial Sequence: Synthetic peptide
  XENP021347 vhCDR1
DYYMH

SEQ ID NO: 26367 - protein, 17 aa, Artificial Sequence
  Description of Artificial Sequence: Synthetic peptide
  XENP021347 vhCDR2
WIDPENGDTEYAPKFQG

SEQ ID NO: 26368 - protein, 9 aa, Artificial Sequence
  Description of Artificial Sequence: Synthetic peptide
  XENP021347 vhCDR3
RGVRQGLDY

SEQ ID NO: 26369 - protein, 214 aa, Artificial Sequence; identical to SEQ ID NO: 17250
  Description of Artificial Sequence: Synthetic polypeptide
  XENP021347 2A11_H1.116_L2_Fab Light Chain

SEQ ID NO: 26370 - protein, 107 aa, Artificial Sequence; identical to SEQ ID NO: 17251
  Description of Artificial Sequence: Synthetic polypeptide
  VL of XENP021347

SEQ ID NO: 26371 - protein, 11 aa, Artificial Sequence
  Description of Artificial Sequence: Synthetic peptide
  XENP021347 vlCDR1
QASQDIGNYLN

SEQ ID NO: 26372 - protein, 7 aa, Artificial Sequence
  Description of Artificial Sequence: Synthetic peptide
  XENP021347 vlCDR2
YTSRLHS

SEQ ID NO: 26373 - protein, 9 aa, Artificial Sequence
  Description of Artificial Sequence: Synthetic peptide
  XENP021347 vlCDR3
QQGNTLPYT

SEQ ID NO: 26374 - protein, 223 aa, Artificial Sequence; identical to SEQ ID NO: 25194
  Description of Artificial Sequence: Synthetic polypeptide
  XENP021348 2A11_H1_L2.1_Fab Heavy Chain

SEQ ID NO: 26375 - protein, 118 aa, Artificial Sequence; identical to SEQ ID NO: 17236
  Description of Artificial Sequence: Synthetic polypeptide
  VH of XENP021348

SEQ ID NO: 26376 - protein, 5 aa, Artificial Sequence
  Description of Artificial Sequence: Synthetic peptide
  XENP021348 vhCDR1
DYYMH

SEQ ID NO: 26377 - protein, 17 aa, Artificial Sequence
  Description of Artificial Sequence: Synthetic peptide
  XENP021348 vhCDR2
WIDPENGDTEYAPKFQG

SEQ ID NO: 26378 - protein, 9 aa, Artificial Sequence
  Description of Artificial Sequence: Synthetic peptide
  XENP021348 vhCDR3
RGVRQALDY

SEQ ID NO: 26379 - protein, 214 aa, Artificial Sequence
  Description of Artificial Sequence: Synthetic polypeptide
  XENP021348 2A11_H1_L2.1_Fab Light Chain
DIQMTQSPAFLSVTPGEKVTITCQASEDIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26380 - protein, 107 aa, Artificial Sequence
  Description of Artificial Sequence: Synthetic polypeptide
  VL of XENP021348
DIQMTQSPAFLSVTPGEKVTITCQASEDIGNYLNWFQQKPDQTVKLLIYYTSRLHSGVPSRFSGSGSGTDYTFTISSLEAEDAATYFCQQGNTLPYTFGGGTKVEIK

SEQ ID NO: 26381 - protein, 11 aa, Artificial Sequence
  Description of Artificial Sequence: Synthetic peptide
  XENP021348 vlCDR1
QASEDIGNYLN

SEQ ID NO: 26382 - protein, 7 aa, Artificial Sequence
  Description of Artificial Sequence: Synthetic peptide
  XENP021348 vlCDR2
YTSRLHS

SEQ ID NO: 26383 - protein, 9 aa, Artificial Sequence
  Description of Artificial Sequence: Synthetic peptide
  XENP021348 vlCDR3
QQGNTLPYT

SEQ ID NO: 26384 - protein, 223 aa, Artificial Sequence; identical to SEQ ID NO: 25194
  Description of Artificial Sequence: Synthetic polypeptide
  XENP021349 2A11_H1_L2.2_Fab Heavy Chain

SEQ ID NO: 26385 - protein, 118 aa, Artificial Sequence; identical to SEQ ID NO: 17236
  Description of Artificial Sequence: Synthetic polypeptide
  VH of XENP021349

SEQ ID NO: 26386 - protein, 5 aa, Artificial Sequence
  Description of Artificial Sequence: Synthetic peptide
  XENP021349 vhCDR1
DYYMH

SEQ ID NO: 26387 - protein, 17 aa, Artificial Sequence
  Description of Artificial Sequence: Synthetic peptide
  XENP021349 vhCDR2
WIDPENGDTEYAPKFQG

SEQ ID NO: 26388 - protein, 9 aa, Artificial Sequence
  Description of Artificial Sequence: Synthetic peptide
  XENP021349 vhCDR3
RGVRQALDY

SEQ ID NO: 26389 - protein, 214 aa, Artificial Sequence
  Description of Artificial Sequence: Synthetic polypeptide
  XENP021349 2A11_H1_L2.2_Fab Light Chain
DIQMTQSPAFLSVTPGEKVTITCQASQNIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26390 - protein, 107 aa, Artificial Sequence
  Description of Artificial Sequence: Synthetic polypeptide
  VL of XENP021349
DIQMTQSPAFLSVTPGEKVTITCQASQNIGNYLNWFQQKPDQTVKLLIYYTSRLHSGVPSRFSGSGSGTDYTFTISSLEAEDAATYFCQQGNTLPYTFGGGTKVEIK

SEQ ID NO: 26391 - protein, 11 aa, Artificial Sequence
  Description of Artificial Sequence: Synthetic peptide
  XENP021349 vlCDR1
QASQNIGNYLN

SEQ ID NO: 26392 - protein, 7 aa, Artificial Sequence
  Description of Artificial Sequence: Synthetic peptide
  XENP021349 vlCDR2
YTSRLHS

SEQ ID NO: 26393 - protein, 9 aa, Artificial Sequence
  Description of Artificial Sequence: Synthetic peptide
  XENP021349 vlCDR3
QQGNTLPYT

SEQ ID NO: 26394 - protein, 223 aa, Artificial Sequence; identical to SEQ ID NO: 25194
  Description of Artificial Sequence: Synthetic polypeptide
  XENP021350 2A11_H1_L2.3_Fab Heavy Chain

SEQ ID NO: 26395 - protein, 118 aa, Artificial Sequence; identical to SEQ ID NO: 17236
  Description of Artificial Sequence: Synthetic polypeptide
  VH of XENP021350

SEQ ID NO: 26396 - protein, 5 aa, Artificial Sequence
  Description of Artificial Sequence: Synthetic peptide
  XENP021350 vhCDR1
DYYMH

SEQ ID NO: 26397 - protein, 17 aa, Artificial Sequence
  Description of Artificial Sequence: Synthetic peptide
  XENP021350 vhCDR2
WIDPENGDTEYAPKFQG

SEQ ID NO: 26398 - protein, 9 aa, Artificial Sequence
  Description of Artificial Sequence: Synthetic peptide
  XENP021350 vhCDR3
RGVRQALDY

SEQ ID NO: 26399 - protein, 214 aa, Artificial Sequence
  Description of Artificial Sequence: Synthetic polypeptide
  XENP021350 2A11_H1_L2.3_Fab Light Chain
DIQMTQSPAFLSVTPGEKVTITCQASQEIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26400 - protein, 107 aa, Artificial Sequence
  Description of Artificial Sequence: Synthetic polypeptide
  VL of XENP021350
DIQMTQSPAFLSVTPGEKVTITCQASQEIGNYLNWFQQKPDQTVKLLIYYTSRLHSGVPSRFSGSGSGTDYTFTISSLEAEDAATYFCQQGNTLPYTFGGGTKVEIK

SEQ ID NO: 26401 - protein, 11 aa, Artificial Sequence
  Description of Artificial Sequence: Synthetic peptide
  XENP021350 vlCDR1
QASQEIGNYLN

SEQ ID NO: 26402 - protein, 7 aa, Artificial Sequence
  Description of Artificial Sequence: Synthetic peptide
  XENP021350 vlCDR2
YTSRLHS

SEQ ID NO: 26403 - protein, 9 aa, Artificial Sequence
  Description of Artificial Sequence: Synthetic peptide
  XENP021350 vlCDR3
QQGNTLPYT

SEQ ID NO: 26404 - protein, 223 aa, Artificial Sequence; identical to SEQ ID NO: 25194
  Description of Artificial Sequence: Synthetic polypeptide
  XENP021351 2A11_H1_L2.4_Fab Heavy Chain

SEQ ID NO: 26405 - protein, 118 aa, Artificial Sequence; identical to SEQ ID NO: 17236
  Description of Artificial Sequence: Synthetic polypeptide
  VH of XENP021351

SEQ ID NO: 26406 - protein, 5 aa, Artificial Sequence
  Description of Artificial Sequence: Synthetic peptide
  XENP021351 vhCDR1
DYYMH

SEQ ID NO: 26407 - protein, 17 aa, Artificial Sequence
  Description of Artificial Sequence: Synthetic peptide
  XENP021351 vhCDR2
WIDPENGDTEYAPKFQG

SEQ ID NO: 26408 - protein, 9 aa, Artificial Sequence
  Description of Artificial Sequence: Synthetic peptide
  XENP021351 vhCDR3
RGVRQALDY

SEQ ID NO: 26409 - protein, 214 aa, Artificial Sequence
  Description of Artificial Sequence: Synthetic polypeptide
  XENP021351 2A11_H1_L2.4_Fab Light Chain
DIQMTQSPAFLSVTPGEKVTITCQASQHIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26410 - protein, 107 aa, Artificial Sequence
  Description of Artificial Sequence: Synthetic polypeptide
  VL of XENP021351
DIQMTQSPAFLSVTPGEKVTITCQASQHIGNYLNWFQQKPDQTVKLLIYYTSRLHSGVPSRFSGSGSGTDYTFTISSLEAEDAATYFCQQGNTLPYTFGGGTKVEIK

SEQ ID NO: 26411 - protein, 11 aa, Artificial Sequence
  Description of Artificial Sequence: Synthetic peptide
  XENP021351 vlCDR1
QASQHIGNYLN

SEQ ID NO: 26412 - protein, 7 aa, Artificial Sequence
  Description of Artificial Sequence: Synthetic peptide
  XENP021351 vlCDR2
YTSRLHS

SEQ ID NO: 26413 - protein, 9 aa, Artificial Sequence
  Description of Artificial Sequence: Synthetic peptide
  XENP021351 vlCDR3
QQGNTLPYT

SEQ ID NO: 26414 - protein, 223 aa, Artificial Sequence; identical to SEQ ID NO: 25194
  Description of Artificial Sequence: Synthetic polypeptide
  XENP021352 2A11_H1_L2.5_Fab Heavy Chain

SEQ ID NO: 26415 - protein, 118 aa, Artificial Sequence; identical to SEQ ID NO: 17236
  Description of Artificial Sequence: Synthetic polypeptide
  VH of XENP021352

SEQ ID NO: 26416 - protein, 5 aa, Artificial Sequence
  Description of Artificial Sequence: Synthetic peptide
  XENP021352 vhCDR1
DYYMH

SEQ ID NO: 26417 - protein, 17 aa, Artificial Sequence
  Description of Artificial Sequence: Synthetic peptide
  XENP021352 vhCDR2
WIDPENGDTEYAPKFQG

SEQ ID NO: 26418 - protein, 9 aa, Artificial Sequence
  Description of Artificial Sequence: Synthetic peptide
  XENP021352 vhCDR3
RGVRQALDY

SEQ ID NO: 26419 - protein, 214 aa, Artificial Sequence
  Description of Artificial Sequence: Synthetic polypeptide
  XENP021352 2A11_H1_L2.5_Fab Light Chain
DIQMTQSPAFLSVTPGEKVTITCQASQSIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26420 - protein, 107 aa, Artificial Sequence
  Description of Artificial Sequence: Synthetic polypeptide
  VL of XENP021352
DIQMTQSPAFLSVTPGEKVTITCQASQSIGNYLNWFQQKPDQTVKLLIYYTSRLHSGVPSRFSGSGSGTDYTFTISSLEAEDAATYFCQQGNTLPYTFGGGTKVEIK

SEQ ID NO: 26421 - protein, 11 aa, Artificial Sequence
  Description of Artificial Sequence: Synthetic peptide
  XENP021352 vlCDR1
QASQSIGNYLN

SEQ ID NO: 26422 - protein, 7 aa, Artificial Sequence
  Description of Artificial Sequence: Synthetic peptide
  XENP021352 vlCDR2
YTSRLHS

SEQ ID NO: 26423 - protein, 9 aa, Artificial Sequence
  Description of Artificial Sequence: Synthetic peptide
  XENP021352 vlCDR3
QQGNTLPYT

SEQ ID NO: 26424 - protein, 223 aa, Artificial Sequence; identical to SEQ ID NO: 25194
  Description of Artificial Sequence: Synthetic polypeptide
  XENP021353 2A11_H1_L2.6_Fab Heavy Chain

SEQ ID NO: 26425 - protein, 118 aa, Artificial Sequence; identical to SEQ ID NO: 17236
  Description of Artificial Sequence: Synthetic polypeptide
  VH of XENP021353

SEQ ID NO: 26426 - protein, 5 aa, Artificial Sequence
  Description of Artificial Sequence: Synthetic peptide
  XENP021353 vhCDR1
DYYMH

SEQ ID NO: 26427 - protein, 17 aa, Artificial Sequence
  Description of Artificial Sequence: Synthetic peptide
  XENP021353 vhCDR2
WIDPENGDTEYAPKFQG

SEQ ID NO: 26428 - protein, 9 aa, Artificial Sequence
  Description of Artificial Sequence: Synthetic peptide
  XENP021353 vhCDR3
RGVRQALDY

SEQ ID NO: 26429 - protein, 214 aa, Artificial Sequence
  Description of Artificial Sequence: Synthetic polypeptide
  XENP021353 2A11_H1_L2.6_Fab Light Chain
DIQMTQSPAFLSVTPGEKVTITCQASQRIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26430 - protein, 107 aa, Artificial Sequence
  Description of Artificial Sequence: Synthetic polypeptide
  VL of XENP021353
DIQMTQSPAFLSVTPGEKVTITCQASQRIGNYLNWFQQKPDQTVKLLIYYTSRLHSGVPSRFSGSGSGTDYTFTISSLEAEDAATYFCQQGNTLPYTFGGGTKVEIK

SEQ ID NO: 26431 - protein, 11 aa, Artificial Sequence
  Description of Artificial Sequence: Synthetic peptide
  XENP021353 vlCDR1
QASQRIGNYLN

SEQ ID NO: 26432 - protein, 7 aa, Artificial Sequence
  Description of Artificial Sequence: Synthetic peptide
  XENP021353 vlCDR2
YTSRLHS

SEQ ID NO: 26433 - protein, 9 aa, Artificial Sequence
  Description of Artificial Sequence: Synthetic peptide
  XENP021353 vlCDR3
QQGNTLPYT

SEQ ID NO: 26434 - protein, 223 aa, Artificial Sequence; identical to SEQ ID NO: 25194
  Description of Artificial Sequence: Synthetic polypeptide
  XENP021354 2A11_H1_L2.7_Fab Heavy Chain

SEQ ID NO: 26435 - protein, 118 aa, Artificial Sequence; identical to SEQ ID NO: 17236
  Description of Artificial Sequence: Synthetic polypeptide
  VH of XENP021354

SEQ ID NO: 26436 - protein, 5 aa, Artificial Sequence
  Description of Artificial Sequence: Synthetic peptide
  XENP021354 vhCDR1
DYYMH

SEQ ID NO: 26437 - protein, 17 aa, Artificial Sequence
  Description of Artificial Sequence: Synthetic peptide
  XENP021354 vhCDR2
WIDPENGDTEYAPKFQG

SEQ ID NO: 26438 - protein, 9 aa, Artificial Sequence
  Description of Artificial Sequence: Synthetic peptide
  XENP021354 vhCDR3
RGVRQALDY

SEQ ID NO: 26439 - protein, 214 aa, Artificial Sequence
  Description of Artificial Sequence: Synthetic polypeptide
  XENP021354 2A11_H1_L2.7_Fab Light Chain
DIQMTQSPAFLSVTPGEKVTITCQASQLIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26440 - protein, 107 aa, Artificial Sequence
  Description of Artificial Sequence: Synthetic polypeptide
  VL of XENP021354
DIQMTQSPAFLSVTPGEKVTITCQASQLIGNYLNWFQQKPDQTVKLLIYYTSRLHSGVPSRFSGSGSGTDYTFTISSLEAEDAATYFCQQGNTLPYTFGGGTKVEIK

SEQ ID NO: 26441 - protein, 11 aa, Artificial Sequence
  Description of Artificial Sequence: Synthetic peptide
  XENP021354 vlCDR1
QASQLIGNYLN

SEQ ID NO: 26442 - protein, 7 aa, Artificial Sequence
  Description of Artificial Sequence: Synthetic peptide
  XENP021354 vlCDR2
YTSRLHS

SEQ ID NO: 26443 - protein, 9 aa, Artificial Sequence
  Description of Artificial Sequence: Synthetic peptide
  XENP021354 vlCDR3
QQGNTLPYT

SEQ ID NO: 26444 - protein, 223 aa, Artificial Sequence; identical to SEQ ID NO: 25194
  Description of Artificial Sequence: Synthetic polypeptide
  XENP021355 2A11_H1_L2.8_Fab Heavy Chain

SEQ ID NO: 26445 - protein, 118 aa, Artificial Sequence; identical to SEQ ID NO: 17236
  Description of Artificial Sequence: Synthetic polypeptide
  VH of XENP021355

SEQ ID NO: 26446 - protein, 5 aa, Artificial Sequence
  Description of Artificial Sequence: Synthetic peptide
  XENP021355 vhCDR1
DYYMH

SEQ ID NO: 26447 - protein, 17 aa, Artificial Sequence
  Description of Artificial Sequence: Synthetic peptide
  XENP021355 vhCDR2
WIDPENGDTEYAPKFQG

SEQ ID NO: 26448 - protein, 9 aa, Artificial Sequence
  Description of Artificial Sequence: Synthetic peptide
  XENP021355 vhCDR3
RGVRQALDY

SEQ ID NO: 26449 - protein, 214 aa, Artificial Sequence
  Description of Artificial Sequence: Synthetic polypeptide
  XENP021355 2A11_H1_L2.8_Fab Light Chain
DIQMTQSPAFLSVTPGEKVTITCQASQTIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26450 - protein, 107 aa, Artificial Sequence
  Description of Artificial Sequence: Synthetic polypeptide
  VL of XENP021355
DIQMTQSPAFLSVTPGEKVTITCQASQTIGNYLNWFQQKPDQTVKLLIYYTSRLHSGVPSRFSGSGSGTDYTFTISSLEAEDAATYFCQQGNTLPYTFGGGTKVEIK

SEQ ID NO: 26451 - protein, 11 aa, Artificial Sequence
  Description of Artificial Sequence: Synthetic peptide
  XENP021355 vlCDR1
QASQTIGNYLN

SEQ ID NO: 26452 - protein, 7 aa, Artificial Sequence
  Description of Artificial Sequence: Synthetic peptide
  XENP021355 vlCDR2
YTSRLHS

SEQ ID NO: 26453 - protein, 9 aa, Artificial Sequence
  Description of Artificial Sequence: Synthetic peptide
  XENP021355 vlCDR3
QQGNTLPYT

SEQ ID NO: 26454 - protein, 223 aa, Artificial Sequence; identical to SEQ ID NO: 25194
  Description of Artificial Sequence: Synthetic polypeptide
  XENP021356 2A11_H1_L2.9_Fab Heavy Chain

SEQ ID NO: 26455 - protein, 118 aa, Artificial Sequence; identical to SEQ ID NO: 17236
  Description of Artificial Sequence: Synthetic polypeptide
  VH of XENP021356

SEQ ID NO: 26456 - protein, 5 aa, Artificial Sequence
  Description of Artificial Sequence: Synthetic peptide
  XENP021356 vhCDR1
DYYMH

SEQ ID NO: 26457 - protein, 17 aa, Artificial Sequence
  Description of Artificial Sequence: Synthetic peptide
  XENP021356 vhCDR2
WIDPENGDTEYAPKFQG

SEQ ID NO: 26458 - protein, 9 aa, Artificial Sequence
  Description of Artificial Sequence: Synthetic peptide
  XENP021356 vhCDR3
RGVRQALDY

SEQ ID NO: 26459 - protein, 214 aa, Artificial Sequence
  Description of Artificial Sequence: Synthetic polypeptide
  XENP021356 2A11_H1_L2.9_Fab Light Chain
DIQMTQSPAFLSVTPGEKVTITCQASQQIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26460 - protein, 107 aa, Artificial Sequence
  Description of Artificial Sequence: Synthetic polypeptide
  VL of XENP021356
DIQMTQSPAFLSVTPGEKVTITCQASQQIGNYLNWFQQKPDQTVKLLIYYTSRLHSGVPSRFSGSGSGTDYTFTISSLEAEDAATYFCQQGNTLPYTFGGGTKVEIK

SEQ ID NO: 26461 - protein, 11 aa, Artificial Sequence
  Description of Artificial Sequence: Synthetic peptide
  XENP021356 vlCDR1
QASQQIGNYLN

SEQ ID NO: 26462 - protein, 7 aa, Artificial Sequence
  Description of Artificial Sequence: Synthetic peptide
  XENP021356 vlCDR2
YTSRLHS

SEQ ID NO: 26463 - protein, 9 aa, Artificial Sequence
  Description of Artificial Sequence: Synthetic peptide
  XENP021356 vlCDR3
QQGNTLPYT

SEQ ID NO: 26464 - protein, 223 aa, Artificial Sequence; identical to SEQ ID NO: 25194
  Description of Artificial Sequence: Synthetic polypeptide
  XENP021357 2A11_H1_L2.10_Fab Heavy Chain

SEQ ID NO: 26465 - protein, 118 aa, Artificial Sequence; identical to SEQ ID NO: 17236
  Description of Artificial Sequence: Synthetic polypeptide
  VH of XENP021357

SEQ ID NO: 26466 - protein, 5 aa, Artificial Sequence
  Description of Artificial Sequence: Synthetic peptide
  XENP021357 vhCDR1
DYYMH

SEQ ID NO: 26467 - protein, 17 aa, Artificial Sequence
  Description of Artificial Sequence: Synthetic peptide
  XENP021357 vhCDR2
WIDPENGDTEYAPKFQG

SEQ ID NO: 26468 - protein, 9 aa, Artificial Sequence
  Description of Artificial Sequence: Synthetic peptide
  XENP021357 vhCDR3
RGVRQALDY

SEQ ID NO: 26469 - protein, 214 aa, Artificial Sequence
  Description of Artificial Sequence: Synthetic polypeptide
  XENP021357 2A11_H1_L2.10_Fab Light Chain
DIQMTQSPAFLSVTPGEKVTITCQASQYIGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26470 - protein, 107 aa, Artificial Sequence
  Description of Artificial Sequence: Synthetic polypeptide
  VL of XENP021357
DIQMTQSPAFLSVTPGEKVTITCQASQYIGNYLNWFQQKPDQTVKLLIYYTSRLHSGVPSRFSGSGSGTDYTFTISSLEAEDAATYFCQQGNTLPYTFGGGTKVEIK

SEQ ID NO: 26471 - protein, 11 aa, Artificial Sequence
  Description of Artificial Sequence: Synthetic peptide
  XENP021357 vlCDR1
QASQYIGNYLN

SEQ ID NO: 26472 - protein, 7 aa, Artificial Sequence
  Description of Artificial Sequence: Synthetic peptide
  XENP021357 vlCDR2
YTSRLHS

SEQ ID NO: 26473 - protein, 9 aa, Artificial Sequence
  Description of Artificial Sequence: Synthetic peptide
  XENP021357 vlCDR3
QQGNTLPYT

SEQ ID NO: 26474 - protein, 223 aa, Artificial Sequence; identical to SEQ ID NO: 25194
  Description of Artificial Sequence: Synthetic polypeptide
  XENP021358 2A11_H1_L2.11_Fab Heavy Chain

SEQ ID NO: 26475 - protein, 118 aa, Artificial Sequence; identical to SEQ ID NO: 17236
  Description of Artificial Sequence: Synthetic polypeptide
  VH of XENP021358

SEQ ID NO: 26476 - protein, 5 aa, Artificial Sequence
  Description of Artificial Sequence: Synthetic peptide
  XENP021358 vhCDR1
DYYMH

SEQ ID NO: 26477 - protein, 17 aa, Artificial Sequence
  Description of Artificial Sequence: Synthetic peptide
  XENP021358 vhCDR2
WIDPENGDTEYAPKFQG

SEQ ID NO: 26478 - protein, 9 aa, Artificial Sequence
  Description of Artificial Sequence: Synthetic peptide
  XENP021358 vhCDR3
RGVRQALDY

SEQ ID NO: 26479 - protein, 214 aa, Artificial Sequence
  Description of Artificial Sequence: Synthetic polypeptide
  XENP021358 2A11_H1_L2.11_Fab Light Chain
DIQMTQSPAFLSVTPGEKVTITCQASQDVGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26480 - protein, 107 aa, Artificial Sequence
  Description of Artificial Sequence: Synthetic polypeptide
  VL of XENP021358
DIQMTQSPAFLSVTPGEKVTITCQASQDVGNYLNWFQQKPDQTVKLLIYYTSRLHSGVPSRFSGSGSGTDYTFTISSLEAEDAATYFCQQGNTLPYTFGGGTKVEIK

SEQ ID NO: 26481 - protein, 11 aa, Artificial Sequence
  Description of Artificial Sequence: Synthetic peptide
  XENP021358 vlCDR1
QASQDVGNYLN

SEQ ID NO: 26482 - protein, 7 aa, Artificial Sequence
  Description of Artificial Sequence: Synthetic peptide
  XENP021358 vlCDR2
YTSRLHS

SEQ ID NO: 26483 - protein, 9 aa, Artificial Sequence
  Description of Artificial Sequence: Synthetic peptide
  XENP021358 vlCDR3
QQGNTLPYT

SEQ ID NO: 26484 - protein, 223 aa, Artificial Sequence; identical to SEQ ID NO: 25194
  Description of Artificial Sequence: Synthetic polypeptide
  XENP021359 2A11_H1_L2.12_Fab Heavy Chain

SEQ ID NO: 26485 - protein, 118 aa, Artificial Sequence; identical to SEQ ID NO: 17236
  Description of Artificial Sequence: Synthetic polypeptide
  VH of XENP021359

SEQ ID NO: 26486 - protein, 5 aa, Artificial Sequence
  Description of Artificial Sequence: Synthetic peptide
  XENP021359 vhCDR1
DYYMH

SEQ ID NO: 26487 - protein, 17 aa, Artificial Sequence
  Description of Artificial Sequence: Synthetic peptide
  XENP021359 vhCDR2
WIDPENGDTEYAPKFQG

SEQ ID NO: 26488 - protein, 9 aa, Artificial Sequence
  Description of Artificial Sequence: Synthetic peptide
  XENP021359 vhCDR3
RGVRQALDY

SEQ ID NO: 26489 - protein, 214 aa, Artificial Sequence
  Description of Artificial Sequence: Synthetic polypeptide
  XENP021359 2A11_H1_L2.12_Fab Light Chain
DIQMTQSPAFLSVTPGEKVTITCQASQDLGNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26490 - protein, 107 aa, Artificial Sequence
  Description of Artificial Sequence: Synthetic polypeptide
  VL of XENP021359
DIQMTQSPAFLSVTPGEKVTITCQASQDLGNYLNWFQQKPDQTVKLLIYYTSRLHSGVPSRFSGSGSGTDYTFTISSLEAEDAATYFCQQGNTLPYTFGGGTKVEIK

SEQ ID NO: 26491 - protein, 11 aa, Artificial Sequence
  Description of Artificial Sequence: Synthetic peptide
  XENP021359 vlCDR1
QASQDLGNYLN

SEQ ID NO: 26492 - protein, 7 aa, Artificial Sequence
  Description of Artificial Sequence: Synthetic peptide
  XENP021359 vlCDR2
YTSRLHS

SEQ ID NO: 26493 - protein, 9 aa, Artificial Sequence
  Description of Artificial Sequence: Synthetic peptide
  XENP021359 vlCDR3
QQGNTLPYT

SEQ ID NO: 26494 - protein, 223 aa, Artificial Sequence; identical to SEQ ID NO: 25194
  Description of Artificial Sequence: Synthetic polypeptide
  XENP021360 2A11_H1_L2.13_Fab Heavy Chain

SEQ ID NO: 26495 - protein, 118 aa, Artificial Sequence; identical to SEQ ID NO: 17236
  Description of Artificial Sequence: Synthetic polypeptide
  VH of XENP021360

SEQ ID NO: 26496 - protein, 5 aa, Artificial Sequence
  Description of Artificial Sequence: Synthetic peptide
  XENP021360 vhCDR1
DYYMH

SEQ ID NO: 26497 - protein, 17 aa, Artificial Sequence
  Description of Artificial Sequence: Synthetic peptide
  XENP021360 vhCDR2
WIDPENGDTEYAPKFQG

SEQ ID NO: 26498 - protein, 9 aa, Artificial Sequence
  Description of Artificial Sequence: Synthetic peptide
  XENP021360 vhCDR3
RGVRQALDY

SEQ ID NO: 26499 - protein, 214 aa, Artificial Sequence
  Description of Artificial Sequence: Synthetic polypeptide
  XENP021360 2A11_H1_L2.13_Fab Light Chain
DIQMTQSPAFLSVTPGEKVTITCQASQDIANYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26500 - protein, 107 aa, Artificial Sequence
  Description of Artificial Sequence: Synthetic polypeptide
  VL of XENP021360
DIQMTQSPAFLSVTPGEKVTITCQASQDIANYLNWFQQKPDQTVKLLIYYTSRLHSGVPSRFSGSGSGTDYTFTISSLEAEDAATYFCQQGNTLPYTFGGGTKVEIK

SEQ ID NO: 26501 - protein, 11 aa, Artificial Sequence
  Description of Artificial Sequence: Synthetic peptide
  XENP021360 vlCDR1
QASQDIANYLN

SEQ ID NO: 26502 - protein, 7 aa, Artificial Sequence
  Description of Artificial Sequence: Synthetic peptide
  XENP021360 vlCDR2
YTSRLHS

SEQ ID NO: 26503 - protein, 9 aa, Artificial Sequence
  Description of Artificial Sequence: Synthetic peptide
  XENP021360 vlCDR3
QQGNTLPYT

SEQ ID NO: 26504 - protein, 223 aa, Artificial Sequence; identical to SEQ ID NO: 25194
  Description of Artificial Sequence: Synthetic polypeptide
  XENP021361 2A11_H1_L2.14_Fab Heavy Chain

SEQ ID NO: 26505 - protein, 118 aa, Artificial Sequence; identical to SEQ ID NO: 17236
  Description of Artificial Sequence: Synthetic polypeptide
  VH of XENP021361

SEQ ID NO: 26506 - protein, 5 aa, Artificial Sequence
  Description of Artificial Sequence: Synthetic peptide
  XENP021361 vhCDR1
DYYMH

SEQ ID NO: 26507 - protein, 17 aa, Artificial Sequence
  Description of Artificial Sequence: Synthetic peptide
  XENP021361 vhCDR2
WIDPENGDTEYAPKFQG

SEQ ID NO: 26508 - protein, 9 aa, Artificial Sequence
  Description of Artificial Sequence: Synthetic peptide
  XENP021361 vhCDR3
RGVRQALDY

SEQ ID NO: 26509 - protein, 214 aa, Artificial Sequence
  Description of Artificial Sequence: Synthetic polypeptide
  XENP021361 2A11_H1_L2.14_Fab Light Chain
DIQMTQSPAFLSVTPGEKVTITCQASQDISNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26510 - protein, 107 aa, Artificial Sequence
  Description of Artificial Sequence: Synthetic polypeptide
  VL of XENP021361
DIQMTQSPAFLSVTPGEKVTITCQASQDISNYLNWFQQKPDQTVKLLIYYTSRLHSGVPSRFSGSGSGTDYTFTISSLEAEDAATYFCQQGNTLPYTFGGGTKVEIK

SEQ ID NO: 26511 - protein, 11 aa, Artificial Sequence
  Description of Artificial Sequence: Synthetic peptide
  XENP021361 vlCDR1
QASQDISNYLN

SEQ ID NO: 26512 - protein, 7 aa, Artificial Sequence
  Description of Artificial Sequence: Synthetic peptide
  XENP021361 vlCDR2
YTSRLHS

SEQ ID NO: 26513 - protein, 9 aa, Artificial Sequence
  Description of Artificial Sequence: Synthetic peptide
  XENP021361 vlCDR3
QQGNTLPYT

SEQ ID NO: 26514 - protein, 223 aa, Artificial Sequence; identical to SEQ ID NO: 25194
  Description of Artificial Sequence: Synthetic polypeptide
  XENP021362 2A11_H1_L2.15_Fab Heavy Chain

SEQ ID NO: 26515 - protein, 118 aa, Artificial Sequence; identical to SEQ ID NO: 17236
  Description of Artificial Sequence: Synthetic polypeptide
  VH of XENP021362

SEQ ID NO: 26516 - protein, 5 aa, Artificial Sequence
  Description of Artificial Sequence: Synthetic peptide
  XENP021362 vhCDR1
DYYMH

SEQ ID NO: 26517 - protein, 17 aa, Artificial Sequence
  Description of Artificial Sequence: Synthetic peptide
  XENP021362 vhCDR2
WIDPENGDTEYAPKFQG

SEQ ID NO: 26518 - protein, 9 aa, Artificial Sequence
  Description of Artificial Sequence: Synthetic peptide
  XENP021362 vhCDR3
RGVRQALDY

SEQ ID NO: 26519 - protein, 214 aa, Artificial Sequence
  Description of Artificial Sequence: Synthetic polypeptide
  XENP021362 2A11_H1_L2.15_Fab Light Chain
DIQMTQSPAFLSVTPGEKVTITCQASQDIDNYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26520 - protein, 107 aa, Artificial Sequence
  Description of Artificial Sequence: Synthetic polypeptide
  VL of XENP021362
DIQMTQSPAFLSVTPGEKVTITCQASQDIDNYLNWFQQKPDQTVKLLIYYTSRLHSGVPSRFSGSGSGTDYTFTISSLEAEDAATYFCQQGNTLPYTFGGGTKVEIK

SEQ ID NO: 26521 - protein, 11 aa, Artificial Sequence
  Description of Artificial Sequence: Synthetic peptide
  XENP021362 vlCDR1
QASQDIDNYLN

SEQ ID NO: 26522 - protein, 7 aa, Artificial Sequence
  Description of Artificial Sequence: Synthetic peptide
  XENP021362 vlCDR2
YTSRLHS

SEQ ID NO: 26523 - protein, 9 aa, Artificial Sequence
  Description of Artificial Sequence: Synthetic peptide
  XENP021362 vlCDR3
QQGNTLPYT

SEQ ID NO: 26524 - protein, 223 aa, Artificial Sequence; identical to SEQ ID NO: 25194
  Description of Artificial Sequence: Synthetic polypeptide
  XENP021363 2A11_H1_L2.16_Fab Heavy Chain

SEQ ID NO: 26525 - protein, 118 aa, Artificial Sequence; identical to SEQ ID NO: 17236
  Description of Artificial Sequence: Synthetic polypeptide
  VH of XENP021363

SEQ ID NO: 26526 - protein, 5 aa, Artificial Sequence
  Description of Artificial Sequence: Synthetic peptide
  XENP021363 vhCDR1
DYYMH

SEQ ID NO: 26527 - protein, 17 aa, Artificial Sequence
  Description of Artificial Sequence: Synthetic peptide
  XENP021363 vhCDR2
WIDPENGDTEYAPKFQG

SEQ ID NO: 26528 - protein, 9 aa, Artificial Sequence
  Description of Artificial Sequence: Synthetic peptide
  XENP021363 vhCDR3
RGVRQALDY

SEQ ID NO: 26529 - protein, 214 aa, Artificial Sequence
  Description of Artificial Sequence: Synthetic polypeptide
  XENP021363 2A11_H1_L2.16_Fab Light Chain
DIQMTQSPAFLSVTPGEKVTITCQASQDIGDYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26530 - protein, 107 aa, Artificial Sequence
  Description of Artificial Sequence: Synthetic polypeptide
  VL of XENP021363
DIQMTQSPAFLSVTPGEKVTITCQASQDIGDYLNWFQQKPDQTVKLLIYYTSRLHSGVPSRFSGSGSGTDYTFTISSLEAEDAATYFCQQGNTLPYTFGGGTKVEIK

SEQ ID NO: 26531 - protein, 11 aa, Artificial Sequence
  Description of Artificial Sequence: Synthetic peptide
  XENP021363 vlCDR1
QASQDIGDYLN

SEQ ID NO: 26532 - protein, 7 aa, Artificial Sequence
  Description of Artificial Sequence: Synthetic peptide
  XENP021363 vlCDR2
YTSRLHS

SEQ ID NO: 26533 - protein, 9 aa, Artificial Sequence
  Description of Artificial Sequence: Synthetic peptide
  XENP021363 vlCDR3
QQGNTLPYT

SEQ ID NO: 26534 - protein, 223 aa, Artificial Sequence; identical to SEQ ID NO: 25194
  Description of Artificial Sequence: Synthetic polypeptide
  XENP021364 2A11_H1_L2.17_Fab Heavy Chain

SEQ ID NO: 26535 - protein, 118 aa, Artificial Sequence; identical to SEQ ID NO: 17236
  Description of Artificial Sequence: Synthetic polypeptide
  VH of XENP021364

SEQ ID NO: 26536 - protein, 5 aa, Artificial Sequence
  Description of Artificial Sequence: Synthetic peptide
  XENP021364 vhCDR1
DYYMH

SEQ ID NO: 26537 - protein, 17 aa, Artificial Sequence
  Description of Artificial Sequence: Synthetic peptide
  XENP021364 vhCDR2
WIDPENGDTEYAPKFQG

SEQ ID NO: 26538 - protein, 9 aa, Artificial Sequence
  Description of Artificial Sequence: Synthetic peptide
  XENP021364 vhCDR3
RGVRQALDY

SEQ ID NO: 26539 - protein, 214 aa, Artificial Sequence
  Description of Artificial Sequence: Synthetic polypeptide
  XENP021364 2A11_H1_L2.17_Fab Light Chain
DIQMTQSPAFLSVTPGEKVTITCQASQDIGHYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26540 - protein, 107 aa, Artificial Sequence
  Description of Artificial Sequence: Synthetic polypeptide
  VL of XENP021364
DIQMTQSPAFLSVTPGEKVTITCQASQDIGHYLNWFQQKPDQTVKLLIYYTSRLHSGVPSRFSGSGSGTDYTFTISSLEAEDAATYFCQQGNTLPYTFGGGTKVEIK

SEQ ID NO: 26541 - protein, 11 aa, Artificial Sequence
  Description of Artificial Sequence: Synthetic peptide
  XENP021364 vlCDR1
QASQDIGHYLN

SEQ ID NO: 26542 - protein, 7 aa, Artificial Sequence
  Description of Artificial Sequence: Synthetic peptide
  XENP021364 vlCDR2
YTSRLHS

SEQ ID NO: 26543 - protein, 9 aa, Artificial Sequence
  Description of Artificial Sequence: Synthetic peptide
  XENP021364 vlCDR3
QQGNTLPYT

SEQ ID NO: 26544 - protein, 223 aa, Artificial Sequence; identical to SEQ ID NO: 25194
  Description of Artificial Sequence: Synthetic polypeptide
  XENP021365 2A11_H1_L2.18_Fab Heavy Chain

SEQ ID NO: 26545 - protein, 118 aa, Artificial Sequence; identical to SEQ ID NO: 17236
  Description of Artificial Sequence: Synthetic polypeptide
  VH of XENP021365

SEQ ID NO: 26546 - protein, 5 aa, Artificial Sequence
  Description of Artificial Sequence: Synthetic peptide
  XENP021365 vhCDR1
DYYMH

SEQ ID NO: 26547 - protein, 17 aa, Artificial Sequence
  Description of Artificial Sequence: Synthetic peptide
  XENP021365 vhCDR2
WIDPENGDTEYAPKFQG

SEQ ID NO: 26548 - protein, 9 aa, Artificial Sequence
  Description of Artificial Sequence: Synthetic peptide
  XENP021365 vhCDR3
RGVRQALDY

SEQ ID NO: 26549 - protein, 214 aa, Artificial Sequence
  Description of Artificial Sequence: Synthetic polypeptide
  XENP021365 2A11_H1_L2.18_Fab Light Chain
DIQMTQSPAFLSVTPGEKVTITCQASQDIGEYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26550 - protein, 107 aa, Artificial Sequence
  Description of Artificial Sequence: Synthetic polypeptide
  VL of XENP021365
DIQMTQSPAFLSVTPGEKVTITCQASQDIGEYLNWFQQKPDQTVKLLIYYTSRLHSGVPSRFSGSGSGTDYTFTISSLEAEDAATYFCQQGNTLPYTFGGGTKVEIK

SEQ ID NO: 26551 - protein, 11 aa, Artificial Sequence
  Description of Artificial Sequence: Synthetic peptide
  XENP021365 vlCDR1
QASQDIGEYLN

SEQ ID NO: 26552 - protein, 7 aa, Artificial Sequence
  Description of Artificial Sequence: Synthetic peptide
  XENP021365 vlCDR2
YTSRLHS

SEQ ID NO: 26553 - protein, 9 aa, Artificial Sequence
  Description of Artificial Sequence: Synthetic peptide
  XENP021365 vlCDR3
QQGNTLPYT

SEQ ID NO: 26554 - protein, 223 aa, Artificial Sequence; identical to SEQ ID NO: 25194
  Description of Artificial Sequence: Synthetic polypeptide
  XENP021366 2A11_H1_L2.19_Fab Heavy Chain

SEQ ID NO: 26555 - protein, 118 aa, Artificial Sequence; identical to SEQ ID NO: 17236
  Description of Artificial Sequence: Synthetic polypeptide
  VH of XENP021366

SEQ ID NO: 26556 - protein, 5 aa, Artificial Sequence
  Description of Artificial Sequence: Synthetic peptide
  XENP021366 vhCDR1
DYYMH

SEQ ID NO: 26557 - protein, 17 aa, Artificial Sequence
  Description of Artificial Sequence: Synthetic peptide
  XENP021366 vhCDR2
WIDPENGDTEYAPKFQG

SEQ ID NO: 26558 - protein, 9 aa, Artificial Sequence
  Description of Artificial Sequence: Synthetic peptide
  XENP021366 vhCDR3
RGVRQALDY

SEQ ID NO: 26559 - protein, 214 aa, Artificial Sequence
  Description of Artificial Sequence: Synthetic polypeptide
  XENP021366 2A11_H1_L2.19_Fab Light Chain
DIQMTQSPAFLSVTPGEKVTITCQASQDIGSYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26560 - protein, 107 aa, Artificial Sequence
  Description of Artificial Sequence: Synthetic polypeptide
  VL of XENP021366
DIQMTQSPAFLSVTPGEKVTITCQASQDIGSYLNWFQQKPDQTVKLLIYYTSRLHSGVPSRFSGSGSGTDYTFTISSLEAEDAATYFCQQGNTLPYTFGGGTKVEIK

SEQ ID NO: 26561 - protein, 11 aa, Artificial Sequence
  Description of Artificial Sequence: Synthetic peptide
  XENP021366 vlCDR1
QASQDIGSYLN

SEQ ID NO: 26562 - protein, 7 aa, Artificial Sequence
  Description of Artificial Sequence: Synthetic peptide
  XENP021366 vlCDR2
YTSRLHS

SEQ ID NO: 26563 - protein, 9 aa, Artificial Sequence
  Description of Artificial Sequence: Synthetic peptide
  XENP021366 vlCDR3
QQGNTLPYT

SEQ ID NO: 26564 - protein, 223 aa, Artificial Sequence; identical to SEQ ID NO: 25194
  Description of Artificial Sequence: Synthetic polypeptide
  XENP021367 2A11_H1_L2.20_Fab Heavy Chain

SEQ ID NO: 26565 - protein, 118 aa, Artificial Sequence; identical to SEQ ID NO: 17236
  Description of Artificial Sequence: Synthetic polypeptide
  VH of XENP021367

SEQ ID NO: 26566 - protein, 5 aa, Artificial Sequence
  Description of Artificial Sequence: Synthetic peptide
  XENP021367 vhCDR1
DYYMH

SEQ ID NO: 26567 - protein, 17 aa, Artificial Sequence
  Description of Artificial Sequence: Synthetic peptide
  XENP021367 vhCDR2
WIDPENGDTEYAPKFQG

SEQ ID NO: 26568 - protein, 9 aa, Artificial Sequence
  Description of Artificial Sequence: Synthetic peptide
  XENP021367 vhCDR3
RGVRQALDY

SEQ ID NO: 26569 - protein, 214 aa, Artificial Sequence
  Description of Artificial Sequence: Synthetic polypeptide
  XENP021367 2A11_H1_L2.20_Fab Light Chain
DIQMTQSPAFLSVTPGEKVTITCQASQDIGRYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26570 - protein, 107 aa, Artificial Sequence
  Description of Artificial Sequence: Synthetic polypeptide
  VL of XENP021367
DIQMTQSPAFLSVTPGEKVTITCQASQDIGRYLNWFQQKPDQTVKLLIYYTSRLHSGVPSRFSGSGSGTDYTFTISSLEAEDAATYFCQQGNTLPYTFGGGTKVEIK

SEQ ID NO: 26571 - protein, 11 aa, Artificial Sequence
  Description of Artificial Sequence: Synthetic peptide
  XENP021367 vlCDR1
QASQDIGRYLN

SEQ ID NO: 26572 - protein, 7 aa, Artificial Sequence
  Description of Artificial Sequence: Synthetic peptide
  XENP021367 vlCDR2
YTSRLHS

SEQ ID NO: 26573 - protein, 9 aa, Artificial Sequence
  Description of Artificial Sequence: Synthetic peptide
  XENP021367 vlCDR3
QQGNTLPYT

SEQ ID NO: 26574 - protein, 223 aa, Artificial Sequence; identical to SEQ ID NO: 25194
  Description of Artificial Sequence: Synthetic polypeptide
  XENP021368 2A11_H1_L2.21_Fab Heavy Chain

SEQ ID NO: 26575 - protein, 118 aa, Artificial Sequence; identical to SEQ ID NO: 17236
  Description of Artificial Sequence: Synthetic polypeptide
  VH of XENP021368

SEQ ID NO: 26576 - protein, 5 aa, Artificial Sequence
  Description of Artificial Sequence: Synthetic peptide
  XENP021368 vhCDR1
DYYMH

SEQ ID NO: 26577 - protein, 17 aa, Artificial Sequence
  Description of Artificial Sequence: Synthetic peptide
  XENP021368 vhCDR2
WIDPENGDTEYAPKFQG

SEQ ID NO: 26578 - protein, 9 aa, Artificial Sequence
  Description of Artificial Sequence: Synthetic peptide
  XENP021368 vhCDR3
RGVRQALDY

SEQ ID NO: 26579 - protein, 214 aa, Artificial Sequence
  Description of Artificial Sequence: Synthetic polypeptide
  XENP021368 2A11_H1_L2.21_Fab Light Chain
DIQMTQSPAFLSVTPGEKVTITCQASQDIGLYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26580 - protein, 107 aa, Artificial Sequence
  Description of Artificial Sequence: Synthetic polypeptide
  VL of XENP021368
DIQMTQSPAFLSVTPGEKVTITCQASQDIGLYLNWFQQKPDQTVKLLIYYTSRLHSGVPSRFSGSGSGTDYTFTISSLEAEDAATYFCQQGNTLPYTFGGGTKVEIK

SEQ ID NO: 26581 - protein, 11 aa, Artificial Sequence
  Description of Artificial Sequence: Synthetic peptide
  XENP021368 vlCDR1
QASQDIGLYLN

SEQ ID NO: 26582 - protein, 7 aa, Artificial Sequence
  Description of Artificial Sequence: Synthetic peptide
  XENP021368 vlCDR2
YTSRLHS

SEQ ID NO: 26583 - protein, 9 aa, Artificial Sequence
  Description of Artificial Sequence: Synthetic peptide
  XENP021368 vlCDR3
QQGNTLPYT

SEQ ID NO: 26584 - protein, 223 aa, Artificial Sequence; identical to SEQ ID NO: 25194
  Description of Artificial Sequence: Synthetic polypeptide
  XENP021369 2A11_H1_L2.22_Fab Heavy Chain

SEQ ID NO: 26585 - protein, 118 aa, Artificial Sequence; identical to SEQ ID NO: 17236
  Description of Artificial Sequence: Synthetic polypeptide
  VH of XENP021369

SEQ ID NO: 26586 - protein, 5 aa, Artificial Sequence
  Description of Artificial Sequence: Synthetic peptide
  XENP021369 vhCDR1
DYYMH

SEQ ID NO: 26587 - protein, 17 aa, Artificial Sequence
  Description of Artificial Sequence: Synthetic peptide
  XENP021369 vhCDR2
WIDPENGDTEYAPKFQG

SEQ ID NO: 26588 - protein, 9 aa, Artificial Sequence
  Description of Artificial Sequence: Synthetic peptide
  XENP021369 vhCDR3
RGVRQALDY

SEQ ID NO: 26589 - protein, 214 aa, Artificial Sequence
  Description of Artificial Sequence: Synthetic polypeptide
  XENP021369 2A11_H1_L2.22_Fab Light Chain
DIQMTQSPAFLSVTPGEKVTITCQASQDIGTYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26590 - protein, 107 aa, Artificial Sequence
  Description of Artificial Sequence: Synthetic polypeptide
  VL of XENP021369
DIQMTQSPAFLSVTPGEKVTITCQASQDIGTYLNWFQQKPDQTVKLLIYYTSRLHSGVPSRFSGSGSGTDYTFTISSLEAEDAATYFCQQGNTLPYTFGGGTKVEIK

SEQ ID NO: 26591 - protein, 11 aa, Artificial Sequence
  Description of Artificial Sequence: Synthetic peptide
  XENP021369 vlCDR1
QASQDIGTYLN

SEQ ID NO: 26592 - protein, 7 aa, Artificial Sequence
  Description of Artificial Sequence: Synthetic peptide
  XENP021369 vlCDR2
YTSRLHS

SEQ ID NO: 26593 - protein, 9 aa, Artificial Sequence
  Description of Artificial Sequence: Synthetic peptide
  XENP021369 vlCDR3
QQGNTLPYT

SEQ ID NO: 26594 - protein, 223 aa, Artificial Sequence; identical to SEQ ID NO: 25194
  Description of Artificial Sequence: Synthetic polypeptide
  XENP021370 2A11_H1_L2.23_Fab Heavy Chain

SEQ ID NO: 26595 - protein, 118 aa, Artificial Sequence; identical to SEQ ID NO: 17236
  Description of Artificial Sequence: Synthetic polypeptide
  VH of XENP021370

SEQ ID NO: 26596 - protein, 5 aa, Artificial Sequence
  Description of Artificial Sequence: Synthetic peptide
  XENP021370 vhCDR1
DYYMH

SEQ ID NO: 26597 - protein, 17 aa, Artificial Sequence
  Description of Artificial Sequence: Synthetic peptide
  XENP021370 vhCDR2
WIDPENGDTEYAPKFQG

SEQ ID NO: 26598 - protein, 9 aa, Artificial Sequence
  Description of Artificial Sequence: Synthetic peptide
  XENP021370 vhCDR3
RGVRQALDY

SEQ ID NO: 26599 - protein, 214 aa, Artificial Sequence
  Description of Artificial Sequence: Synthetic polypeptide
  XENP021370 2A11_H1_L2.23_Fab Light Chain
DIQMTQSPAFLSVTPGEKVTITCQASQDIGKYLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26600 - protein, 107 aa, Artificial Sequence
  Description of Artificial Sequence: Synthetic polypeptide
  VL of XENP021370
DIQMTQSPAFLSVTPGEKVTITCQASQDIGKYLNWFQQKPDQTVKLLIYYTSRLHSGVPSRFSGSGSGTDYTFTISSLEAEDAATYFCQQGNTLPYTFGGGTKVEIK

SEQ ID NO: 26601 - protein, 11 aa, Artificial Sequence
  Description of Artificial Sequence: Synthetic peptide
  XENP021370 vlCDR1
QASQDIGKYLN

SEQ ID NO: 26602 - protein, 7 aa, Artificial Sequence
  Description of Artificial Sequence: Synthetic peptide
  XENP021370 vlCDR2
YTSRLHS

SEQ ID NO: 26603 - protein, 9 aa, Artificial Sequence
  Description of Artificial Sequence: Synthetic peptide
  XENP021370 vlCDR3
QQGNTLPYT

SEQ ID NO: 26604 - protein, 223 aa, Artificial Sequence; identical to SEQ ID NO: 25194
  Description of Artificial Sequence: Synthetic polypeptide
  XENP021371 2A11_H1_L2.24_Fab Heavy Chain

SEQ ID NO: 26605 - protein, 118 aa, Artificial Sequence; identical to SEQ ID NO: 17236
  Description of Artificial Sequence: Synthetic polypeptide
  VH of XENP021371

SEQ ID NO: 26606 - protein, 5 aa, Artificial Sequence
  Description of Artificial Sequence: Synthetic peptide
  XENP021371 vhCDR1
DYYMH

SEQ ID NO: 26607 - protein, 17 aa, Artificial Sequence
  Description of Artificial Sequence: Synthetic peptide
  XENP021371 vhCDR2
WIDPENGDTEYAPKFQG

SEQ ID NO: 26608 - protein, 9 aa, Artificial Sequence
  Description of Artificial Sequence: Synthetic peptide
  XENP021371 vhCDR3
RGVRQALDY

SEQ ID NO: 26609 - protein, 214 aa, Artificial Sequence
  Description of Artificial Sequence: Synthetic polypeptide
  XENP021371 2A11_H1_L2.24_Fab Light Chain
DIQMTQSPAFLSVTPGEKVTITCQASQDIGNFLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26610 - protein, 107 aa, Artificial Sequence
  Description of Artificial Sequence: Synthetic polypeptide
  VL of XENP021371
DIQMTQSPAFLSVTPGEKVTITCQASQDIGNFLNWFQQKPDQTVKLLIYYTSRLHSGVPSRFSGSGSGTDYTFTISSLEAEDAATYFCQQGNTLPYTFGGGTKVEIK

SEQ ID NO: 26611 - protein, 11 aa, Artificial Sequence
  Description of Artificial Sequence: Synthetic peptide
  XENP021371 vlCDR1
QASQDIGNFLN

SEQ ID NO: 26612 - protein, 7 aa, Artificial Sequence
  Description of Artificial Sequence: Synthetic peptide
  XENP021371 vlCDR2
YTSRLHS

SEQ ID NO: 26613 - protein, 9 aa, Artificial Sequence
  Description of Artificial Sequence: Synthetic peptide
  XENP021371 vlCDR3
QQGNTLPYT

SEQ ID NO: 26614 - protein, 223 aa, Artificial Sequence; identical to SEQ ID NO: 25194
  Description of Artificial Sequence: Synthetic polypeptide
  XENP021372 2A11_H1_L2.25_Fab Heavy Chain

SEQ ID NO: 26615 - protein, 118 aa, Artificial Sequence; identical to SEQ ID NO: 17236
  Description of Artificial Sequence: Synthetic polypeptide
  VH of XENP021372

SEQ ID NO: 26616 - protein, 5 aa, Artificial Sequence
  Description of Artificial Sequence: Synthetic peptide
  XENP021372 vhCDR1
DYYMH

SEQ ID NO: 26617 - protein, 17 aa, Artificial Sequence
  Description of Artificial Sequence: Synthetic peptide
  XENP021372 vhCDR2
WIDPENGDTEYAPKFQG

SEQ ID NO: 26618 - protein, 9 aa, Artificial Sequence
  Description of Artificial Sequence: Synthetic peptide
  XENP021372 vhCDR3
RGVRQALDY

SEQ ID NO: 26619 - protein, 214 aa, Artificial Sequence; identical to SEQ ID NO: 22179
  Description of Artificial Sequence: Synthetic polypeptide
  XENP021372 2A11_H1_L2.25_Fab Light Chain

SEQ ID NO: 26620 - protein, 107 aa, Artificial Sequence; identical to SEQ ID NO: 22180
  Description of Artificial Sequence: Synthetic polypeptide
  VL of XENP021372

SEQ ID NO: 26621 - protein, 11 aa, Artificial Sequence
  Description of Artificial Sequence: Synthetic peptide
  XENP021372 vlCDR1
QASQDIGNHLN

SEQ ID NO: 26622 - protein, 7 aa, Artificial Sequence
  Description of Artificial Sequence: Synthetic peptide
  XENP021372 vlCDR2
YTSRLHS

SEQ ID NO: 26623 - protein, 9 aa, Artificial Sequence
  Description of Artificial Sequence: Synthetic peptide
  XENP021372 vlCDR3
QQGNTLPYT

SEQ ID NO: 26624 - protein, 223 aa, Artificial Sequence; identical to SEQ ID NO: 25194
  Description of Artificial Sequence: Synthetic polypeptide
  XENP021373 2A11_H1_L2.26_Fab Heavy Chain

SEQ ID NO: 26625 - protein, 118 aa, Artificial Sequence; identical to SEQ ID NO: 17236
  Description of Artificial Sequence: Synthetic polypeptide
  VH of XENP021373

SEQ ID NO: 26626 - protein, 5 aa, Artificial Sequence
  Description of Artificial Sequence: Synthetic peptide
  XENP021373 vhCDR1
DYYMH

SEQ ID NO: 26627 - protein, 17 aa, Artificial Sequence
  Description of Artificial Sequence: Synthetic peptide
  XENP021373 vhCDR2
WIDPENGDTEYAPKFQG

SEQ ID NO: 26628 - protein, 9 aa, Artificial Sequence
  Description of Artificial Sequence: Synthetic peptide
  XENP021373 vhCDR3
RGVRQALDY

SEQ ID NO: 26629 - protein, 214 aa, Artificial Sequence
  Description of Artificial Sequence: Synthetic polypeptide
  XENP021373 2A11_H1_L2.26_Fab Light Chain
DIQMTQSPAFLSVTPGEKVTITCQASQDIGNLLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26630 - protein, 107 aa, Artificial Sequence
  Description of Artificial Sequence: Synthetic polypeptide
  VL of XENP021373
DIQMTQSPAFLSVTPGEKVTITCQASQDIGNLLNWFQQKPDQTVKLLIYYTSRLHSGVPSRFSGSGSGTDYTFTISSLEAEDAATYFCQQGNTLPYTFGGGTKVEIK

SEQ ID NO: 26631 - protein, 11 aa, Artificial Sequence
  Description of Artificial Sequence: Synthetic peptide
  XENP021373 vlCDR1
QASQDIGNLLN

SEQ ID NO: 26632 - protein, 7 aa, Artificial Sequence
  Description of Artificial Sequence: Synthetic peptide
  XENP021373 vlCDR2
YTSRLHS

SEQ ID NO: 26633 - protein, 9 aa, Artificial Sequence
  Description of Artificial Sequence: Synthetic peptide
  XENP021373 vlCDR3
QQGNTLPYT

SEQ ID NO: 26634 - protein, 223 aa, Artificial Sequence; identical to SEQ ID NO: 25194
  Description of Artificial Sequence: Synthetic polypeptide
  XENP021374 2A11_H1_L2.27_Fab Heavy Chain

SEQ ID NO: 26635 - protein, 118 aa, Artificial Sequence; identical to SEQ ID NO: 17236
  Description of Artificial Sequence: Synthetic polypeptide
  VH of XENP021374

SEQ ID NO: 26636 - protein, 5 aa, Artificial Sequence
  Description of Artificial Sequence: Synthetic peptide
  XENP021374 vhCDR1
DYYMH

SEQ ID NO: 26637 - protein, 17 aa, Artificial Sequence
  Description of Artificial Sequence: Synthetic peptide
  XENP021374 vhCDR2
WIDPENGDTEYAPKFQG

SEQ ID NO: 26638 - protein, 9 aa, Artificial Sequence
  Description of Artificial Sequence: Synthetic peptide
  XENP021374 vhCDR3
RGVRQALDY

SEQ ID NO: 26639 - protein, 214 aa, Artificial Sequence
  Description of Artificial Sequence: Synthetic polypeptide
  XENP021374 2A11_H1_L2.27_Fab Light Chain
DIQMTQSPAFLSVTPGEKVTITCQASQDIGNWLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26640 - protein, 107 aa, Artificial Sequence
  Description of Artificial Sequence: Synthetic polypeptide
  VL of XENP021374
DIQMTQSPAFLSVTPGEKVTITCQASQDIGNWLNWFQQKPDQTVKLLIYYTSRLHSGVPSRFSGSGSGTDYTFTISSLEAEDAATYFCQQGNTLPYTFGGGTKVEIK

SEQ ID NO: 26641 - protein, 11 aa, Artificial Sequence
  Description of Artificial Sequence: Synthetic peptide
  XENP021374 vlCDR1
QASQDIGNWLN

SEQ ID NO: 26642 - protein, 7 aa, Artificial Sequence
  Description of Artificial Sequence: Synthetic peptide
  XENP021374 vlCDR2
YTSRLHS

SEQ ID NO: 26643 - protein, 9 aa, Artificial Sequence
  Description of Artificial Sequence: Synthetic peptide
  XENP021374 vlCDR3
QQGNTLPYT

SEQ ID NO: 26644 - protein, 223 aa, Artificial Sequence; identical to SEQ ID NO: 25194
  Description of Artificial Sequence: Synthetic polypeptide
  XENP021375 2A11_H1_L2.28_Fab Heavy Chain

SEQ ID NO: 26645 - protein, 118 aa, Artificial Sequence; identical to SEQ ID NO: 17236
  Description of Artificial Sequence: Synthetic polypeptide
  VH of XENP021375

SEQ ID NO: 26646 - protein, 5 aa, Artificial Sequence
  Description of Artificial Sequence: Synthetic peptide
  XENP021375 vhCDR1
DYYMH

SEQ ID NO: 26647 - protein, 17 aa, Artificial Sequence
  Description of Artificial Sequence: Synthetic peptide
  XENP021375 vhCDR2
WIDPENGDTEYAPKFQG

SEQ ID NO: 26648 - protein, 9 aa, Artificial Sequence
  Description of Artificial Sequence: Synthetic peptide
  XENP021375 vhCDR3
RGVRQALDY

SEQ ID NO: 26649 - protein, 214 aa, Artificial Sequence
  Description of Artificial Sequence: Synthetic polypeptide
  XENP021375 2A11_H1_L2.28_Fab Light Chain
DIQMTQSPAFLSVTPGEKVTITCQASQDIGNVLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26650 - protein, 107 aa, Artificial Sequence
  Description of Artificial Sequence: Synthetic polypeptide
  VL of XENP021375
DIQMTQSPAFLSVTPGEKVTITCQASQDIGNVLNWFQQKPDQTVKLLIYYTSRLHSGVPSRFSGSGSGTDYTFTISSLEAEDAATYFCQQGNTLPYTFGGGTKVEIK

SEQ ID NO: 26651 - protein, 11 aa, Artificial Sequence
  Description of Artificial Sequence: Synthetic peptide
  XENP021375 vlCDR1
QASQDIGNVLN

SEQ ID NO: 26652 - protein, 7 aa, Artificial Sequence
  Description of Artificial Sequence: Synthetic peptide
  XENP021375 vlCDR2
YTSRLHS

SEQ ID NO: 26653 - protein, 9 aa, Artificial Sequence
  Description of Artificial Sequence: Synthetic peptide
  XENP021375 vlCDR3
QQGNTLPYT

SEQ ID NO: 26654 - protein, 223 aa, Artificial Sequence; identical to SEQ ID NO: 25194
  Description of Artificial Sequence: Synthetic polypeptide
  XENP021376 2A11_H1_L2.29_Fab Heavy Chain

SEQ ID NO: 26655 - protein, 118 aa, Artificial Sequence; identical to SEQ ID NO: 17236
  Description of Artificial Sequence: Synthetic polypeptide
  VH of XENP021376

SEQ ID NO: 26656 - protein, 5 aa, Artificial Sequence
  Description of Artificial Sequence: Synthetic peptide
  XENP021376 vhCDR1
DYYMH

SEQ ID NO: 26657 - protein, 17 aa, Artificial Sequence
  Description of Artificial Sequence: Synthetic peptide
  XENP021376 vhCDR2
WIDPENGDTEYAPKFQG

SEQ ID NO: 26658 - protein, 9 aa, Artificial Sequence
  Description of Artificial Sequence: Synthetic peptide
  XENP021376 vhCDR3
RGVRQALDY

SEQ ID NO: 26659 - protein, 214 aa, Artificial Sequence
  Description of Artificial Sequence: Synthetic polypeptide
  XENP021376 2A11_H1_L2.29_Fab Light Chain
DIQMTQSPAFLSVTPGEKVTITCQASQDIGNALNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26660 - protein, 107 aa, Artificial Sequence
  Description of Artificial Sequence: Synthetic polypeptide
  VL of XENP021376
DIQMTQSPAFLSVTPGEKVTITCQASQDIGNALNWFQQKPDQTVKLLIYYTSRLHSGVPSRFSGSGSGTDYTFTISSLEAEDAATYFCQQGNTLPYTFGGGTKVEIK

SEQ ID NO: 26661 - protein, 11 aa, Artificial Sequence
  Description of Artificial Sequence: Synthetic peptide
  XENP021376 vlCDR1
QASQDIGNALN

SEQ ID NO: 26662 - protein, 7 aa, Artificial Sequence
  Description of Artificial Sequence: Synthetic peptide
  XENP021376 vlCDR2
YTSRLHS

SEQ ID NO: 26663 - protein, 9 aa, Artificial Sequence
  Description of Artificial Sequence: Synthetic peptide
  XENP021376 vlCDR3
QQGNTLPYT

SEQ ID NO: 26664 - protein, 223 aa, Artificial Sequence; identical to SEQ ID NO: 25194
  Description of Artificial Sequence: Synthetic polypeptide
  XENP021377 2A11_H1_L2.30_Fab Heavy Chain

SEQ ID NO: 26665 - protein, 118 aa, Artificial Sequence; identical to SEQ ID NO: 17236
  Description of Artificial Sequence: Synthetic polypeptide
  VH of XENP021377

SEQ ID NO: 26666 - protein, 5 aa, Artificial Sequence
  Description of Artificial Sequence: Synthetic peptide
  XENP021377 vhCDR1
DYYMH

SEQ ID NO: 26667 - protein, 17 aa, Artificial Sequence
  Description of Artificial Sequence: Synthetic peptide
  XENP021377 vhCDR2
WIDPENGDTEYAPKFQG

SEQ ID NO: 26668 - protein, 9 aa, Artificial Sequence
  Description of Artificial Sequence: Synthetic peptide
  XENP021377 vhCDR3
RGVRQALDY

SEQ ID NO: 26669 - protein, 214 aa, Artificial Sequence
  Description of Artificial Sequence: Synthetic polypeptide
  XENP021377 2A11_H1_L2.30_Fab Light Chain
DIQMTQSPAFLSVTPGEKVTITCQASQDIGNQLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26670 - protein, 107 aa, Artificial Sequence
  Description of Artificial Sequence: Synthetic polypeptide
  VL of XENP021377
DIQMTQSPAFLSVTPGEKVTITCQASQDIGNQLNWFQQKPDQTVKLLIYYTSRLHSGVPSRFSGSGSGTDYTFTISSLEAEDAATYFCQQGNTLPYTFGGGTKVEIK

SEQ ID NO: 26671 - protein, 11 aa, Artificial Sequence
  Description of Artificial Sequence: Synthetic peptide
  XENP021377 vlCDR1
QASQDIGNQLN

SEQ ID NO: 26672 - protein, 7 aa, Artificial Sequence
  Description of Artificial Sequence: Synthetic peptide
  XENP021377 vlCDR2
YTSRLHS

SEQ ID NO: 26673 - protein, 9 aa, Artificial Sequence
  Description of Artificial Sequence: Synthetic peptide
  XENP021377 vlCDR3
QQGNTLPYT

SEQ ID NO: 26674 - protein, 223 aa, Artificial Sequence; identical to SEQ ID NO: 25194
  Description of Artificial Sequence: Synthetic polypeptide
  XENP021378 2A11_H1_L2.31_Fab Heavy Chain

SEQ ID NO: 26675 - protein, 118 aa, Artificial Sequence; identical to SEQ ID NO: 17236
  Description of Artificial Sequence: Synthetic polypeptide
  VH of XENP021378

SEQ ID NO: 26676 - protein, 5 aa, Artificial Sequence
  Description of Artificial Sequence: Synthetic peptide
  XENP021378 vhCDR1
DYYMH

SEQ ID NO: 26677 - protein, 17 aa, Artificial Sequence
  Description of Artificial Sequence: Synthetic peptide
  XENP021378 vhCDR2
WIDPENGDTEYAPKFQG

SEQ ID NO: 26678 - protein, 9 aa, Artificial Sequence
  Description of Artificial Sequence: Synthetic peptide
  XENP021378 vhCDR3
RGVRQALDY

SEQ ID NO: 26679 - protein, 214 aa, Artificial Sequence
  Description of Artificial Sequence: Synthetic polypeptide
  XENP021378 2A11_H1_L2.31_Fab Light Chain
DIQMTQSPAFLSVTPGEKVTITCQASQDIGNELNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26680 - protein, 107 aa, Artificial Sequence
  Description of Artificial Sequence: Synthetic polypeptide
  VL of XENP021378
DIQMTQSPAFLSVTPGEKVTITCQASQDIGNELNWFQQKPDQTVKLLIYYTSRLHSGVPSRFSGSGSGTDYTFTISSLEAEDAATYFCQQGNTLPYTFGGGTKVEIK

SEQ ID NO: 26681 - protein, 11 aa, Artificial Sequence
  Description of Artificial Sequence: Synthetic peptide
  XENP021378 vlCDR1
QASQDIGNELN

SEQ ID NO: 26682 - protein, 7 aa, Artificial Sequence
  Description of Artificial Sequence: Synthetic peptide
  XENP021378 vlCDR2
YTSRLHS

SEQ ID NO: 26683 - protein, 9 aa, Artificial Sequence
  Description of Artificial Sequence: Synthetic peptide
  XENP021378 vlCDR3
QQGNTLPYT

SEQ ID NO: 26684 - protein, 223 aa, Artificial Sequence; identical to SEQ ID NO: 25194
  Description of Artificial Sequence: Synthetic polypeptide
  XENP021379 2A11_H1_L2.32_Fab Heavy Chain

SEQ ID NO: 26685 - protein, 118 aa, Artificial Sequence; identical to SEQ ID NO: 17236
  Description of Artificial Sequence: Synthetic polypeptide
  VH of XENP021379

SEQ ID NO: 26686 - protein, 5 aa, Artificial Sequence
  Description of Artificial Sequence: Synthetic peptide
  XENP021379 vhCDR1
DYYMH

SEQ ID NO: 26687 - protein, 17 aa, Artificial Sequence
  Description of Artificial Sequence: Synthetic peptide
  XENP021379 vhCDR2
WIDPENGDTEYAPKFQG

SEQ ID NO: 26688 - protein, 9 aa, Artificial Sequence
  Description of Artificial Sequence: Synthetic peptide
  XENP021379 vhCDR3
RGVRQALDY

SEQ ID NO: 26689 - protein, 214 aa, Artificial Sequence
  Description of Artificial Sequence: Synthetic polypeptide
  XENP021379 2A11_H1_L2.32_Fab Light Chain
DIQMTQSPAFLSVTPGEKVTITCQASQDIGNKLNWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26690 - protein, 107 aa, Artificial Sequence
  Description of Artificial Sequence: Synthetic polypeptide
  VL of XENP021379
DIQMTQSPAFLSVTPGEKVTITCQASQDIGNKLNWFQQKPDQTVKLLIYYTSRLHSGVPSRFSGSGSGTDYTFTISSLEAEDAATYFCQQGNTLPYTFGGGTKVEIK

SEQ ID NO: 26691 - protein, 11 aa, Artificial Sequence
  Description of Artificial Sequence: Synthetic peptide
  XENP021379 vlCDR1
QASQDIGNKLN

SEQ ID NO: 26692 - protein, 7 aa, Artificial Sequence
  Description of Artificial Sequence: Synthetic peptide
  XENP021379 vlCDR2
YTSRLHS

SEQ ID NO: 26693 - protein, 9 aa, Artificial Sequence
  Description of Artificial Sequence: Synthetic peptide
  XENP021379 vlCDR3
QQGNTLPYT

SEQ ID NO: 26694 - protein, 223 aa, Artificial Sequence; identical to SEQ ID NO: 25194
  Description of Artificial Sequence: Synthetic polypeptide
  XENP021380 2A11_H1_L2.33_Fab Heavy Chain

SEQ ID NO: 26695 - protein, 118 aa, Artificial Sequence; identical to SEQ ID NO: 17236
  Description of Artificial Sequence: Synthetic polypeptide
  VH of XENP021380

SEQ ID NO: 26696 - protein, 5 aa, Artificial Sequence
  Description of Artificial Sequence: Synthetic peptide
  XENP021380 vhCDR1
DYYMH

SEQ ID NO: 26697 - protein, 17 aa, Artificial Sequence
  Description of Artificial Sequence: Synthetic peptide
  XENP021380 vhCDR2
WIDPENGDTEYAPKFQG

SEQ ID NO: 26698 - protein, 9 aa, Artificial Sequence
  Description of Artificial Sequence: Synthetic peptide
  XENP021380 vhCDR3
RGVRQALDY

SEQ ID NO: 26699 - protein, 214 aa, Artificial Sequence
  Description of Artificial Sequence: Synthetic polypeptide
  XENP021380 2A11_H1_L2.33_Fab Light Chain
DIQMTQSPAFLSVTPGEKVTITCQASQDIGNYLHWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26700 - protein, 107 aa, Artificial Sequence
  Description of Artificial Sequence: Synthetic polypeptide
  VL of XENP021380
DIQMTQSPAFLSVTPGEKVTITCQASQDIGNYLHWFQQKPDQTVKLLIYYTSRLHSGVPSRFSGSGSGTDYTFTISSLEAEDAATYFCQQGNTLPYTFGGGTKVEIK

SEQ ID NO: 26701 - protein, 11 aa, Artificial Sequence
  Description of Artificial Sequence: Synthetic peptide
  XENP021380 vlCDR1
QASQDIGNYLH

SEQ ID NO: 26702 - protein, 7 aa, Artificial Sequence
  Description of Artificial Sequence: Synthetic peptide
  XENP021380 vlCDR2
YTSRLHS

SEQ ID NO: 26703 - protein, 9 aa, Artificial Sequence
  Description of Artificial Sequence: Synthetic peptide
  XENP021380 vlCDR3
QQGNTLPYT

SEQ ID NO: 26704 - protein, 223 aa, Artificial Sequence; identical to SEQ ID NO: 25194
  Description of Artificial Sequence: Synthetic polypeptide
  XENP021381 2A11_H1_L2.34_Fab Heavy Chain

SEQ ID NO: 26705 - protein, 118 aa, Artificial Sequence; identical to SEQ ID NO: 17236
  Description of Artificial Sequence: Synthetic polypeptide
  VH of XENP021381

SEQ ID NO: 26706 - protein, 5 aa, Artificial Sequence
  Description of Artificial Sequence: Synthetic peptide
  XENP021381 vhCDR1
DYYMH

SEQ ID NO: 26707 - protein, 17 aa, Artificial Sequence
  Description of Artificial Sequence: Synthetic peptide
  XENP021381 vhCDR2
WIDPENGDTEYAPKFQG

SEQ ID NO: 26708 - protein, 9 aa, Artificial Sequence
  Description of Artificial Sequence: Synthetic peptide
  XENP021381 vhCDR3
RGVRQALDY

SEQ ID NO: 26709 - protein, 214 aa, Artificial Sequence
  Description of Artificial Sequence: Synthetic polypeptide
  XENP021381 2A11_H1_L2.34_Fab Light Chain
DIQMTQSPAFLSVTPGEKVTITCQASQDIGNYLYWFQQKPDQTVKLLIYYTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26710 - protein, 107 aa, Artificial Sequence
  Description of Artificial Sequence: Synthetic polypeptide
  VL of XENP021381
DIQMTQSPAFLSVTPGEKVTITCQASQDIGNYLYWFQQKPDQTVKLLIYYTSRLHSGVPSRFSGSGSGTDYTFTISSLEAEDAATYFCQQGNTLPYTFGGGTKVEIK

SEQ ID NO: 26711 - protein, 11 aa, Artificial Sequence
  Description of Artificial Sequence: Synthetic peptide
  XENP021381 vlCDR1
QASQDIGNYLY

SEQ ID NO: 26712 - protein, 7 aa, Artificial Sequence
  Description of Artificial Sequence: Synthetic peptide
  XENP021381 vlCDR2
YTSRLHS

SEQ ID NO: 26713 - protein, 9 aa, Artificial Sequence
  Description of Artificial Sequence: Synthetic peptide
  XENP021381 vlCDR3
QQGNTLPYT

SEQ ID NO: 26714 - protein, 223 aa, Artificial Sequence; identical to SEQ ID NO: 25194
  Description of Artificial Sequence: Synthetic polypeptide
  XENP021382 2A11_H1_L2.35_Fab Heavy Chain

SEQ ID NO: 26715 - protein, 118 aa, Artificial Sequence; identical to SEQ ID NO: 17236
  Description of Artificial Sequence: Synthetic polypeptide
  VH of XENP021382

SEQ ID NO: 26716 - protein, 5 aa, Artificial Sequence
  Description of Artificial Sequence: Synthetic peptide
  XENP021382 vhCDR1
DYYMH

SEQ ID NO: 26717 - protein, 17 aa, Artificial Sequence
  Description of Artificial Sequence: Synthetic peptide
  XENP021382 vhCDR2
WIDPENGDTEYAPKFQG

SEQ ID NO: 26718 - protein, 9 aa, Artificial Sequence
  Description of Artificial Sequence: Synthetic peptide
  XENP021382 vhCDR3
RGVRQALDY

SEQ ID NO: 26719 - protein, 214 aa, Artificial Sequence
  Description of Artificial Sequence: Synthetic polypeptide
  XENP021382 2A11_H1_L2.35_Fab Light Chain
DIQMTQSPAFLSVTPGEKVTITCQASQDIGNYLNWFQQKPDQTVKLLIYFTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26720 - protein, 107 aa, Artificial Sequence
  Description of Artificial Sequence: Synthetic polypeptide
  VL of XENP021382
DIQMTQSPAFLSVTPGEKVTITCQASQDIGNYLNWFQQKPDQTVKLLIYFTSRLHSGVPSRFSGSGSGTDYTFTISSLEAEDAATYFCQQGNTLPYTFGGGTKVEIK

SEQ ID NO: 26721 - protein, 11 aa, Artificial Sequence
  Description of Artificial Sequence: Synthetic peptide
  XENP021382 vlCDR1
QASQDIGNYLN

SEQ ID NO: 26722 - protein, 7 aa, Artificial Sequence
  Description of Artificial Sequence: Synthetic peptide
  XENP021382 vlCDR2
FTSRLHS

SEQ ID NO: 26723 - protein, 9 aa, Artificial Sequence
  Description of Artificial Sequence: Synthetic peptide
  XENP021382 vlCDR3
QQGNTLPYT

SEQ ID NO: 26724 - protein, 223 aa, Artificial Sequence; identical to SEQ ID NO: 25194
  Description of Artificial Sequence: Synthetic polypeptide
  XENP021383 2A11_H1_L2.36_Fab Heavy Chain

SEQ ID NO: 26725 - protein, 118 aa, Artificial Sequence; identical to SEQ ID NO: 17236
  Description of Artificial Sequence: Synthetic polypeptide
  VH of XENP021383

SEQ ID NO: 26726 - protein, 5 aa, Artificial Sequence
  Description of Artificial Sequence: Synthetic peptide
  XENP021383 vhCDR1
DYYMH

SEQ ID NO: 26727 - protein, 17 aa, Artificial Sequence
  Description of Artificial Sequence: Synthetic peptide
  XENP021383 vhCDR2
WIDPENGDTEYAPKFQG

SEQ ID NO: 26728 - protein, 9 aa, Artificial Sequence
  Description of Artificial Sequence: Synthetic peptide
  XENP021383 vhCDR3
RGVRQALDY

SEQ ID NO: 26729 - protein, 214 aa, Artificial Sequence
  Description of Artificial Sequence: Synthetic polypeptide
  XENP021383 2A11_H1_L2.36_Fab Light Chain
DIQMTQSPAFLSVTPGEKVTITCQASQDIGNYLNWFQQKPDQTVKLLIYHTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26730 - protein, 107 aa, Artificial Sequence
  Description of Artificial Sequence: Synthetic polypeptide
  VL of XENP021383
DIQMTQSPAFLSVTPGEKVTITCQASQDIGNYLNWFQQKPDQTVKLLIYHTSRLHSGVPSRFSGSGSGTDYTFTISSLEAEDAATYFCQQGNTLPYTFGGGTKVEIK

SEQ ID NO: 26731 - protein, 11 aa, Artificial Sequence
  Description of Artificial Sequence: Synthetic peptide
  XENP021383 vlCDR1
QASQDIGNYLN

SEQ ID NO: 26732 - protein, 7 aa, Artificial Sequence
  Description of Artificial Sequence: Synthetic peptide
  XENP021383 vlCDR2
HTSRLHS

SEQ ID NO: 26733 - protein, 9 aa, Artificial Sequence
  Description of Artificial Sequence: Synthetic peptide
  XENP021383 vlCDR3
QQGNTLPYT

SEQ ID NO: 26734 - protein, 223 aa, Artificial Sequence; identical to SEQ ID NO: 25194
  Description of Artificial Sequence: Synthetic polypeptide
  XENP021384 2A11_H1_L2.37_Fab Heavy Chain

SEQ ID NO: 26735 - protein, 118 aa, Artificial Sequence; identical to SEQ ID NO: 17236
  Description of Artificial Sequence: Synthetic polypeptide
  VH of XENP021384

SEQ ID NO: 26736 - protein, 5 aa, Artificial Sequence
  Description of Artificial Sequence: Synthetic peptide
  XENP021384 vhCDR1
DYYMH

SEQ ID NO: 26737 - protein, 17 aa, Artificial Sequence
  Description of Artificial Sequence: Synthetic peptide
  XENP021384 vhCDR2
WIDPENGDTEYAPKFQG

SEQ ID NO: 26738 - protein, 9 aa, Artificial Sequence
  Description of Artificial Sequence: Synthetic peptide
  XENP021384 vhCDR3
RGVRQALDY

SEQ ID NO: 26739 - protein, 214 aa, Artificial Sequence
  Description of Artificial Sequence: Synthetic polypeptide
  XENP021384 2A11_H1_L2.37_Fab Light Chain
DIQMTQSPAFLSVTPGEKVTITCQASQDIGNYLNWFQQKPDQTVKLLIYLTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26740 - protein, 107 aa, Artificial Sequence
  Description of Artificial Sequence: Synthetic polypeptide
  VL of XENP021384
DIQMTQSPAFLSVTPGEKVTITCQASQDIGNYLNWFQQKPDQTVKLLIYLTSRLHSGVPSRFSGSGSGTDYTFTISSLEAEDAATYFCQQGNTLPYTFGGGTKVEIK

SEQ ID NO: 26741 - protein, 11 aa, Artificial Sequence
  Description of Artificial Sequence: Synthetic peptide
  XENP021384 vlCDR1
QASQDIGNYLN

SEQ ID NO: 26742 - protein, 7 aa, Artificial Sequence
  Description of Artificial Sequence: Synthetic peptide
  XENP021384 vlCDR2
LTSRLHS

SEQ ID NO: 26743 - protein, 9 aa, Artificial Sequence
  Description of Artificial Sequence: Synthetic peptide
  XENP021384 vlCDR3
QQGNTLPYT

SEQ ID NO: 26744 - protein, 223 aa, Artificial Sequence; identical to SEQ ID NO: 25194
  Description of Artificial Sequence: Synthetic polypeptide
  XENP021385 2A11_H1_L2.38_Fab Heavy Chain

SEQ ID NO: 26745 - protein, 118 aa, Artificial Sequence; identical to SEQ ID NO: 17236
  Description of Artificial Sequence: Synthetic polypeptide
  VH of XENP021385

SEQ ID NO: 26746 - protein, 5 aa, Artificial Sequence
  Description of Artificial Sequence: Synthetic peptide
  XENP021385 vhCDR1
DYYMH

SEQ ID NO: 26747 - protein, 17 aa, Artificial Sequence
  Description of Artificial Sequence: Synthetic peptide
  XENP021385 vhCDR2
WIDPENGDTEYAPKFQG

SEQ ID NO: 26748 - protein, 9 aa, Artificial Sequence
  Description of Artificial Sequence: Synthetic peptide
  XENP021385 vhCDR3
RGVRQALDY

SEQ ID NO: 26749 - protein, 214 aa, Artificial Sequence
  Description of Artificial Sequence: Synthetic polypeptide
  XENP021385 2A11_H1_L2.38_Fab Light Chain
DIQMTQSPAFLSVTPGEKVTITCQASQDIGNYLNWFQQKPDQTVKLLIYWTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26750 - protein, 107 aa, Artificial Sequence
  Description of Artificial Sequence: Synthetic polypeptide
  VL of XENP021385
DIQMTQSPAFLSVTPGEKVTITCQASQDIGNYLNWFQQKPDQTVKLLIYWTSRLHSGVPSRFSGSGSGTDYTFTISSLEAEDAATYFCQQGNTLPYTFGGGTKVEIK

SEQ ID NO: 26751 - protein, 11 aa, Artificial Sequence
  Description of Artificial Sequence: Synthetic peptide
  XENP021385 vlCDR1
QASQDIGNYLN

SEQ ID NO: 26752 - protein, 7 aa, Artificial Sequence
  Description of Artificial Sequence: Synthetic peptide
  XENP021385 vlCDR2
WTSRLHS

SEQ ID NO: 26753 - protein, 9 aa, Artificial Sequence
  Description of Artificial Sequence: Synthetic peptide
  XENP021385 vlCDR3
QQGNTLPYT

SEQ ID NO: 26754 - protein, 223 aa, Artificial Sequence; identical to SEQ ID NO: 25194
  Description of Artificial Sequence: Synthetic polypeptide
  XENP021386 2A11_H1_L2.39_Fab Heavy Chain

SEQ ID NO: 26755 - protein, 118 aa, Artificial Sequence; identical to SEQ ID NO: 17236
  Description of Artificial Sequence: Synthetic polypeptide
  VH of XENP021386

SEQ ID NO: 26756 - protein, 5 aa, Artificial Sequence
  Description of Artificial Sequence: Synthetic peptide
  XENP021386 vhCDR1
DYYMH

SEQ ID NO: 26757 - protein, 17 aa, Artificial Sequence
  Description of Artificial Sequence: Synthetic peptide
  XENP021386 vhCDR2
WIDPENGDTEYAPKFQG

SEQ ID NO: 26758 - protein, 9 aa, Artificial Sequence
  Description of Artificial Sequence: Synthetic peptide
  XENP021386 vhCDR3
RGVRQALDY

SEQ ID NO: 26759 - protein, 214 aa, Artificial Sequence
  Description of Artificial Sequence: Synthetic polypeptide
  XENP021386 2A11_H1_L2.39_Fab Light Chain
DIQMTQSPAFLSVTPGEKVTITCQASQDIGNYLNWFQQKPDQTVKLLIYATSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26760 - protein, 107 aa, Artificial Sequence
  Description of Artificial Sequence: Synthetic polypeptide
  VL of XENP021386
DIQMTQSPAFLSVTPGEKVTITCQASQDIGNYLNWFQQKPDQTVKLLIYATSRLHSGVPSRFSGSGSGTDYTFTISSLEAEDAATYFCQQGNTLPYTFGGGTKVEIK

SEQ ID NO: 26761 - protein, 11 aa, Artificial Sequence
  Description of Artificial Sequence: Synthetic peptide
  XENP021386 vlCDR1
QASQDIGNYLN

SEQ ID NO: 26762 - protein, 7 aa, Artificial Sequence
  Description of Artificial Sequence: Synthetic peptide
  XENP021386 vlCDR2
ATSRLHS

SEQ ID NO: 26763 - protein, 9 aa, Artificial Sequence
  Description of Artificial Sequence: Synthetic peptide
  XENP021386 vlCDR3
QQGNTLPYT

SEQ ID NO: 26764 - protein, 223 aa, Artificial Sequence; identical to SEQ ID NO: 25194
  Description of Artificial Sequence: Synthetic polypeptide
  XENP021387 2A11_H1_L2.40_Fab Heavy Chain

SEQ ID NO: 26765 - protein, 118 aa, Artificial Sequence; identical to SEQ ID NO: 17236
  Description of Artificial Sequence: Synthetic polypeptide
  VH of XENP021387

SEQ ID NO: 26766 - protein, 5 aa, Artificial Sequence
  Description of Artificial Sequence: Synthetic peptide
  XENP021387 vhCDR1
DYYMH

SEQ ID NO: 26767 - protein, 17 aa, Artificial Sequence
  Description of Artificial Sequence: Synthetic peptide
  XENP021387 vhCDR2
WIDPENGDTEYAPKFQG

SEQ ID NO: 26768 - protein, 9 aa, Artificial Sequence
  Description of Artificial Sequence: Synthetic peptide
  XENP021387 vhCDR3
RGVRQALDY

SEQ ID NO: 26769 - protein, 214 aa, Artificial Sequence
  Description of Artificial Sequence: Synthetic polypeptide
  XENP021387 2A11_H1_L2.40_Fab Light Chain
DIQMTQSPAFLSVTPGEKVTITCQASQDIGNYLNWFQQKPDQTVKLLIYTTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26770 - protein, 107 aa, Artificial Sequence
  Description of Artificial Sequence: Synthetic polypeptide
  VL of XENP021387
DIQMTQSPAFLSVTPGEKVTITCQASQDIGNYLNWFQQKPDQTVKLLIYTTSRLHSGVPSRFSGSGSGTDYTFTISSLEAEDAATYFCQQGNTLPYTFGGGTKVEIK

SEQ ID NO: 26771 - protein, 11 aa, Artificial Sequence
  Description of Artificial Sequence: Synthetic peptide
  XENP021387 vlCDR1
QASQDIGNYLN

SEQ ID NO: 26772 - protein, 7 aa, Artificial Sequence
  Description of Artificial Sequence: Synthetic peptide
  XENP021387 vlCDR2
TTSRLHS

SEQ ID NO: 26773 - protein, 9 aa, Artificial Sequence
  Description of Artificial Sequence: Synthetic peptide
  XENP021387 vlCDR3
QQGNTLPYT

SEQ ID NO: 26774 - protein, 223 aa, Artificial Sequence; identical to SEQ ID NO: 25194
  Description of Artificial Sequence: Synthetic polypeptide
  XENP021388 2A11_H1_L2.41_Fab Heavy Chain

SEQ ID NO: 26775 - protein, 118 aa, Artificial Sequence; identical to SEQ ID NO: 17236
  Description of Artificial Sequence: Synthetic polypeptide
  VH of XENP021388

SEQ ID NO: 26776 - protein, 5 aa, Artificial Sequence
  Description of Artificial Sequence: Synthetic peptide
  XENP021388 vhCDR1
DYYMH

SEQ ID NO: 26777 - protein, 17 aa, Artificial Sequence
  Description of Artificial Sequence: Synthetic peptide
  XENP021388 vhCDR2
WIDPENGDTEYAPKFQG

SEQ ID NO: 26778 - protein, 9 aa, Artificial Sequence
  Description of Artificial Sequence: Synthetic peptide
  XENP021388 vhCDR3
RGVRQALDY

SEQ ID NO: 26779 - protein, 214 aa, Artificial Sequence
  Description of Artificial Sequence: Synthetic polypeptide
  XENP021388 2A11_H1_L2.41_Fab Light Chain
DIQMTQSPAFLSVTPGEKVTITCQASQDIGNYLNWFQQKPDQTVKLLIYQTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26780 - protein, 107 aa, Artificial Sequence
  Description of Artificial Sequence: Synthetic polypeptide
  VL of XENP021388
DIQMTQSPAFLSVTPGEKVTITCQASQDIGNYLNWFQQKPDQTVKLLIYQTSRLHSGVPSRFSGSGSGTDYTFTISSLEAEDAATYFCQQGNTLPYTFGGGTKVEIK

SEQ ID NO: 26781 - protein, 11 aa, Artificial Sequence
  Description of Artificial Sequence: Synthetic peptide
  XENP021388 vlCDR1
QASQDIGNYLN

SEQ ID NO: 26782 - protein, 7 aa, Artificial Sequence
  Description of Artificial Sequence: Synthetic peptide
  XENP021388 vlCDR2
QTSRLHS

SEQ ID NO: 26783 - protein, 9 aa, Artificial Sequence
  Description of Artificial Sequence: Synthetic peptide
  XENP021388 vlCDR3
QQGNTLPYT

SEQ ID NO: 26784 - protein, 223 aa, Artificial Sequence; identical to SEQ ID NO: 25194
  Description of Artificial Sequence: Synthetic polypeptide
  XENP021389 2A11_H1_L2.42_Fab Heavy Chain

SEQ ID NO: 26785 - protein, 118 aa, Artificial Sequence; identical to SEQ ID NO: 17236
  Description of Artificial Sequence: Synthetic polypeptide
  VH of XENP021389

SEQ ID NO: 26786 - protein, 5 aa, Artificial Sequence
  Description of Artificial Sequence: Synthetic peptide
  XENP021389 vhCDR1
DYYMH

SEQ ID NO: 26787 - protein, 17 aa, Artificial Sequence
  Description of Artificial Sequence: Synthetic peptide
  XENP021389 vhCDR2
WIDPENGDTEYAPKFQG

SEQ ID NO: 26788 - protein, 9 aa, Artificial Sequence
  Description of Artificial Sequence: Synthetic peptide
  XENP021389 vhCDR3
RGVRQALDY

SEQ ID NO: 26789 - protein, 214 aa, Artificial Sequence
  Description of Artificial Sequence: Synthetic polypeptide
  XENP021389 2A11_H1_L2.42_Fab Light Chain
DIQMTQSPAFLSVTPGEKVTITCQASQDIGNYLNWFQQKPDQTVKLLIYETSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26790 - protein, 107 aa, Artificial Sequence
  Description of Artificial Sequence: Synthetic polypeptide
  VL of XENP021389
DIQMTQSPAFLSVTPGEKVTITCQASQDIGNYLNWFQQKPDQTVKLLIYETSRLHSGVPSRFSGSGSGTDYTFTISSLEAEDAATYFCQQGNTLPYTFGGGTKVEIK

SEQ ID NO: 26791 - protein, 11 aa, Artificial Sequence
  Description of Artificial Sequence: Synthetic peptide
  XENP021389 vlCDR1
QASQDIGNYLN

SEQ ID NO: 26792 - protein, 7 aa, Artificial Sequence
  Description of Artificial Sequence: Synthetic peptide
  XENP021389 vlCDR2
ETSRLHS

SEQ ID NO: 26793 - protein, 9 aa, Artificial Sequence
  Description of Artificial Sequence: Synthetic peptide
  XENP021389 vlCDR3
QQGNTLPYT

SEQ ID NO: 26794 - protein, 223 aa, Artificial Sequence; identical to SEQ ID NO: 25194
  Description of Artificial Sequence: Synthetic polypeptide
  XENP021390 2A11_H1_L2.43_Fab Heavy Chain

SEQ ID NO: 26795 - protein, 118 aa, Artificial Sequence; identical to SEQ ID NO: 17236
  Description of Artificial Sequence: Synthetic polypeptide
  VH of XENP021390

SEQ ID NO: 26796 - protein, 5 aa, Artificial Sequence
  Description of Artificial Sequence: Synthetic peptide
  XENP021390 vhCDR1
DYYMH

SEQ ID NO: 26797 - protein, 17 aa, Artificial Sequence
  Description of Artificial Sequence: Synthetic peptide
  XENP021390 vhCDR2
WIDPENGDTEYAPKFQG

SEQ ID NO: 26798 - protein, 9 aa, Artificial Sequence
  Description of Artificial Sequence: Synthetic peptide
  XENP021390 vhCDR3
RGVRQALDY

SEQ ID NO: 26799 - protein, 214 aa, Artificial Sequence
  Description of Artificial Sequence: Synthetic polypeptide
  XENP021390 2A11_H1_L2.43_Fab Light Chain
DIQMTQSPAFLSVTPGEKVTITCQASQDIGNYLNWFQQKPDQTVKLLIYKTSRLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26800 - protein, 107 aa, Artificial Sequence
  Description of Artificial Sequence: Synthetic polypeptide
  VL of XENP021390
DIQMTQSPAFLSVTPGEKVTITCQASQDIGNYLNWFQQKPDQTVKLLIYKTSRLHSGVPSRFSGSGSGTDYTFTISSLEAEDAATYFCQQGNTLPYTFGGGTKVEIK

SEQ ID NO: 26801 - protein, 11 aa, Artificial Sequence
  Description of Artificial Sequence: Synthetic peptide
  XENP021390 vlCDR1
QASQDIGNYLN

SEQ ID NO: 26802 - protein, 7 aa, Artificial Sequence
  Description of Artificial Sequence: Synthetic peptide
  XENP021390 vlCDR2
KTSRLHS

SEQ ID NO: 26803 - protein, 9 aa, Artificial Sequence
  Description of Artificial Sequence: Synthetic peptide
  XENP021390 vlCDR3
QQGNTLPYT

SEQ ID NO: 26804 - protein, 223 aa, Artificial Sequence; identical to SEQ ID NO: 25194
  Description of Artificial Sequence: Synthetic polypeptide
  XENP021391 2A11_H1_L2.44_Fab Heavy Chain

SEQ ID NO: 26805 - protein, 118 aa, Artificial Sequence; identical to SEQ ID NO: 17236
  Description of Artificial Sequence: Synthetic polypeptide
  VH of XENP021391

SEQ ID NO: 26806 - protein, 5 aa, Artificial Sequence
  Description of Artificial Sequence: Synthetic peptide
  XENP021391 vhCDR1
DYYMH

SEQ ID NO: 26807 - protein, 17 aa, Artificial Sequence
  Description of Artificial Sequence: Synthetic peptide
  XENP021391 vhCDR2
WIDPENGDTEYAPKFQG

SEQ ID NO: 26808 - protein, 9 aa, Artificial Sequence
  Description of Artificial Sequence: Synthetic peptide
  XENP021391 vhCDR3
RGVRQALDY

SEQ ID NO: 26809 - protein, 214 aa, Artificial Sequence
  Description of Artificial Sequence: Synthetic polypeptide
  XENP021391 2A11_H1_L2.44_Fab Light Chain
DIQMTQSPAFLSVTPGEKVTITCQASQDIGNYLNWFQQKPDQTVKLLIYYTSKLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26810 - protein, 107 aa, Artificial Sequence
  Description of Artificial Sequence: Synthetic polypeptide
  VL of XENP021391
DIQMTQSPAFLSVTPGEKVTITCQASQDIGNYLNWFQQKPDQTVKLLIYYTSKLHSGVPSRFSGSGSGTDYTFTISSLEAEDAATYFCQQGNTLPYTFGGGTKVEIK

SEQ ID NO: 26811 - protein, 11 aa, Artificial Sequence
  Description of Artificial Sequence: Synthetic peptide
  XENP021391 vlCDR1
QASQDIGNYLN

SEQ ID NO: 26812 - protein, 7 aa, Artificial Sequence
  Description of Artificial Sequence: Synthetic peptide
  XENP021391 vlCDR2
YTSKLHS

SEQ ID NO: 26813 - protein, 9 aa, Artificial Sequence
  Description of Artificial Sequence: Synthetic peptide
  XENP021391 vlCDR3
QQGNTLPYT

SEQ ID NO: 26814 - protein, 223 aa, Artificial Sequence; identical to SEQ ID NO: 25194
  Description of Artificial Sequence: Synthetic polypeptide
  XENP021392 2A11_H1_L2.45_Fab Heavy Chain

SEQ ID NO: 26815 - protein, 118 aa, Artificial Sequence; identical to SEQ ID NO: 17236
  Description of Artificial Sequence: Synthetic polypeptide
  VH of XENP021392

SEQ ID NO: 26816 - protein, 5 aa, Artificial Sequence
  Description of Artificial Sequence: Synthetic peptide
  XENP021392 vhCDR1
DYYMH

SEQ ID NO: 26817 - protein, 17 aa, Artificial Sequence
  Description of Artificial Sequence: Synthetic peptide
  XENP021392 vhCDR2
WIDPENGDTEYAPKFQG

SEQ ID NO: 26818 - protein, 9 aa, Artificial Sequence
  Description of Artificial Sequence: Synthetic peptide
  XENP021392 vhCDR3
RGVRQALDY

SEQ ID NO: 26819 - protein, 214 aa, Artificial Sequence
  Description of Artificial Sequence: Synthetic polypeptide
  XENP021392 2A11_H1_L2.45_Fab Light Chain
DIQMTQSPAFLSVTPGEKVTITCQASQDIGNYLNWFQQKPDQTVKLLIYYTSELHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26820 - protein, 107 aa, Artificial Sequence
  Description of Artificial Sequence: Synthetic polypeptide
  VL of XENP021392
DIQMTQSPAFLSVTPGEKVTITCQASQDIGNYLNWFQQKPDQTVKLLIYYTSELHSGVPSRFSGSGSGTDYTFTISSLEAEDAATYFCQQGNTLPYTFGGGTKVEIK

SEQ ID NO: 26821 - protein, 11 aa, Artificial Sequence
  Description of Artificial Sequence: Synthetic peptide
  XENP021392 vlCDR1
QASQDIGNYLN

SEQ ID NO: 26822 - protein, 7 aa, Artificial Sequence
  Description of Artificial Sequence: Synthetic peptide
  XENP021392 vlCDR2
YTSELHS

SEQ ID NO: 26823 - protein, 9 aa, Artificial Sequence
  Description of Artificial Sequence: Synthetic peptide
  XENP021392 vlCDR3
QQGNTLPYT

SEQ ID NO: 26824 - protein, 223 aa, Artificial Sequence; identical to SEQ ID NO: 25194
  Description of Artificial Sequence: Synthetic polypeptide
  XENP021393 2A11_H1_L2.46_Fab Heavy Chain

SEQ ID NO: 26825 - protein, 118 aa, Artificial Sequence; identical to SEQ ID NO: 17236
  Description of Artificial Sequence: Synthetic polypeptide
  VH of XENP021393

SEQ ID NO: 26826 - protein, 5 aa, Artificial Sequence
  Description of Artificial Sequence: Synthetic peptide
  XENP021393 vhCDR1
DYYMH

SEQ ID NO: 26827 - protein, 17 aa, Artificial Sequence
  Description of Artificial Sequence: Synthetic peptide
  XENP021393 vhCDR2
WIDPENGDTEYAPKFQG

SEQ ID NO: 26828 - protein, 9 aa, Artificial Sequence
  Description of Artificial Sequence: Synthetic peptide
  XENP021393 vhCDR3
RGVRQALDY

SEQ ID NO: 26829 - protein, 214 aa, Artificial Sequence
  Description of Artificial Sequence: Synthetic polypeptide
  XENP021393 2A11_H1_L2.46_Fab Light Chain
DIQMTQSPAFLSVTPGEKVTITCQASQDIGNYLNWFQQKPDQTVKLLIYYTSDLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26830 - protein, 107 aa, Artificial Sequence
  Description of Artificial Sequence: Synthetic polypeptide
  VL of XENP021393
DIQMTQSPAFLSVTPGEKVTITCQASQDIGNYLNWFQQKPDQTVKLLIYYTSDLHSGVPSRFSGSGSGTDYTFTISSLEAEDAATYFCQQGNTLPYTFGGGTKVEIK

SEQ ID NO: 26831 - protein, 11 aa, Artificial Sequence
  Description of Artificial Sequence: Synthetic peptide
  XENP021393 vlCDR1
QASQDIGNYLN

SEQ ID NO: 26832 - protein, 7 aa, Artificial Sequence
  Description of Artificial Sequence: Synthetic peptide
  XENP021393 vlCDR2
YTSDLHS

SEQ ID NO: 26833 - protein, 9 aa, Artificial Sequence
  Description of Artificial Sequence: Synthetic peptide
  XENP021393 vlCDR3
QQGNTLPYT

SEQ ID NO: 26834 - protein, 223 aa, Artificial Sequence; identical to SEQ ID NO: 25194
  Description of Artificial Sequence: Synthetic polypeptide
  XENP021394 2A11_H1_L2.47_Fab Heavy Chain

SEQ ID NO: 26835 - protein, 118 aa, Artificial Sequence; identical to SEQ ID NO: 17236
  Description of Artificial Sequence: Synthetic polypeptide
  VH of XENP021394

SEQ ID NO: 26836 - protein, 5 aa, Artificial Sequence
  Description of Artificial Sequence: Synthetic peptide
  XENP021394 vhCDR1
DYYMH

SEQ ID NO: 26837 - protein, 17 aa, Artificial Sequence
  Description of Artificial Sequence: Synthetic peptide
  XENP021394 vhCDR2
WIDPENGDTEYAPKFQG

SEQ ID NO: 26838 - protein, 9 aa, Artificial Sequence
  Description of Artificial Sequence: Synthetic peptide
  XENP021394 vhCDR3
RGVRQALDY

SEQ ID NO: 26839 - protein, 214 aa, Artificial Sequence; identical to SEQ ID NO: 22039
  Description of Artificial Sequence: Synthetic polypeptide
  XENP021394 2A11_H1_L2.47_Fab Light Chain

SEQ ID NO: 26840 - protein, 107 aa, Artificial Sequence; identical to SEQ ID NO: 22040
  Description of Artificial Sequence: Synthetic polypeptide
  VL of XENP021394

SEQ ID NO: 26841 - protein, 11 aa, Artificial Sequence
  Description of Artificial Sequence: Synthetic peptide
  XENP021394 vlCDR1
QASQDIGNYLN

SEQ ID NO: 26842 - protein, 7 aa, Artificial Sequence
  Description of Artificial Sequence: Synthetic peptide
  XENP021394 vlCDR2
YTSHLHS

SEQ ID NO: 26843 - protein, 9 aa, Artificial Sequence
  Description of Artificial Sequence: Synthetic peptide
  XENP021394 vlCDR3
QQGNTLPYT

SEQ ID NO: 26844 - protein, 223 aa, Artificial Sequence; identical to SEQ ID NO: 25194
  Description of Artificial Sequence: Synthetic polypeptide
  XENP021395 2A11_H1_L2.48_Fab Heavy Chain

SEQ ID NO: 26845 - protein, 118 aa, Artificial Sequence; identical to SEQ ID NO: 17236
  Description of Artificial Sequence: Synthetic polypeptide
  VH of XENP021395

SEQ ID NO: 26846 - protein, 5 aa, Artificial Sequence
  Description of Artificial Sequence: Synthetic peptide
  XENP021395 vhCDR1
DYYMH

SEQ ID NO: 26847 - protein, 17 aa, Artificial Sequence
  Description of Artificial Sequence: Synthetic peptide
  XENP021395 vhCDR2
WIDPENGDTEYAPKFQG

SEQ ID NO: 26848 - protein, 9 aa, Artificial Sequence
  Description of Artificial Sequence: Synthetic peptide
  XENP021395 vhCDR3
RGVRQALDY

SEQ ID NO: 26849 - protein, 214 aa, Artificial Sequence
  Description of Artificial Sequence: Synthetic polypeptide
  XENP021395 2A11_H1_L2.48_Fab Light Chain
DIQMTQSPAFLSVTPGEKVTITCQASQDIGNYLNWFQQKPDQTVKLLIYYTSTLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26850 - protein, 107 aa, Artificial Sequence
  Description of Artificial Sequence: Synthetic polypeptide
  VL of XENP021395
DIQMTQSPAFLSVTPGEKVTITCQASQDIGNYLNWFQQKPDQTVKLLIYYTSTLHSGVPSRFSGSGSGTDYTFTISSLEAEDAATYFCQQGNTLPYTFGGGTKVEIK

SEQ ID NO: 26851 - protein, 11 aa, Artificial Sequence
  Description of Artificial Sequence: Synthetic peptide
  XENP021395 vlCDR1
QASQDIGNYLN

SEQ ID NO: 26852 - protein, 7 aa, Artificial Sequence
  Description of Artificial Sequence: Synthetic peptide
  XENP021395 vlCDR2
YTSTLHS

SEQ ID NO: 26853 - protein, 9 aa, Artificial Sequence
  Description of Artificial Sequence: Synthetic peptide
  XENP021395 vlCDR3
QQGNTLPYT

SEQ ID NO: 26854 - protein, 223 aa, Artificial Sequence; identical to SEQ ID NO: 25194
  Description of Artificial Sequence: Synthetic polypeptide
  XENP021396 2A11_H1_L2.49_Fab Heavy Chain

SEQ ID NO: 26855 - protein, 118 aa, Artificial Sequence; identical to SEQ ID NO: 17236
  Description of Artificial Sequence: Synthetic polypeptide
  VH of XENP021396

SEQ ID NO: 26856 - protein, 5 aa, Artificial Sequence
  Description of Artificial Sequence: Synthetic peptide
  XENP021396 vhCDR1
DYYMH

SEQ ID NO: 26857 - protein, 17 aa, Artificial Sequence
  Description of Artificial Sequence: Synthetic peptide
  XENP021396 vhCDR2
WIDPENGDTEYAPKFQG

SEQ ID NO: 26858 - protein, 9 aa, Artificial Sequence
  Description of Artificial Sequence: Synthetic peptide
  XENP021396 vhCDR3
RGVRQALDY

SEQ ID NO: 26859 - protein, 214 aa, Artificial Sequence
  Description of Artificial Sequence: Synthetic polypeptide
  XENP021396 2A11_H1_L2.49_Fab Light Chain
DIQMTQSPAFLSVTPGEKVTITCQASQDIGNYLNWFQQKPDQTVKLLIYYTSALHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26860 - protein, 107 aa, Artificial Sequence
  Description of Artificial Sequence: Synthetic polypeptide
  VL of XENP021396
DIQMTQSPAFLSVTPGEKVTITCQASQDIGNYLNWFQQKPDQTVKLLIYYTSALHSGVPSRFSGSGSGTDYTFTISSLEAEDAATYFCQQGNTLPYTFGGGTKVEIK

SEQ ID NO: 26861 - protein, 11 aa, Artificial Sequence
  Description of Artificial Sequence: Synthetic peptide
  XENP021396 vlCDR1
QASQDIGNYLN

SEQ ID NO: 26862 - protein, 7 aa, Artificial Sequence
  Description of Artificial Sequence: Synthetic peptide
  XENP021396 vlCDR2
YTSALHS

SEQ ID NO: 26863 - protein, 9 aa, Artificial Sequence
  Description of Artificial Sequence: Synthetic peptide
  XENP021396 vlCDR3
QQGNTLPYT

SEQ ID NO: 26864 - protein, 223 aa, Artificial Sequence; identical to SEQ ID NO: 25194
  Description of Artificial Sequence: Synthetic polypeptide
  XENP021401 2A11_H1_L2.50_Fab Heavy Chain

SEQ ID NO: 26865 - protein, 118 aa, Artificial Sequence; identical to SEQ ID NO: 17236
  Description of Artificial Sequence: Synthetic polypeptide
  VH of XENP021401

SEQ ID NO: 26866 - protein, 5 aa, Artificial Sequence
  Description of Artificial Sequence: Synthetic peptide
  XENP021401 vhCDR1
DYYMH

SEQ ID NO: 26867 - protein, 17 aa, Artificial Sequence
  Description of Artificial Sequence: Synthetic peptide
  XENP021401 vhCDR2
WIDPENGDTEYAPKFQG

SEQ ID NO: 26868 - protein, 9 aa, Artificial Sequence
  Description of Artificial Sequence: Synthetic peptide
  XENP021401 vhCDR3
RGVRQALDY

SEQ ID NO: 26869 - protein, 214 aa, Artificial Sequence; identical to SEQ ID NO: 22059
  Description of Artificial Sequence: Synthetic polypeptide
  XENP021401 2A11_H1_L2.50_Fab Light Chain

SEQ ID NO: 26870 - protein, 107 aa, Artificial Sequence; identical to SEQ ID NO: 22060
  Description of Artificial Sequence: Synthetic polypeptide
  VL of XENP021401

SEQ ID NO: 26871 - protein, 11 aa, Artificial Sequence
  Description of Artificial Sequence: Synthetic peptide
  XENP021401 vlCDR1
QASQDIGNYLN

SEQ ID NO: 26872 - protein, 7 aa, Artificial Sequence
  Description of Artificial Sequence: Synthetic peptide
  XENP021401 vlCDR2
YTSYLHS

SEQ ID NO: 26873 - protein, 9 aa, Artificial Sequence
  Description of Artificial Sequence: Synthetic peptide
  XENP021401 vlCDR3
QQGNTLPYT

SEQ ID NO: 26874 - protein, 223 aa, Artificial Sequence; identical to SEQ ID NO: 25194
  Description of Artificial Sequence: Synthetic polypeptide
  XENP021402 2A11_H1_L2.51_Fab Heavy Chain

SEQ ID NO: 26875 - protein, 118 aa, Artificial Sequence; identical to SEQ ID NO: 17236
  Description of Artificial Sequence: Synthetic polypeptide
  VH of XENP021402

SEQ ID NO: 26876 - protein, 5 aa, Artificial Sequence
  Description of Artificial Sequence: Synthetic peptide
  XENP021402 vhCDR1
DYYMH

SEQ ID NO: 26877 - protein, 17 aa, Artificial Sequence
  Description of Artificial Sequence: Synthetic peptide
  XENP021402 vhCDR2
WIDPENGDTEYAPKFQG

SEQ ID NO: 26878 - protein, 9 aa, Artificial Sequence
  Description of Artificial Sequence: Synthetic peptide
  XENP021402 vhCDR3
RGVRQALDY

SEQ ID NO: 26879 - protein, 214 aa, Artificial Sequence
  Description of Artificial Sequence: Synthetic polypeptide
  XENP021402 2A11_H1_L2.51_Fab Light Chain
DIQMTQSPAFLSVTPGEKVTITCQASQDIGNYLNWFQQKPDQTVKLLIYYTSLLHSGVPSRFSGSGSGTDYTFTISSLEAEDAATYFCQQGNTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26880 - protein, 107 aa, Artificial Sequence
  Description of Artificial Sequence: Synthetic polypeptide
  VL of XENP021402
DIQMTQSPAFLSVTPGEKVTITCQASQDIGNYLNWFQQKPDQTVKLLIYYTSLLHSGVPSRFSGSGSGTDYTFTISSLEAEDAATYFCQQGNTLPYTFGGGTKVEIK

SEQ ID NO: 26881 - protein, 11 aa, Artificial Sequence
  Description of Artificial Sequence: Synthetic peptide
  XENP021402 vlCDR1
QASQDIGNYLN

SEQ ID NO: 26882 - protein, 7 aa, Artificial Sequence
  Description of Artificial Sequence: Synthetic peptide
  XENP021402 vlCDR2
YTSLLHS

SEQ ID NO: 26883 - protein, 9 aa, Artificial Sequence
  Description of Artificial Sequence: Synthetic peptide
  XENP021402 vlCDR3
QQGNTLPYT

SEQ ID NO: 26884 - protein, 223 aa, Artificial Sequence; identical to SEQ ID NO: 25194
  Description of Artificial Sequence: Synthetic polypeptide
  XENP021403 2A11_H1_L2.52_Fab Heavy Chain
